United States Patent 9,073,990 (PROTEASE-ACTIVATABLE PORE-FORMING POLYPEPTIDES) - sequence listing, part 7

SEQ ID NO: 19045 - protein, 670 aa, Legionella pneumophila
MIKDNLCRYIWLRFYLFCFVCWLCASLQAQQVGDSITGKVHAIPEVGIKGRRVPPALSATAPLQQMKKTDMERLGVSDVADAVRHFSGVSVKDYGGVGGLKTVSVRSLGAQHTAVSYDGVTVSDCQSGQVDISRFSLDNVSELALSIGQSDNIYQTAKMFASAGALSIETARPDFSDRPLRLLANMKTGSYGLANPSLFYAQKLSNRFSLSAHADYLRADGNYPFKMWNGNKLIDSKRNNSDIETYRAELNLFVTLNEKQDLKAKVYLFDSERGLPGGVIYDNPYAAERLYDRNYFGQLKYENRFSEKWKLQASGKFNFSWNRDYNNESSGITDNRFRQTETYLSATLWNEPVKGLSFSLAQDFAYNYLSTTLQNNQYPERFTYLTAIATHYKSNRFSATASLLNTYITENVRTGKAAADRKRLSPAVSLSWKPFDFGLRFRASYKDIFRTPTFNDLYYLVIGNHNLKPEVTRQFNVGTTWSSTSLEFIDYLSLSVDAYYNRVKDKIVAVPTMFIWKMMNLGKVETIGTDINLAIEKELAEHYKLYLTGTYNFMQAEDITDRNSKIWRNQIIYTPKHSGSGSLTFENPYVNLTYNIMYASERYSIAQNIPENRIKSYTDHSISLSHTFKWKKQSLRIQLDALNLSDKNYEIVRFYPMPGRNYKVTINYKL

SEQ ID NO: 19046 - protein, 308 aa, Legionella pneumophila
MKNKIVLLAPVSLSFLFSCSTYAADYEFNGLSLSASLGILSGKAHEYVYHPETDTKLSQLDWRIKNAPIIKGELNYDFLDWLSMNSRGWTTLVKNKAAMDDYDWLNPYQDTWTHWSHHEDTYLNYANELDMSLRAWLMQKQNYKLGLATGYQWNSFDWKATGGCYQYYGGLYAGCFPGDQPGIGYQQKFRTPYIGLAGKYFINNFEFSGLLKFSDWVSARDHDEHYARNLTFNERGNSSRYYAATIHSGYFLKPNTKIFVEASYNHYSNGRADTEIIDNDTGERSYFGDSAGLSNKHYTVALGLQYLF

SEQ ID NO: 19047 - protein, 711 aa, Legionella pneumophila
MNVWIKKTDAFKPSLLAAAIATTMTSGVYAAEVNLPAADQSVDEILVVTGSRTEEKLEDVAGAVSVISADDIDMQVSNGLADVFRYDPSIQSTGTQGQAQTLSIRGIGGNRVEYIKDGRRLNDAYAGGGGYLVGRGYLDVAQVQQIEVAKAAASPLYGSDGLGGVIVISTPDPSDVLNGNDKAARLSFGFDGLTDETKLGFSGARQFDGSSAMIQVSARQGQETQNYEESLPGYDYDSQSVLAKWALDIGDDELKFTLDHFQQNTQQFIAETNQTDDDNRQTALSVGYQRNQPNAFADSQHWQLYLTDYEQGSDQVSAGASQAGAYTDYNDYGFEQRIMGARWQAQKQLDAASTRHDLVYGFDADYYDTERPRFKTRIASDGTVMQDNEPQKAFPGAETWLTGVFLQDNITFKETAFKLIVGARVDHYEMSPNENTLYDMSELADINETAFSPKVAGVYTFESGIRGYLQYAEGFKIPPHDQAYQSHGIEPFYAILPNPDLQPESSRAVEAGLKFSNDTTRWNLAAFYSRFDDFIETAVVGTSPTYIPGVDRVEYQYVNQDEVTIKGAEASVTHWLTDFMRVDTSAAYVTGENDATGEALTSLSPLSGNFSLGYFADNWHIRGIVNAVAAMDDVPSASAESGPYIETAGYTTVDVLAGVRLGDWQVNLAALNVTDKYYVPYQRVAGLSADAPTEQYSQPGRSFAIQASYRF

SEQ ID NO: 19048 - protein, 329 aa, Legionella pneumophila
MKIKFLLSMIGVILSTQSAYAKIPDSSASRAQNINDNKGAKNANNFLKKITPEFAYSYIDFNFDSTAGLNFNRYNGHSNLYSIGADHFSPVPSIIAGLYVLNIDTEVSSQFQLFPNTPIPSSQTIHNNTLFAHMRKIFTPKFDIDIAGGYGQNRINSQTLLNRGITDIAFSKHTNDNWLASINAVYRKRGKKISLRTYVGMLYSQINSGSYILAFQSNQRGQIIAPLTTKTTYIMEGAEISYKLKPALTPFVNGGLIQIADFTNSRPILTQQINGSLPQLNMDKNGYKLGAGVIFNYKQMTLRLEEKYYSAGNIFESYQTTAGLEYRFN

SEQ ID NO: 19049 - protein, 730 aa, Legionella pneumophila
MLISGVAKVGRVERKSIVFIMLGFGAEAVGFGLLAPRAFAQEQLPTIDVVAEGPTLPSASEILIRDTQRMDRARDNLSPRGGATAYDLGRQAIEGLPQGDNASLDKIVLQMPGVTQDSVASGDFHIRNEHANVQYRINGVLLPDGVSGFGQILDPAFIGNLALIDGVLPSRYGLRTSGILDITTRSGVFDNGGDVSLYGGSYSSIMPRLSYGGTSGKTQYFAVGRFFSNGLGMENLTIGHQAFHDASQQGRFFGYASTMLDDATRLSVITGFSINRYQIPNNPGQSPQFTVFGINDFNSLNINENQVERSFYNVLAWQRSVGDIDAQVAYFSRYSSVHYIPDQLGDLLFNGVASNVFRDSLLNGVQGDAALHAGPNTVRFGFQVSAEYTRAINSNTVLPLDGDGNAIDAPFTLGEAVPKTGFLGSVYAEDEWRINDQLTLNAGLRFDQMNQYVSANQLSPRFSLVYVPMEGTAFHIGYARYFTPPSQSLSAPVDQAIYANTTLQPEVTTQSPVRPERSHYFDAGVTQQLTPQLSTGIDVYYKNARNLLDDGQFGQAYVLTTFNYDRAYNTGVEFKANYQDENLRAYANFAWARQRATQVSSNQYLFGADELAYIDSHYIYTDHAQKISASAGFSYLWQGTRFGVDLIYGSGLRSGFANTESLSPYAQVNLGLSHDFKLSDAGKGQPLTVRFDIINLFDHGYAIRDGSGIGVFAPQYAQRRSFYAGLSYKF

SEQ ID NO: 19050 - protein, 1215 aa, Legionella pneumophila
MRLIFQTKLILMITQSRFSVHFAVAGSAIATFLFPITAYADSSLNSYVEISTGDELGTDQVDMSTGGWIRTVATGTIDLVPEIDILDGATVRFSAIPGSDLNLKLYRVGTGAELHFGGAADSGTVTLADFFFSGGNQDVFVDSGTLLVPEDGQGALLRASTTTVASGATVDLGSHSDWIASLAGSGTIRLNDADLEIRNFSFDGTIDGANRVTFSRGGSWRGRFADVDEVALSANQTLTIVDAGAAANLSTLDSLRLSSGSTFDLTSYDASLNSLYGAGLIGTTETLAIGSGNYSGGIVAGRGLTISGDFQWSGQSQGALSINVLSGATLTANGGNVFGGSADISLDGALYVNASEAVDALTGSGTVEVANNAILSVGAGDSSTTFDGEISGQGGLTKAGTGTFILSSRQSYTGATTVSAGTLQLMSVNAVPATSPLEVRTGAQLNMAGFNQAFASLTGNGNILLGNANFSIGGVGGSGSFSGVISGSGSVTKSGAGTLGLFGNNSFSGGMTVVGGTLAVSSSASLGDGSTTNTLTLDGGTLQTFGSVASPAARGVVIGSAGATVDTNGNAVTFAGGVSGAGQLTKTGAGTLTLSGNNTRSGDTEIDQGRLAVQNGGALADDARVNIADLAGAGLDVATSETIGSLSGGGLSGGDVSLSNAAILTVGGDDSSSTFGGSITGDGSLIKTGSGLFQLTGNSTYTGDTDVLDGTLSVNGSLTGAFNIGSGARLQGTGSVGTTSLAAGSVLAPGNSIGTLTVTGDLNFDPTSNFEVEIGSTGLSDRVDVTGTAFLNGAKVQTILWDPSVSYVNGQSYTIVSAGTVSGTFGDLEIDSAFLKSFLSYSATDVTLTLRTVLSPGSLFPSAALTYNQQQSAYGLDFLDQTSGSSSLALYNAILYSDRAEARDAFDQLSGEIHASLQSGLFSEANDVRNTVFDRLDEVFQSGGRAWTSAYGNISTLESDGNASSATNARGGALYGADWMIDDISAGVFAGFGQSLFEISDLGSTANVDSVHLGLYAAQRSGNFEIKLGASNSWYDIETRRNIAFPGFSDTQTASYHGNTAQVFSEASYDFRFSQSLIVTPFGRLDYGISHRDSFEEDGGAASLSGESAREDMFASTVGLRAQRQSVIADKTVTTGIDVAWRRALYQGTPLSHLTFENGGSFTVKGVQNSSDSVVAGGSVAFQLASDASLALSYRGEFGDGFNRHSGSARLDVRF

SEQ ID NO: 19051 - protein, 190 aa, Legionella pneumophila
MKRLISCLTIICALNASAAAETTSNPCSRWISFLKPVCQRIHQTWAEGHDDMYFSGYAWHNRYVYSNEKIKSYNETAWGGGLGKSLFDEKGNWHGLYAIAFLDSHRHFEPAVGYAYLKTASVNKDLKAGLGYSVLVTSRVDYDNVPIPGALPWAALFYKRITIAATYIPGSSREGHENGNVLYMLGKISL

SEQ ID NO: 19052 - protein, 157 aa, Methylococcus capsulatus
MEFYMKAFNKLFSLVVASVLVFSLAGCGDKEESKKFSANLNGTEIAITYVYKGDKVLKQSSETKIQFASIGATTKEDAAKTLEPLSAKYKNIAGVEEKLTYTDTYAQENVTIDMEKVDFKALQGISGINVSAEDAKKGITMAQMELVMKAAGFKEVK

SEQ ID NO: 19053 - protein, 1055 aa, Methylococcus capsulatus
MLKRFRPVSLILLVGALGFSGNLYATPMSGIPRVDISQQNAKVSGIVEDALGPVTGASVIVKGTTNGTMTDLDGHFTLDNVKKGDIIQISFIGYTSQDIPYTGQSEITVKLVEDTQKLDEVVVTALGMKRDKKALGYAMQELKGDDLLASREPNLANSLSGKVSGLQIVRSSNGVGGSSKIVLRGNNSLTGSNQPLIVVDGTPMDNFTGGVDDVWGNSGADMGNGLSDINPEDIESMTVLKGASAAALYGSRAGNGVILITTKSGRKNEGLGITINAGITAETIFLKPDLQNDFGQGSVGVYDNQSRLSWGPKAMGQMVTDWRGNQIPLHTYDNIDAFFRTGTSFNEGVSFQQNIKGTAVFASVNRSDDASITPRSKLNKTNITLRATTFLDEAEKWKVDAKVNYINQNAHNRPIQGVNPSNAFNTIYNLPRSLNIREFEDDVDEQGNMIWYDASKNPQENPYWVTRYRQNEDTRNRLLGNISLKYAPTDWFDIELRGGTDYYTTTKSEKVYAGGNTSPRGLYTEGSETFYENNFSFLATARKDNLIDRLGGFVTFGGNLMLQQRNKMNASAGELLVPNLFSLNNGVNKPTVTSELIRRRMNSLYGSLQLNWDGYLFLDVTARNDWSSTMSKANRSYFYPSVSLSAVISDMLPKIGGSMPDWFSFAKVRASFAEVGNDLDPYQLYNFYSVGKDPNGNTTAKPGKVLYDSDVRSELIKSWEAGFDIRFFNNRLGLDAAWYKSNATRQLLDLPMDPFSGYASRKINAGNIQNEGLEISLNGTILDNPAGLSWSSTAQFSLNRNKIKELYEGVNLYDIKTFDAIQIVAPVGGYYGEIYGQTFMRVTDENSPHYGKIVVGDDGLPLISTEKSKVGNQSPDWMMGWTNNFSYKGFNLSFLIDFRIGGSIYSATASNLYTRGNAAGTVVNGDRAEFVVPNTVVQQGSGYAENTVAVTPQNYWERIGSTGNYGLPEVYTYSATNVRLRNITFGYEFNRQMLKKTPFQRVRLSATCNNVWMIHYNLPGIDPESVAATNTNATGFENGAAPTSRSYTFNVTVGF

SEQ ID NO: 19054 - protein, 684 aa, Methylococcus capsulatus
MQARKKKLPLAISLALAAIGPAIAVEPTELDVINVTSHYNNAVGSSNAASQGTATSSLVENRPALRTGELLEFVPGMIVTQHSGDGKANQYFLRGFNLDHGTDFATYVDDVPVNMRTHAHGQGYTDINFIIPELIDRIDYKKGPYFADEGDFASAGAAHMRLADKLPSGIASITAGSHGYQRTVLADSFDAGSGTLLYGLEVTRNKGPWDNPEDLRKYSGTLKYTGGNQYEGFSITGMAYKNTWNSTDQIPQRAINAGLIGRFGAIDPTDGGSTSRYSLSYAMHKRSQDSLFELNAYAVQSKLNLFSNFTYLLDNPIDGDQFQQSENRRMYGLNAAQTWIDKIGGITMQNKIGFQTRYDRLSPVGLYDTIAQERTATVREDKVKEASIGVYAENSAQWLEKFRTVAALRYDAYRFNVDSDIAGNSGKARDHTVSPKLSLIFGPWAKTEYFVNYGKGFHSNDARGTTQTQLPGGGASTPVTPLVATRGAEVGLRTEIIPNLQSSLALWRLDIDSELLFVGDAGETEPSRASRRTGIEWNNHYIARPWLLFDLDLALSRARYRDADPAGDYIPGSIDRVVSFGATVTGLGRWYGAFQYRYFGARPLIENNSVRSKATAIAYARVGYKVNPKTRLTLDVFNLFDRKASDIDYYYSSRLNGEVAGGVNDIHSHPVEPRSVRLTLTHNF

SEQ ID NO: 19055 - protein, 1099 aa, Methylococcus capsulatus
METTYLNVCDRPISRWSIVRLLKTVLLLLCVSFSSVYVQASDRNEGITISCKNESLEQVIHLIESQSSYLFVLNDKVNTKHKVSIKIENGNINAILNKIFQGTNMTYQVDGDHILISTTHKSIGLDETRQATMIKGKIVDNAGEPMIGVNVLVKGTTNGAITDFEGNYSLADVNENDVLMVTYIGYLTQEIKVGKQSVINVVMKDDTQSLDEVVVVGYGVQKKSDLTGSISSIKPADITSTPTTNALKSLQGKVAGLDITQSSGQPGASISLTMRGNRSLKADNNPLVLVDGIDYGSFVDINPTDIESIEVLKDISSTAIYGTKGANGVIIITTKSGAKGQKTKIDFNAYVSIKNKAKYPRMMNGEEYAQLKREAYRTTNSAAPDQYMDDALIFNAEELEYLEKGYWVDWQDLLLGTGITQNYEISMSGGTEKTSYSLSFGFQDDKGLLKNDVLKRYNGRISLDHKINKIFNVGVNVSYTFKDQDKRQNPLNLANKIPCIGRAYDDNGNFILNPAPGNSSAFSPLCDEQPGAYEDNIRTKRMFASGYLNVNILKDFFFKSTIGIDVTDSREGIYKDKNTVANLGVKSTSSVQADNDWRYTWENILNYSKTFGKHGLTAMIGSSTTAYGYEKVLASGANQASALTSFHDLGANADSKENASQLIETQMVSFFGRLNYKFNERYLFQASLRADGSSVLAKGHKWGYFPSASAAWRISEEGFMADQDIFSNLKLRLSWGVAGNSAIDAYATLGGLKKSVYTFGSSVYGYYPSEIANKDLTWEKTSTWNLGLDFSILRNRISGTIDTYISQTSDLLLPSLLPSSTGYASVMQNIGKTENKGIEVTLNTIWFQNKNFSWNTDWTYSLNREKIKALNSGVTRDEGNLWFVGSPTQVFYDYKKIGIWQLGEEVQAKAFGGFKPGDIKVADMSPKGSEGEGVFSTDDRVIFSRVPKYTFGITNNIIYKNFDLMFFIYGRIGQYVKDAYTQLYKPSALENSAPVNYWTPENPSNEYPRPNSGYSTNSYLLQSSLAFRKASFVKIRDITLGYTLPKEWTSKMMVQKLRIYCSLNNFITFTDFPNYDPESNGSMDFPLAKQVLFGINLSL

SEQ ID NO: 19056 - protein, 840 aa, Methylococcus capsulatus
MHGCRRHSVAAWRAIPTGLRARDNGRQDMISNARFTAFTFAALAGASLLPLASAHAQAAPQDVAADSEQASDGSGIGDIIVTARRREERLQDVPVSVTALSAEQIRKYDMTSLEKISTQTPQLTIGRASNGSGAQLTLRGIGSSSTSIGIEQSVAVILDGVYYGQGRVINEGFLDLAGVEMLKGPQALFFGKNATAGVISLRSANPSNSPEFMARAGYEFKAKNLVGEVMGSGPLSDTLGIRIALRGSNMFGGYFKNGGIDKTYNTTNINTGVVTPHLAPALTGDNPGEREVLGRVTLQYKPTDRLTATLKANASFNDNDNNSWNYVPVACANGTYALNPAIKCGKQFTIYQNRFPEDLAGTNPFSRADGGLYNRYRSWAVTGTLDYALDDLTLTWINNFNRNVNQWACDCTFVSSDAAAAPSTEKSKYHAFSSELRAQTSYDGPVNVLAGIYYQKTRRDHTQTGSFGNVEDDTAPAAYRYLGYLKRSETDGETISGYGQATWKLVEGLEATAGVRYTHETKDSYLVQPYVNAALQFLFPQDKVIRAGQAFDNWSPEATLTWKPTSDITVYGAYKTAYKSGGFSNSGFVSTGTVPSDVAFNPEKARGFEAGIKTTLLDRQLRVNLGVYTYKYVDLQVDFFNSNTFAFITTNAGGVRTRGVELEFEFAPRALDGFNLHGTVNYNRARYTNYIAPCYGGQSVDAGCDTVFQGAGGQDLSGKPTAVAPAWTGSFGFSYETPVADNLNFGLSADSRYSGSYLASSFAHPLSRQDEYLTIDASVRLRTADDKYELALIGKNLTNRFIVGGVVDAPNTPAVVGQVADQMGFVSLPRTVQVQATVRF

SEQ ID NO: 19057 - protein, 783 aa, Methylococcus capsulatus
MKGFASFRNCQKGPVIGFYTLLRRQVENGEEDSMKRISALMVGVALAGLCGSASAFAQDAAGQRGAEASGDEDGGDIVVTARKRSELLQNVPIAVSAITEETAARSGVTGIEAVTFSTPNLQFNREISQGATPFLRGVGSPQASAGGESPVAVYIDDVYIGSPNGNMFEFNNIASVQVLKGPQGTLFGRNATGGVIQVQTKAPSFDPAMEIRAGYGNYDTYSGAVYATAGLGENVAFNIAASGSKQNDGWGRSLITGREIHKGWDWNVRGKLLFQAGENTELTLSGDYGKQSSDIGSNATVYPGSVALSGPTFQGRNTQTAGLDFADVKQGGVSLKIDHEASFADLVSITAYRYTKVAFDLDQDLGMAPLVQVGTVVTPTKTFTQELQIVSKPDSPIKWIVGLYYLHTKTGYDPSRSSGVFIVGPYAGVGVTNSVSLFDTQKLNSYSAFGEATVPVLSDTNLTVGLRYTRDVYDLQVDGRVGDDTFTIPDARGAPFAKHDVFPKLTYRAILDHKFTPDIMAYASYSRGFRSGGYQLAFPGTSVAPAAVVKPEVLDAFEVGLKTQFFNGALTLNGAAFYYDYKNMAISFVQPGGNLIENAAAARIKGLDIDFIANPVKGLRISGGIGILDGEYTDFPNGPILLPLTTPTPANCFAPPPQQVAGGNLVCSGNLSGKTTIRTPKFTLTLAPSYTFETGIGSFTIGANYYHNSGFFWEVSNRTSQAAYDVINGSLSWKSPSDSFEIRLWGKNLTDKYYAVYSSPTQLNDLLAPAAPRTYGVTATVRF

SEQ ID NO: 19058 - protein, 1065 aa, Methylococcus capsulatus
MDKKKNVKFVRYGSSFILLIAALSLFSNYGYANNSTLIERIDMLQQQNSPLKGRVVDKDGIPLIGVNIVVDSATGTITDVDGNFSVNVLAPVELKVSYIGYITQNVIVKNTDKELHIVLIEDAQTLEEVVVVGYGSQKKVTVTGAVASVQTAELTQNSAANLSTALAGRLPGLTALQTSGQPGVDDVAIYLRGVSTTNGQSPLILIDGVPREDIGMLDPNEIQSVSILKDASATAVFGVRGANGVIMVTTRRGEAGKSQLSVSVNYSLQRFITTPTRVHSWEFAELRNQAFLNDGTSADNLPFTDYMIDMYRNGKDRVFYPDRDVQSEFFRKWAPQTKVNINLSGGNDKLTYFLNAAYMGQGGQLKTESTERLSYDPAFSNDRYNFRANVDYKIAKNLKLSLNLASYLEKVNSPQTKDLFGSNTSTTSMVAQSMSYIWSIPSTQPGSLTAEGYTLEDGTPVPGGEVIAQPGTGGRNIYGDLNRRGYRQQTNSNLNSSVTLDWGLDFITKGLSTKIMAAFDTKSRTIRQGVRLYDQYDVHVATTPDDRCYYTEIQSNQNDALNLSKTASTNYYLNLQYSINYERDFGLHRVTGMALVQRDSWQQYAADLPYNMLGISARATYAYNMKYLMEVNLGYNGSEQFAKKKRFGFFPAFSAGWVVSNERFLEKNKTITNLKLRASYGKVGNDQLGSNRFLYLDDIQMASGVIPSLGRGQSISINKKGNPDVGWEIAYKQNYGVDIQLFNELSFSFDYFRERREDILIQRSTVPELQGLPLSALPKVNMGMVHNSGFELEVGYNRKLNKDFSFGVKGNFSYNKNKIDYIDETCLPEEYAYPYRKTGYSIGQIFGYKIDYSNGNGYINTVEELEWAKKTYKIGTPRMGDLLYKDVNGDGDIDPEDISPIKYSNIPRITYGFSGNLSWRNLDFSFLFSGVAKVSKYYSNFGVTEIGLVGFYTGYHLNAWTAERYNSGRKIEYPALSANTTTSMTANDFFVMDRSFLRLKNIELGYTLPKLLLEKIKIQKLRIYVSGNNLLTFKKMKLNSIDPEQSSETAYPVTKMVSFGANVTF

SEQ ID NO: 19059 - protein, 1073 aa, Methylococcus capsulatus
MYRKHVGRALILALMLSGATSMNAQRITRQFKNVPLKTVLAEVEKELQYSIIYKKDEVNERKQITRDFKDASLEEVLSAVLDNGLSYSVQGKMIVISKKEAAGSSITQQKQIIVKGIVKDENGEPVVGANVVEKGTSNGTITDMDGNFSLSISEGSKLSITYIGYLDKDVAVSKGKTTLNIQLKEDTQALDEVVVVGYGSVKKRDLTGSVSQISSSSIQNQAVMKDPMQALQGKIAGADITMGNSPGASSTIVIRGYNSINAGNDPLIVVDDAPFGGKIDEINPAEIESIDVLKDASSTAIYGSRGANGVVIITTKRARKEAKLSVSYDGYVGVSKSFKNYDMMSGEKYADWKRMANYGKTDKEIFDDIQLKALNSGQFVDWQDLMFSGTGYKTDHNVSINQSNGRNRNMLVLGYNKDQSIIDNMGYERFSARINGDMELAKNLTVGYSSLLALTTRNNGDNSVWKYGTVIDPLTEVYDENGDMRFYNSGWYQTVLHSNPLFDTDKNNVDNKEKRTRILLNLFADWEIIKGLKFRTSLTYGLSSIENGVYKSSTSQARQLASPSAEYKKTNEQQITFTNVLNYKKVLNDHSLDVSLVHDMQTDKAELVGLTGQDMPYYGSWFNVNEAPDVFTRLSSVRKWALLSFMGRVNYTFKDRYLLTLTGRYDGSSRLAKGNKWDFFPSVALAWRMNDESFLREVDWLSNLKLRLSWGNSGNTAISEYATQGALGKYVYYFGTTEQSAMGYLPTELANNQLGWESTEEYNVGVDFGFLNNRISGSIDGYIRNTRDLLMKRNLPINTGYEFTWQNVGKTRNSGIEIALNTVPVVTKDFRWTVDLTFGYNKNEIVELFNGKEDSPGNKWFIGQPLYVERLYKYIGVWQYGEEEEAAKYGREPGNPKIEDVNNNGVYDEGDLHTFNKIPKWTAGLSTGFYYKNFDLNVYFYTRQKYGQLLGVLTDEAGSTRYNHLDVDFWTPDNPSNACPKPAITNPQELLVSSDYAYRDLSFIRLKNINLGYTLPKEISKKFYSEKFRVYFMVENPYTWTKSDYVGLDPENCNSYTDHRPLTSFIFGVNASF

SEQ ID NO: 19060 - protein, 1089 aa, Methylococcus capsulatus
MNFYRLKSIFFIIFSCFILQTAAFAQNNVKITIKKKNITLQEALREVEKQSDYLIAFNESKLEKTKRVNLNINAESLDKTLASILSGTGLSYKIKDKYIMIIPQSKVEVESKKLSGIVKDDKGDPLIGVNVSFKGSPTGTVTGLDGRFSILAAKGNIIEFSYVGYTTQYITVGDASSLTVVLEEDAKALDEVVVTALGIKRAEKALSYSVQQVKSDAINDVKDANFVNGLTGKVAGVSINRSSSGIGGATRVVMRGAKSIVGNNNVLYVVDGMPIGNPSKGEINNDYSTPGGGEGISDFNPEDIESLSILTGPAAAALYGSSAANGVILINTKKGQEGKLKISISNNTEFMTPYVMPEFQNRYGNAKGSYKSWGEMLQQPSTFRPKDFFKTGANIMNAANFSVGNKNNQTFVSVATTNSTGIIPNNEYYRYNFTLRNTASMLNDKLHLDLGASYVLQGDQNMLSAGRYFNPLVPLYLFPRGEDFEAVKVYERYDTNRKFPIQEWSYGDQGLNLENPYWIVNREMFVSKKKRYMFYANVKYDILSWLNIAGRIRVDNTNTTSERKLHASTIKLHAQSDKGAYNRSMEEYQQTYADIMLNVNKNFGNFNLTANAGFSYEDHLTTGMGIGGKLFTVPNLFSAYNFDPASGPGSQSHTHTRNNSVFVSTELGYKSMLYLTLTGRQEWASQLVNSDQPTYFYPSVGVSGVISEMVSLPKFISFWKMRASFAEVGGPINYTGLTPGTVTDPMKGGVINPISVYPFPNFKAEQTKSYELGTNLRLFNNKINIDATVYLTDTYNQTFLSSMSPASGYSGFYVQAGKVRNKGIELSLGYNDRFGKVGYATNLTYTANRNKIMKMVHDYKNPSDDSLFSITELTLQDKGGVYLREKDAIGDVYVKGILARGKDGKLIEEEGGYKVDRSQRIKIGSVNPDFSIGWRHNVTWNNITLDLLFNGRFGGIVTSSTQAFLDDYGVSKDTYKARQNGGVWVNGTQYDAEKYYTTIGGEQLMAYYAYKATNIRLQEASLSYTLPGKWFGNVINRLTVSAIGRNLWMIYNKAPFDPEMTSSTGTYNRGDVFMPPSLRSVGFSVKIEL

SEQ ID NO: 19061 - protein, 1310 aa, Helicobacter pylori
MEIQQTHRKINRPIISLALVGVLMGTELGANTPNDPIHSESRAFFTTVIIPAIVGGIATGAAVGTVSGLLSWGLKQAEQANKAPDKPDKVWRIQAGRGFDNFPHKQYDLYKSLLSSKIDGGWDWGNAARHYWVKDGQWNKLEVDMQNAVGTYNLSGLINFTGGDLDVNMQKATLRLGQFNGNSFTSFKDGANRTTRVNFDAKNILIDNFVEINNRVGSGAGRKASSTVLTLKSSEKITSRENAEISLYDGATLNLVSSSNQSVDLYGKVWMGRLQYVGAYLAPSYSTIDTSKVQGEMNFRHLAVGDQNAAQAGIIANKKTNIGTLDLWQSAGLSIITPPEGGYESKTKDNPQNNPKNDAQKTEIQPTQVIDGPFAGGKDTVVNIFHLNTKADGTLRAGGFKASLSTNAAHLHIGEGGVNLSNQASGRTLLVENLTGNITVEGTLRVNNQVGGAAIAGSSANFEFKAGEDTNNATATFNNDIHLGKAVNLRVDAHTANFNGNIYLGKSTNLRVNGHTAHFKNIDATKSDNGLNTSTLDFSGVTDKVNINKLTTAATNVNIKNFDIKELVVTTRVQSFGQYTIFGENIGDKSRIGVVSLQTGYSPAYSGGVTFKGGKKLVIDEIYHAPWNYFDARNVTDVEINKRILFGAPGNIAGKTGLMFNNLTLNSNASMDYGKDLDLTIQGHFTNNQGTMNLFVQDGRVATLNAGHQASMIFNNLVDSTTGFYKPLIKINNAQNLTKNKEHVLVKARNIDYNLVGVQGASYDNISASNTNLQEQFKERLALYNNNNRMDTCVVRKDNLNDIKACGMAIGNQSMVNNPENYKYLEGKAWKNTGINKTANNTTIAVNLGNNSTPTNSTTDTTNLPTNTTNNARFASYALIKNAPFAHSATPNLVAINQHDFGTIESVFELANRSSDIDTLYANSGAQGRDLLQTLLIDSHDAGYARTMIDATSANEITQQLNAATTTLNNIASLEHKTSGLQTLSLSNAMILNSRLVNLSRKHTNHIDSFAKRLQALKDQRFASLESAAEVLYQFAPKYEKPTNVWANAIGGTSLNNGSNASLYGTSAGVDAYLNGEVEAIVGGFGSYGYSSFSNQANSLNSGANNTNFGVYSRIFANQHEFDFEAQGALGSDQSSLNFKSALLQDLNQSYHYLAYSATTRASYGYDFAFFRNALVLKPSVGVSYNHLGSTNFKSNSNQVALSNGSSSQHLFNANANVEARYYYGDTSYFYMNAGVLQEFARFGSNNAVSLNTFKVNATRNPLNTHARVMMGGELQLAKEVFLNLGVVYLHNLISNASHFASNLGMRYSF

SEQ ID NO: 19062 - protein, 1303 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNNIDSFAQRLQALKGQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGASTRASYGYDFAFFRNALVLKPSVGVSYNHLGSTNFESNSTHKTALKNGASSQHLFNASANVEARYYYGDTSYFYMNAGVLQEFANFGSSNAVSLNTFKVNTAHNPLNTHARVMMGGELKLAKEVFLNLGFIYLHNLISNAGYFASNLGMRYSF

SEQ ID NO: 19063 - protein, 1303 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFAHYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 19064 - protein, 1296 aa, Helicobacter pylori
MELQQTHRKINRPLVSLALVGALVSITPQQSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNTAQAGIIASKKTYIGTLDLWQSAGLNIIAPPEGGYKDKPNNTNSQSGAKNDKNESTKNDKQESSQNNSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSHINTVRLETGTRSIYSGGVKFKSGEKLVINDFCYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENVSLGTNSISNANLIEQFNERLALYNNNNRMDTCVVRNTDDIKACGMAIGDQAMVNNPDNYKYLIGKAWKNIGISKTANGSKISVRYLGNSTPTENGGNTTNLPTNATNNARFARYALIKNAPFAQTNATPNLVAINKHDFGTIESVFELANRSKDIDTLYANSGAKGRDLLQTLLIDSHDAGYARTMIDATSANEITKQLNTATDALNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNGEVEAIVGGFGSYGYSSFSNQANSLNSGANNANFGVYSRIFANKHEFDFEAQGALGSDQSSLNFKSALLRDLNQSYNYLSYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNAARNPLNTHARVMMGGELQLAKEVFLNLGFIYLHNLISNIGHFASNLGMRYSF

SEQ ID NO: 19065 - protein, 1291 aa, Helicobacter pylori
MEIQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISLDNFLEINNRVGSGAGRKASSTVLTLQASEGITSGKNAEISLYDGATLNLASNSVKLMGNVWMGRLQYVGAYLAPSYSTINTSKVTGEVNFNHLTVGDHNAAQAGIIASKKTYIGTLDLWQSAGLNIIAPPEGGYKDKPNNTTSQSGAKSDKNESAKNDKQDSNTQVINPPNSGQKTEIQPTQVIDGPFAGAKDTVVNINRINTNADGTIKVGGYTASLTTNAAHLNIGKGGINLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENVSLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFARYALIKNAPFAQTSATPNLVAINKHDFGTIESVFELANRSKDIDTLYANSGVQGRDLLQTLLIDSHNAGYARTMIDATSANEITKQLNTATDALNNIASLEHKTSGLQTLSLSNAMILNSRLVNLSRRHTNNIDSFAKRLQALKDQKFASLESAAEVLYQFAPKYEKPTNVWASAIGGASLNSGGNTSLYGTSAGVDAYLNEKVEAIVGGFGSYGYSSFNNQANSLNSGANNANFGVYSRIFANQHEFDFEAQGAVGSDQSSLNFKGALLRDLNQSYNYLAYGASARASYGYDFAFFRNALVLKPSVGVNYNHLGSTNFESNSTHKAALKNGASSQHLFNASANMEARYYYGDTSYFYMNAGVLQEFANFGSSNAVSLNTFKVNAARNPLNTHARVMMGGELKLAKEVFLNLGFIYLHNLISNIGHFASNLGMRYSF

SEQ ID NO: 19066 - protein, 1290 aa, Helicobacter pylori
MEIQQTHRKINRPLVSLALVGALVSITPQQSHAAFFTTVIIPAIVGGIATGAAVGTVSGLLGWGLKQAEEANKTPDKPDKVWRIQAGKGFNEFPNKEYDLYRSLLSSKIDGGWDWGNAATHYWVKGGQWNKLEVDMKDAVGTYNLSGLRNFTGGDLDVNMQKATLRLGQFNGNSFTSYKDSADRTTRVDFNAKNILIDNFLEINNRVGSGAGRKASSTVLTLQASEGITSSKNAEISLYDGATLNLASNSVKLMGNVWMGRLQYVGAYLAPSYSTINTSKVTGEVNFNHLTVGDHNAAQAGIIASNKTHIGTLDLWQSAGLNIIAPPEGGYKDKPKDKPSNTTQNNANNNQQNSAQNNSNTQVINPPNSAQKTEIQPTQVIDGPFAGGKDTVVNIDRINTNADGTIKVGGYKASLTTNAAHLHIGKGGINLSNQASGRTLLVENLTGNITVDGPLRVNNQVGGYALAGSSANFEFKAGTDTKNGTATFNNDISLGRFVNLKVDAHTANFKGIDTGNGGFNTLDFSGVTGKVNINKLITASTNVAVKNFNINELVVKTNGVSVGEYTHFSEDIGSQSRINTVRLETGTRSIFSGGVKFKSGEKLVIDEFYYSPWNYFDARNIKNVEITRKFASSTPENPWGTSKLMFNNLTLGQNAVMDYSQFSNLTIQGDFINNQGTINYLVRGGQVATLNVGNAAAMFFSNNVDSATGFYQPLMKINSAQDLIKNKEHVLLKAKIIGYGNVSLGTNSISNVNLIEQFKERLALYNNNNRMDICVVRNTDDIKACGTAIGNQSMVNNPDNYKYLIGKAWKNIGISKTANGSKISVYYLGNSTPTEKGGNTTNLPTNTTSNVRSANNALAQNAPFAQPSATPNLVAINQHDFGTIESVFELANRSKDIDTLYANSGAQGRDLLQTLLIDSHDAGYARQMIDNTSTGEITKQLNAATTTLNNIASLEHKTSSLQTLSLSNAMILNSRLVNLSRRHTNNIDSFAQRLQALKDQKFASLESAAEVLYQFAPKYEKPTNVWANAIGGTSLNNGGNASLYGTSAGVDAYLNGEVEAIVGGFGSYGYSSFNNQANSLNSGANNTNFGVYSRIFANQHEFDFEAQGALGSDQSSLNFKSALLRDLNQSYNYLAYSAATRASYGYDFAFFRNALVLKPSVGVSYNHLGSTNFKSNSNQVALKNGSSSQHLFNASANVEARYYYGDTSYFYMNAGVLQEFANFGSSNAVSLNTFKVNAAHNPLSTHARVMMGGELKLAKEVFLNLGFVYLHNLISNIGHFASNLGMRYSF

SEQ ID NO: 19067 - protein, 1323 aa, Helicobacter pylori
MELQQTHRKINRPLVSLALVGLLVSITPQKSHAAFFTTVIIPAIVGGIATGAAVGTVSGLLSWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTAVNINRINTNADGTIKVGGYTASLTTNAANLNIGKGGVNLSNQASGRSLLVENLTGNITVDGALMVNNQVGGYALAGSSANFEFKAGTDTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNNARFARYALIKNAPFARYSATPNLVAINKHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNNIDSFAQRLQALKGQRFASLESAAEVLYQFAPKYEKPTNVWANAIGGASLNSGGNTSLYGTSAGVDAYLNEKVEAIVGGFGSYGYSSFNNQANSLNSGTNNANFGVYSRIFANRHEFDFEAQGALGSDQSSLNFKSALLRDLNQSYNYLAYGASTRASYGYDFAFFRNALVLKPSVGVSYNHLGSTNFESNSTHKTALKNGASSQHLFNASANVEARYYYGDTSYFYMNAGVLQEFANFGSSNAVSLNTFKVNAARNPLNTHARVMMGGELKLAKEVFLNLGFIYLHNLISNAGYFASNLGMRYSF

SEQ ID NO: 19068 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYQALLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSDKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTKSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQTNATPNLVAINKHDFGTIESVFELANRSKDIDTLYAHSGVQGRDLLQTLLIDSHNAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGMYSRIFANRHEFDFEAQGAVGSDQSSLNFKSALLRDLNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNATRNPLNTHARVMMGGELQLAKEVFLNLGFVYLHNLISNIGHFASNLGMRYSF

SEQ ID NO: 19069 - protein, 1295 aa, Helicobacter pylori
MELQQTHRKMNRPLVSLVLAGALISAIPQQSHAAFFTTVIIPAIVGGIATGTAVGTVSGLLSWGLKQAEEANKTPDKPDKVWRIQAGKGFNEFPNKEYDLYKSLLSSKIDGGWDWGNAARHYWVKGGQQNKLEVDMKDAVGTYKLSGLRNFTGGDLDVNMQKATLRLGQFNGNSFTSYKDSADRTTRVDFNAKNISIDNFVEINNRVGSGAGRKASSTVLTLQASEGITSSKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEVQPTQVIDGPFAGAKDTVVNINRINTNADGTIKIGGYKASLTTNAANLNIGKGGVNLSNQASGRSLLVENLTGNITVEGALMVNNQVGGYALAGSSANFEFKAGVDTKNGTIAFNNNISLGRFVNLKASAHTVNFKGIDTGNGGFNTLDFSGVTNKVNINKLITASTNVAIKNFNINELLVKTNGISVGEYTNFSEDIGSQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENVSLGTKSISNVNLIEQFNERLALYNNNNRMDTCVVRNTDDIKACGMAIGNQAMVNNPDNYKYLIGKAWKNIGISKTANGSKISVRYLGNATPAENGGNTTNLPTNSTKNAAKSYALIKNAPFAHYNATPNLVAINQHDFGTIESVFELANRSGDIDTLHANSGTQGRDLLQTLLIDSHDAGYARTMIDATSANEITKQLNTATTTLNNIASLEHKTSGLQTLSLSNAMILNSRLVNLSRRHTNNIDSFAQRLQALKDYKFASLESAAEVLYQFAPKYEKPTNVWANAIGGTSLNSGGNASLYGTSAGVDAYLNGEVEAIVGGFGSYGYSSFSNQANSLNSGANNTNFGVYSRIFANHHEFDFEAQGALGSDQSSLNFKSALLQDLNQSYNYLAYSAATRASYGYDFAFFRNALVLKPSVGVSYNHLGSTNFKSNSTNQVALKNGTSSQHLFNASANVEARYYYGDTSYFYMNAGVLQEFAHFGSNGVASLNTFKINAARSPLSTYARAMMGGELRLAKEVFLNLGVVYLHNLISNASHFASNLGMRYSF

SEQ ID NO: 19070 - protein, 1303 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYKSILSSKIDGGWDWGNAARHYWVKDGQWNKLEVDMKDAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 19071 - protein, 1324 aa, Helicobacter pylori
MELQQTHRKINRPLVSLALVGALVSITPQQSHAAFFTTVIIPAIVGGIATGAAVGTVSGLLGWGLKQAEEANKTPDKPDKVWCIQAGRGFNEFPNKEYDLYKSLLSSKIDGGWDWGNAARHYWVKGGQWNKLEVDMKDAVGTYKLSGLKNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAANLNIGKGGINLSNQASGRSLLVENLTGNITVDGALMVNKKAGGAALPGSSANFEFKAGVDTKNGTATFNNDIHLGKAVNLKVDAHTINFNGNMYLGRFTHLKVNGHTANFKDIDASKGRNGIDTTILDFSGVTNKVNINKLTTAATNAAIKNFDIKELVVTTNVLSVGKYTDFTEDIGDQSHIGIVRLQMGYSPAYSGGVTFKSGKKLVIDEIYHAPWNYFDARNITDVEINKKILFGAPGYIAGKTGLMFNNLTLNSNASMDYGKDLDLTIQGHFTNNQGTMNLFVQDGRVATLNAGHQASMMFNNLVDSATGFYKPLIKINNAQNLTKNKEHVLVRARNIDYNLVGVQGASYDNIFASNTNLQEQFKERLALYNNNNRMDICVVRNTNDIKACGMAIGNQSMVNNPENYKYLEGKAWKNTGINKTADNTTIAVNLGNNSAPTENGGNTTNLPTNTTNNARFARFARYALIKNAPFAHYSATPNLVAINKHDFGTIESVFELANRSKDIDTLYAHSGAQGRDLLQTLLIDSHNAGYARTMIDATSANEITKQLNEANSALNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVNAYLNEKVEAIVGGFGSYGYSSFNNQANSLNSGANNANFGVYSRIFANRHEFDFEAQGAVGSDQSSLNFKSALLRDLNQSYNYLAYGATTRASYGYDFAFFRNALVLKPSVGVSYNHLGSTNFESNSTHKTALKNGASSQHLFNASANVEARYYYGDTSYFYMNAGVLQEFANFGSSNAVSLNTFKVNAARNPLNTHARVMMGGELQLAKEVFLNLGFIYLHNLISNAGYFASNLGMRYSF

SEQ ID NO: 19072 - protein, 1296 aa, Helicobacter pylori
MELQQTHRKINRPLVSLALVGALVSITPQQSHAAFFTTVIIPAIVGGIATGAAVGTVSGLLGWGLKQAEEANKTPDKPDKVWRIQAGRGFNEFLNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDHNAAQAGIIASKKTYIGTLDLWQSAGLNIIAPPEGGYKDKPNNTNSQSGTKNDKNESAKNDKQESSQNNSNTQVINPPNSGQKTEIQPTQVIDGPFAGAKDTVVNINRINTNADGTIKVGGYTASLTTNAAHLHIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFCYAPWNYFDARNIKNVEITNKLAFGPQGSPWGTSKLMFNNLTLGPNAVMDYSQFSNVTIQGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNTGISKTANGSKISVRYLGNATPAENGGNTTNLPTNTTNNARFARYALIKNAPFAQTNATPNLVAINKHDFGTIESVFELANRSKDIDTLYAHSGVQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGASTRASYGYDFAFFRNALVLKPSVGVSYNHLGSTNFESNSTHKTALKNGASSQHLFNASANVQARYYYGDTSYFYMNAGVLQEFANFGSSNAVSLNTFKVNTAHNPLNTHARVMMGGELKLAKEVFLNLGFIYLHNLISNAGYFASNLGMRYSF

SEQ ID NO: 19073 - protein, 1293 aa, Helicobacter pylori
MELQQTHHKINRPLVSLALVGLLVSITPQKSHAAFFTTVIIPAIVGGIASGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAAHLNIGKGGVNLSNQASGRTLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKSGEKLVINDFYYAPWNYFDARNIKNVEITNKLAFGPQGSPWGTSKLMFNNLTLGPNAVMDYSQFSNVTIQGDFINNQGTINYLVRGGNIETLSVGNAAVMSFNNDIDSATGFYKPLVKINSAQDLIKNKEHVLLKAKIIGYDNVSLGTNRISNVNLIEQFNERVALYNNNNRMDTCVVRNTDDIKACGMAIGNQAMVNNPDNYKYLIGKAWKNIGISKTANGSKISVRYLGNATPAENGGNTTNLPTNTTNNARFASYALLKNAPFAQTSATPNLVAINKHNFGTIESVFELANRSKDIDTLYAHSGTQGRDLLQTLLIDSHNAGYARTMIDATSANEITKQLNTATDALNNIASLEHKTSGLQTLSLSNAMILNSRLVNLSRRHTNNIDSFAKRLQALKDQKFASLESAAEVLYQFAPKYEKPTNVWANAIGGASLNSERGGNTSLYGTSTGVDAYLNGEVEAIVGGFGSYGYSSFNNQANSLNSGANNANFGVYSRIFANQHEFDFEAQGAVGSDQSRLNFKSALLRDLNQCYNYLPYGASTRASYGYDFAFLRNALLLKPSVGVSYNQLGSTNFESNSTNKTALKNGASSQHLFNASANVEARYYYGDTSYFYMNAGVLQEFANFGSSNAVSLNTFKVNTARNPLNTHARVMMGGELKLAKEVFLNLGFIYLHNLISNAGYFASNLGMRYSF

SEQ ID NO: 19074 - protein, 1303 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFVSYALIKNAPFARYSTTPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNNIDSFAQRLQALKGQRFASLESAAEVLYQFAPKYEKPTNVWANAIGGTSLNNGSNASLYGTSAGVDAYLNGEVQAIVGGFGSYGYSSFRNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 19075 - protein, 1290 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPHKEYDLYKSLLSSKIDGGWDWGNAARHYWVKGGQWNKLEVDMKDAVGTYKLSGLINFTGGDLDVNMQKATLRLGQFNGNSFTSYKDSADRTTRVDFNAKNILIDNFLEINNRVGSGAGRKASSTVLTLQASEGITSSKNAEISLYDGATLNLASSSVKLMGNVWMGRLQYVGAYLAPSYSTINTSKVTGEVNFNHLTVGDHNAAQAGIIASNKTHIGTLDLWQSAGLNIIAPPEGGYKDKPKDKPSNTTQNNANNNQQNSAQNNNNTQVINPPNSAQKTEIQPTQVINGPFGGGKDTVVNINRINTNADGTIRVGGYKASLTTNAAHLHIGKGGINLSNQASGRSLLVENLTGNITVDGPLRVNNQVGGYALAGSNANFEFKAGTDTKNGTATFNNDISLGRFGNLKVDAHTANFKGIDTGNGGFTTLDFCGVTDKVIINKLITASTNVAIKNSNINDLLVTTNGVSVGEYTHFSEDIGSQSRINTVRLETGTRSIFSGGVKFKSGEKLVIDEFYYSPWNYLDARNIKNVEITRKFASSTPENPWGTSKLMFNNLTLGQNAAMDYSQFSNLTIQGDFINNQGTINYLVRGGKVATLNVGNAAAMMFNNDIDSATGFYKPLIKINSAQDLIKNTEHVLLKAKIIGYGNVSTGTNGISNVNLEEQFKGRLALYNNNNRMDTCVVRNTDDIKACGMAIGNQSMVTTPDNYKYLIGKAWKNIGISKTANGSKISVYYLGNSTPTENGGNTTNLPTNTTNSARSANYALVKNAPFAHSATPNLVAINQHECGTIESVCELANRSKDIDTLYTHSGAKGRDLLQTLLIDSHDAGYVRQMIDNTSTGEITKQLNAATTTLNNIASLEHKTSSLQTLSLSNAMILNSRLVNLSRKHTNNIDSFAKRLQALKDQRFASLESAAEVLYQFAPKYEKPTNVWANAIGGASLNNGSNASLYGTSAGVDAYLNGQVEAIVGGFGSYGYSSFSNRANSLNSGTNNTNCGVYSRIFANQHEFDFEAQGALGSDQSSLNFKSALLQDLNQSYNYLAYSAATRASYGYDFAFFKNALVLTPSVGVSYNHLGSTNFKSNSTNKVALSNGSSSQHLFNASANVEARYYYGDTSYFYMNAGVLQEFANFGSSNAVSLNTFKVNAARNPLNTHPRVMMGGEFQLAKEVFLNLGFVYLHNLISNIGHFASNLGMRYSF

SEQ ID NO: 19076 - protein, 1303 aa, Helicobacter pylori
MELQQTHRKINRPLVSLALVGLLVSITPQKSHAAFFTTVIIPAIVGGIATGAAVGTVSGLLSWGLKQAEEANKTPDKPDKVWRIQAGRGFNEFPNKEYDLYKSLLSSKIDGGWDWGNAARHYWVKGGQWNKLEVDMKDAVGTYNLSGLINFTGGDLDVNMQKATLRLGQFNGNSFTSFKDSADRTTRVDFNAKNISIDNFVEINNRVGSGAGRKASSTVLTLQASEGITSGKNAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 19077 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQTGRGFNEFPNKEYDLYQALLSSKIDGGWDWGNAARHYWVKGGQRNKLEVDMKDAVGTYKLSGLRNFTGGDLDVNMQKATLRLGQFNGNSFTSFKDGANRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGSQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSTTGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPAENGGNTTNLPTNTTNNARFARYALIKNAPFAQTSATPNLVAINKHDFGTIESVFELANRSSDIDTLYAHSGAQGRDLLQTLLIDSHNAGYARTMIDATSANEITKQLNEANSALNNIASLEHKTNGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFVFLRNALVLKPSVGVSYNHLGSTNFESNSTHKTALKNGASSQHLFNASANVEARYYYGDTSYFYMNAGVLQEFANFGSSNALSLNTFKVNATRNPLNTHARVMMGGELKLAKEVFLNLGFIYLHNLISNAGYFASNLGMRYSF

SEQ ID NO: 19078 - protein, 1303 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKETVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFVSYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 19079 - protein, 1291 aa, Helicobacter pylori
MELQQTHRKINRPLVSLALVGLLVSITPQQSHAAFFTTVIIPAIVVGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFHAKNILIDNFLEINNRVGSGAGRKASSTVLTLQASEGITSGKNAEISLYDGATLNLASNSVKLMGNVWMGRLQYVGAYLAPSYSTINTSKVAGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGSRSIYSGGVKFKGGEKLVINDFYYAPWNYFDARNIKIVEITNKLAFGPQGSPWGTAKLMFNNLTLGPNAVMDYSQFSNVTIHGNFINNQGTINYLVRGGNIETLSVGNAAVMSFNNDIDSATGFYKPLIKINSAQDLIKNKEHVLLKAKIIGYDNVSLGTNSISNANLIEQFNERLALYNNNNRMDTCVVRNTDDIKACGMAIGNQAMVNNPDNYKYLIGKAWKNIGISKTANGSKISVRYLGNATPAENGGNTTNLPTNTTNNARFASYALIKNAPFAQTSATPNLVAINKHDFGTIESVFELANRSEDIDTLHANSGAQGRDLLQTLLIDSHDAGYARTMIDATSANEITKQLNEANSALNNIASLDHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNEKVEAIVGGFGSYGYSSFNNQANSLNSGANNANFGVYSRIFANQHEFDFEAQGALGSDQSSLNFKSALLRDLNQSYNYLAYGASTRASYGYDFAFFRNALVLKPSVGVSYNHLGSTNFESNSTHKAALKNGASSQHLFNASANVEARYYYGDTSYFYMNAGVLQEFANFGSSNAVSLNTFKVNTAYNPLNTHARVMMGGELKLAKEVFLNLGFIYLHNLISNIGHFASNLGMRYSF

SEQ ID NO: 19080 - protein, 1303 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWHIQAGRGFNNFPNKEYDLYKSLLSSKIDGGWDWGNAARHYWVKDGQWNKLEVDMKDAVGTYNLSGLINFTGGDLDVNMQKATLRLGQFNGNSFTSFKDGANRTTRVDFNAKNILMYNFVEINNRVGSGAGRKASSTVLTLQASEKITSRENAEISLYDGATLNLVSSSNHSVDLYGKVWMGRLQYVGAYLAPSYSTIDTSKVEGEMNFRHLAVGDQNAAQAGIIANKKTNIGVLDLWQSAGLNIIAPPEGGYESKNKDNPQNNPKNDTQKTETEPTQVIDGPFAGAKDTVVNIFRLNTNADGTIRVGGFKASLTTNAAHLHIGEGGVNLSNQASGRTLLVENLTGNITVEGALRVNNQVGGSAVAGSSANFEFKAGADTNNGTATFNNDIHLGKAVNLRVDAHTAYFNGNIYLGKSTNLRVNGHSAHFKNIDATKSDNGLNTSALDFSGVTDKVNINKLTTSATNVNIKNFDIKELVVTTRVQSFGQYTIFGENIGDKSRIGVVSLQTGYSPAYSGGVTFKGGKKLVIDELYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSTTGFYKPLIKINNAQNLTKNKEHVLVKARNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYKF

SEQ ID NO: 19081 - protein, 1323 aa, Helicobacter pylori
MEIQQTHRKINRPLVSLALVGALVSITPQQSHAAFFTTVIIPAIVGGIATGAAVGTVSGLLSWGLKQAEEANKTPDKPDKVWRIQAGRGFNNFPNKEYDLYRSLLSSKIDGGWDWGNAARHYWVKGGQWNKLEVDMKDAVGTYTLSGLRNFTGGDLDVNMQKATLRLGQFNGNSFTSYKDSADRTTRVDFNAKNILIDNFLEINNRVGSGAGRKASSTVLTLQASEKITSRENAEISLYDGATLNLASNSVKLMGNVWMGRLQYVGAYLAPSYSTINTSKVTGEVDFNHLTVGDHNAAQAGIIASNKTHIGTLDLWQSAGLNIIAPPEGGYKDKPKDKPSNTTQNNANNNQQNSAQNNSNTQVINPPNSAQKTEIQPTQVIDGPFAGGKDTVVNINRINTNADGTIRAGGYKASLTTNAAHLYIGKGGVNLSNQASGRSLLVENLTGNIAVEGTLRVNNQVGGSAVAGSSANFEFKAGTDTNNGTATFNNDIHLGKAVNLRVDAHTAYFNGNIYLGKSTNLKVNGHSAHFKNIDATKSDNGLNTSALDFSGVTDKVNINKLTTSATNVNIKNFDIKELVVTTRVQSFGQYTIFGENIGDKSRIGVVSLQAGYSPAYSGGVTFKSGKKLVIDEIYHAPWNYFDARNVTDVEINKRILFGSPGNIAGKTGLMFNNLTLNSNASMDYGKDLDLTIQGHFTNNQGTMNLFVQDGRVATLNAGHQASMIFNNLVDSATGFYKPLIKINNAQNLTKNKEHVLVRARNIDYNLVGVQGASYDNISASNTNLQEQFKERLALYNNNNRMDICVVRKNNLNDIKACGMAIGNQSMVNNPESYKYLEGKAWKNTGINKTANNTTIAVNLGNNSTPTENGGNTTDLPTNTTNNARFASYALIKNAPFAHYNATPNLVAINQHDFGTIESVFELANRSSDIDTLYANSGVQGRDLLQTLLIDSHDAGYARTMIDATSANEITKQLNAATTTLNNIASLDHKTSGLQTLSLSNAMILNSRLVNLSRRHTNNIDSFAKHLQALKGQRFASLESAAEVLYQFAPKYEKPTNVWANAIGGASLNNGGNASLYGTSAGVDAYLNGEVEAIVGGFGSYGYSSFNNQANSLNSGANNTNFGVYSRIFANQHEFDFEAQGALGSDQSSLNFKSALLQDLNQSYNYLAYSAATRASYGYDFAFFKNALVLKPSVGVSYNHLGSTNFKSNSTNKVALSNGSSSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 19082 - protein, 1082 aa, Helicobacter pylori
MEIQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASARTVNFKDIDTGNGGFNTLNFSGVTNKVNINKLITASTNVAVKNFNINELLVKTNGISVGEYTHFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQTSATPSLVAINKHDFGTIESVFELANRSKDIDTLYAHSGVQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNGEVEAIVGGFGSYGYSSFSNQANSLNS

SEQ ID NO: 19083 - protein, 1288 aa, Helicobacter pylori
MEIQQTHRKMNRPLVSLVLAGALISAIPQESHAAFFTTVIIPAIVGGIATGAAVGTVSGLLSWGLKQAEEANKTPDKPDKVWRIQAGRGFNEFPNKEYDLYQSLLSSKIDGGWDWGNAARHYWVKGGQWNKLEVDMKDAVGTYKLSGLRNFTGGDLDVNMQKATLRLGQFNGNSFTSYKDSADRTTRVNFNAKNISIENFVEINNRVGSGTGRKASSTVLTLQASEGITSSKNAEISLYDGATLNLASNSVKLMGNVWMGRLQYVGAYLAPSYSTINTSKVQGEVDFNHLTVGDQNAAQAGIIASNKTHIGTLDLWQSAGLNIIAPPEGGYKDKPNSTTSQSGTKNDKQEISQNNNSNTEVINPPNNTQKTETEPTQVIDGPFAGGKDTVVNIDRINTKADGTIRVGGFKASLTTNAAHLNIGKGGVNLSNQASGRTLLVENLTGNITVDGPLRVNNQVGGYALAGSSANFEFKAGVDTKNGTATFNNDISLGRFVNLKVDAHTANFKGIDTGNGGFNTLDFSGVTGKVNINKLITASTNVAVKNFNINELVVKTNGVSVGEYTHFSEDIGSQSRINTVRLETGTRSIFSGGVKFKSGEKLVIDEFYYSPWNYFDARNIKNVEITNKLAFGPQGSPWGTSKLMFNNLTLGQNAVMDYSQFQILTIQGDFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWKNIGISKTANGSKISVYYLGNSTPTENGGNTTNLPTNTTNNARSANYALIKNAPFAHSATPNLVAINQHDFGTIESVFELANRSKDIDTLYTHSGAQGRDLLQTLLIDSHDAGYARQMIDNTSTGEITKQLNAATDALNNVASLEHKQSGLQTLSLSNAMILNSRLVNLSRKHTNHINSFAQRLQALKGQRFASLESAAEVLYQFAPKYEKPTNVWANAIGGASLNSGGNASLYGTSAGVDAYLNGEVEAIVGGFGSYGYSSFSNQANSLNSGANNANFGVYNRVFANQHEFDFEAQGALGSDQSSLNFKSALLQDLNQSYNYLAYSATTRASYGYDFAFFRNALVLKPSVGVGYNHLGSTNFKSNSQSQVALKNGASSQHLFNANANVEARYYYGDTSYFYMNAGVLQEFAHFGSNDVASLNTFKINAARSPLSTYARAMMGGELRLAKEVFLNLGVDYLHNLISNASHFASNLGMRYSF

SEQ ID NO: 19084 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNILIDNFLEINNRVGSGAGRKASSTVLTLQASEGITSSKNAEISLYDGATLNLASNSVKLMGNVWMGRLQYVGAYLAPSYSTINTSKVAGEVNFNHLTVGDHNAAQAGIIASKKTNIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAANLNIGKGGVNLSNQASGRSLLVENLTGNITVEGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTENGGNTTNLPTNTTNNARFARYALIKNAPFAQTSATPNLVAINKHDFGTIESVFELANRSKDIDTLYANSGAQGRDLLQTLLIDSHNAGYARTMIDATSANEITKQLNTATDALNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNVARNPLNTHARVMMGGELKLAKEVFLNLGFIYLHNLISNAGHFASNLGMRYSF

SEQ ID NO: 19085 - protein, 1291 aa, Helicobacter pylori
MELQQTHRKINRPLVSLALVGLLVSITPQKSHAAFFTTVIIPAIVGGIATGTAVGTVSGLLGWGLKQAEEANKTPDKPDKVWRIQAGRGVNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIRVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFASYALIKNAPFAQTNATPNLVAINKHDFGTIESVFELANRSKDIDTLYAHSGAQGRDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFIYLHNLISNIGHFASNLGMRYSF

SEQ ID NO: 19086 - protein, 1296 aa, Helicobacter pylori
MEIQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAAHLHIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGLNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGNQAMVNNPDNYKYLIGKAWKNIGISKTANGSKISVRYLGNATPAENGGNTTNLPTNTTNNARFARYALIKNAPFAQTNATPNLVAINKHDFGTIESVFELANRSKDIDTLYAHSGVQGRDLLQTLLIDSHNAGYARTMIDATSANEITKQLNTATDALNNIASLEHKTSGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGASTRASYGYDFAFFRNALVLKPSVGVSYNHLGSTNFESNSTHKTALKNGASSQHLFNASANVEARYYYGDTSYFYMNAGVLQEFANFGSSNAVSLNTFKVNTAHNPLNTHARVMMGGELKLAKEVFLNLGFIYLHNLISNAGYFASNLGMRYSF

SEQ ID NO: 19087 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAAHLNIGKGGINLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLSVGNAAVMSFNNDIDSATGFYKPLVKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFASYALIKNAPFAQTNATPNLVAINKHDFGTIESVFELANRSKDIDTLYAHSGAQGRDLLQTLLIDSHDAGYARTMIDATSANEITKQLNTATDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 19088 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDGTNRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQESSQNNSNTQVINPPNSGQKTEIQPTQVIDGPFAGAKDTMVNINRINTNADGTIKVGGYTASLTTNAAHLNIGKGGVNLSNQASGRTLLVENLTGNITVEGALRVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSATGFYKPLIKINSAQDLIKNKEHVLLKAKIIGYGNVSLGTNSISNANLIEQFNERLALYNNNNRMDTCVVRNTDDIKACGMAIGDQAMVNNPDNYKYLIGKAWKNIGISKTANGSKISVRYLGNATPPENGGNTTNLPTNTTNNARFASYALIKNAPFAQTNATPNLVAINKHNFGTIESVFELANRSKDIDTLYAHSGAQGRDLLQTLLIDSHNAGYARTMIDATSANEITKQLNAANSALNNIASLEHKTNGLQTLSLSNAMILNSRLVNLSRRHTNNIDSFAQRLQALKDQRFASLESAAEVLYQFAPKYEKPTNVWANAIGGASLNSGGNTSLYGTSAGVDAYLNEKVEAIVGGFGSYGYSSFSNQANSLNSGANNANFGVYSRIFANRHEFDFEAQGAVGSDQSSLNFKSALLRDFNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNTARNPLNTHARVMMGGELKLAKEVFLNLGFIYLHNLISNIGHFASNLGMRYSF

SEQ ID NO: 19089 - protein, 1303 aa, Helicobacter pylori
MELQQTHRKINRPLVSLALVGLLVSITPQKSHAAFFTTVIIPAIVGGIASGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLINYTGGDLDVNMQKATLRLGQFNGNSFTSFKDSADRTTRVDFNAKNISIDNFLEINNRVGSGAGRKASSTVLTLQASEGITSSKNAEISLYDGATLNLASNSVKLMGNVWMGRLQYVGAYLAPSYSTINTSKVTGEVNFNHLTVGDHNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLNSNASMDYGKDLDLTIQGHFTNNQGTMNLFVQDGRVATLNAGHQASMIFNNLVDSATGFYKPLIKINNAQNLTKNKEHVLVKARNIDYNLVGVQGASYDNISASNTNLQEQFKERLALYNNNNRMDICVVRKDNLNDIKACGMAIGDQAMVNNPENYKYLEGKAWKNTGINKTADNTTIAVNLGNNSTPTSSESNTTNLPTNTTNNARFARYALIRNAPFAHYSATPNLVAINKHDFGTIESVFELANRSSDIDTLYAHSGAQGRDLLQTLLIDSHNAGYARTMIDATSANEITKQLNTGTDALNNIASLEHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIGGGFGSYGYSSFNNQANSLNSGANNANFGVYSRIFANRHEFDFEAQGALGSDQSSLNFKSALLRDLNQSYNYLAYGASTRASYGYDFAFFRNALVLKPSVGVSYNHLGSTNFESNSTHKTALKNGASSQHLFNASANVEARYYYGDTSYFYMNAGVLQEFANFGSSNAVSLNTFKVNAARNPLNTHARVMMGGELQLAKEVFLNLGFIYLHNLISNAGHFASNLGMRYSF

SEQ ID NO: 19090 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVDFNHLTVGDHNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAANLNIGKGGVNLSNQASGRTLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGDFINNQGTINYLVRGGNIETLSVGNAAAMLFNNDIDSATGFYKPLIKINSAQDLIKNKEHVLLKAKIIGYENASLGTNNISNANLIEQFNERLALYNNNNRMDTCVVRNTDDIKACGMAIGDQAMVNNPDNYKYLIGKAWKNIGISKTANGSKISVRYLGNSTPAENGGNTTNLPTNATNKARFARYALIKNAPFAHYSATPNLVAINKHDFGTIESVFELANRSKDIDTLYAHSGAQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGALGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNVLSLNTFKVNAARNPLNTHARVMMGGELKLAKEVFLNLGFIYLHNLISNAGHFASNLGMRYSF

SEQ ID NO: 19091 - protein, 390 aa, Burkholderia mallei
MKQTKHLAALAVPAGFLLSAGAHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 19092 - protein, 687 aa, Burkholderia mallei
MNAKKLKLSILCFCLMGLGEIKAEEQYQLDDVVVSASGFEQDLVDAPASISVITKEELSKKPIKDIGEAISDIPGVDVTMNKTGTYDFSIRGFGSSYTLVLIDGKRQSVANGFYDNGFGGSESGYLPPASMIERIEVIRGPASTLYGSDAVGGVINIITKKNPNKTEANIEFSTLLQQHSSKYGNAGGFNAYVATPLIEDTLSISARIKYYDKAASDLKWPTPVWSNGTQRPENYQIASHSPGYFTSLGFGSRLNWTVDDSNNVYLDVERYINEISVNSTSSSAIKSERQLFKDNVVLNHDGNYEFGTTNSYLQYGSTKDKDLHSQIWVGEGKVVLPWNLDKYGNLVSTFGTRIDYETLKNDQESAGSEIRGKNLDQTTVALYGEGEYFISDDLIFTTGLRYIYSDLFDSEVTPRVYLVYHLNDNVAFKGGVAMGYKTPAAKQLTNGYYNYSNNGASFGNPDLKPEESTNYELGVDFRIFDFAHYSITGFITDFKNQISSEELTGMYNGIDCANGVTCERSINLGKTQTRGIELAFNTKPYKGFSVNSSYTFMDNRYKDGQTNWFGGDRIENLPRHIAMLKLNYEQGKFSSYVKARARLDTIARSKGGGSGTLPWQKYKPFYIVDLGVNYKIDKQSSLSFTVQNLFDKDFFDPQVTRWDGANPGGYANRYQDYTEGRSFWLSYKYDF

SEQ ID NO: 19093 - protein, 1239 aa, Burkholderia mallei
MRGYSNNICRVGFALAVAVPSFGLPAMADPVPRTTPVAGSVIARKTGEEVRFIDVSDWRVVDLHQDLLTGDVLRTNANGQLAIVFSDHTQVRLGRNSSLQVKKMAASGDTVLNLQSGTIWARAERGGQGLTVETPAAAAAIRGTDWTMTVEGAKTSMIVLEGRVALSNPQGSVEVNEGEGAAATIGQAPRKVVIVTPDHREQMLFYLTLRNGFALMPASPLPTATMRSERGRIAAVPAQSRSAADWLTLAEAQLTFDGAKDALASLARTRDLPLSAAQRARAELIEALIAGGRMRYAEAARLFEKALPHLDPQRRAIATYGGYYSRALADPQRVESPPAAAAIGPNGAIAKAYTAGFLKDIPAAIEVLKQAEKQYPDDATLPARRALLAQLIDDPAQMKEAVERSLSIDPRDPDGLQARARYRESYEGDTKGALADLSRSLADMPGSSMNWNDLGLLQSDRGANGEAEAAFLKAIELDPEDPAPHANLAILYLDQSRMKEAKREIDTALAVDPSFDIALLARGRYYLQNGETDKALDDLLAASTANPGYSAAQLGLAIAHLEKGDRLPSNQAVDNADRLDKNDPAISAFRTAVDIDDYDADGAIHNAQEFLRRSRARGGDYSALGANASAGSTLNDAFRLQGLDAWGRYYGDAVFDPFKGSGYIDQSIKGSIFPFVNATNFSDDNIIQNRGNASSYSSFIQGLLINPHMLSGRSRSTTFFDVPFIEGSLGGGINSVDGHTRRIGEAEIQGYSNSTIPISFYGNLTWEELALDRDYRDSGGVQTDNKLLGANGYLTATVTPDDRVVAFVNHGKNDGTLNALSSNTGFMELLFRVPIPLPLYTTEETLRETTYAGIGWSHTFAYENVLNGALLYSGSKSNTNSALDVDLDPVFIGAGVPFIVPFTDVIQEAESHTYIGALSHSIGAGPLTFRYGIEGGWMDASSSVDTTLLGVTAPPDRAENTVDIGRGYVDVLHEITPDLKGEYALFATRLEGDGIDISRLEPRFGLAWTPVQNHWLRAAFMRQSFDTTVPTLAPIGILGLQANQFSTNPQGYTDTVALQWDAEWTDRLFTSVEYQHQELHDFSVDFPLISLPSDTSLPISRGSIDRASVTANVALGNGFGLSATYAYMDSENRDPLEPIYGGPLPFIPQNSGQIALTWVNEAKVKATVAANYIGERDGDRFGTKLDDYWSLDAHLVWEPFDKRIELEAAAYNLLDEDFEVTPGVPGWGRAFKGTLKVRF

SEQ ID NO: 19094 - protein, 1053 aa, Burkholderia mallei
MTRGYGVSLAALAVALLGPGAQAQTAGNGVDILSGFRRIWIPGQTYDTGSPTALGAPLLLRNIQIVAERARERTQAQEIAAYYDDRRNQSYSVIDGLGPLTRAYLAGSGATTTIPAFDATTSRVQYVDQGTGAGVTTSPLGKVVQLVNAFRTNASTGPAKDAYSYPRPWRQSLNGQSLGFVVPPSLGPERSPTPATDGGFPSGHTNAAYLSALALAYAIPQRFQELLTRASELGDNRIEAGMHSPTDVIGGRVLATAFAIRALNDPANAALLGEAFAQAQRYLSQACGGPLERCAHAPVDPATDRFSDYARDKAAYTARLTYGLPPVGPTDRPPVVPVGAEALLATRFPYLTAAQRRDVIATTELPSGGFLDNGLGYDRINLFAAADGYGALDGTVTVTMDAARGGFSAYDVWRNDIGGAGGLVKLGSGTLVLTGANTYAGGTTIGGGTLVGHAGAFGTGAIVDDAALVVDQSTDGTLANAVSGSGTLTKTGAGTLTLTGLGTLTGATAVQAGRLVVNGALAHSVVTVLPGAELGGSGTLGGISALAGGTVAPGNSIGTLTAAGHVAFAPGSTYRVEAGAAGQADRIAATGSATLSGGTVQVRAAPGAYNPRTTYTILSAAGGVSGRFAGVTANLAFLSPGLRYRSDAVDLTLTRNDVPFAASATGRNGAAAANAIQAAGSGRLYDAAVAFTADEAGSGFRALAGDIHAGTVSTASETAYFVREAVLDRLRWGGPGTGLDDGRLPAADAADLPGRAPVVADVPVRALDPQVFGVWGQGFGAFGTAGGGGNAFDLNRQIAGFAVGADVRLASGPRVGVVGGYSEADLASAGRVGGLSRAESATLKSGFGGLYGGYERGPLALRLGALYADTDARTRRAVAYGLSDTLSGHGGGHTVQAFGEIGWRIALGQPAGASVEPFAGGAYVGIRRGAFAETGGAAALASVARDYDLGAATVGVRAQTRLDLGLSRPVTLRGLVGYRRAFGDVVPTALLAFGAGGPAFLSAGVPIDRDALVAQVGLELAVTPDASLGVAYTGQTGARARDQAVTGGFTLRF

SEQ ID NO: 19095 - protein, 917 aa, Burkholderia mallei
MRASDLARRCLWGSLKMMALVSSRETAFPRTQALAPSPSPGRTYRTSGVHAPPLDVRTMHSTLFGEPRLGAAKAVAGRRALRAGLPLSIMLCVLSLAVPSSAAAQEAAEAEAPAKVKRRKRVVKPAAPARPAAKTAKKPKKPVKPPIEDADEPEIPVLGGGPATDDPSPASAPAPVPTPPSAAPLTPATPLTAEPASPQALPPVGADFNPPDAPTHLSPATATLPAHQPAPSSNIPISAPFAEPTLDRPLPPQSGLAGLGTDPLDGADALEESVNRVLSEAVVTTAGKRNQRISDVPLTVSWIPADELEGTGQFTLCEAIQYFPGMECRRGSMRKAAVSARGLGSNYLSNRLLLLQDGRPLTDPWTGQFYGDETTPLTNLKQVEVIRGPGSSLYGSNAFSGVINVIQRQPSDLIEKGKNVGAEARVLAGQDQTWRLHGTVAGRGGPVEALLGYYGFGSDGPQLFNDPRVGRVDTNQDSLVHQVNGKVRIGPLALDADFTDAEIGRPGGTHISTVGNCGRCHYTPNDSESVQNFNASAQVDQQVTDNLRLFGQAYGLFKRRDVLMENAFGGDPTRALGKRRRLGGEARALWTMGDLNVTFGGDLKADAVNVPNVLPELSMDDTRQTILGGFVDAEYRLFNRLVFGAGARYDRYQIPERVWQNRTDQVSPRASVVFHAVPELLTLRTNYGRAFRAPTLAELAINQQMYAATLVGNSNLRAETLDTIEASVDFWPFDRRVRLTGTGFYNLAKNFINQQLVFGSVSQFQNLGDARVAGFELEAAAQIPSINSSFDIAYQFLDAKALPYDDGPQSPLDYAPAHRIYARGRTNIGKVAFVELYALLVGSRYDPGFEVDETTGLPTTRVQLPSYVTASARVGFNVYDGISVSFLGSNLFNAKYEESHGFPAPPQSFFSEVKVRY

SEQ ID NO: 19096 - protein, 698 aa, Burkholderia mallei
MDDHRRIAPPFARRLHPLSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGKLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 19097 - protein, 375 aa, Burkholderia mallei
MKRQYLALSIATAACAAPQAHAQSSVQLYGLIDLSFPTYQSHANAKGDHVIGMGLGGEPWFSGSRWGLKGAEDIGGGTKVIFRLESEYTVADGNMEDPGQIFDRDAWVGVENDTFGKLTAGFQNTIARDAGAIYGDPYGSAKLTTEEGGWTNANNFKQMIFYAAGATGTRYNNGLAWKKLFGNGIFASAGYAFSNSTSFGQNSTYQVALGYNGGPFNVSGFFSHVNHAGYANKSFSVGGNYTFDIFRVNAGYFRYLGDQGALGQRQDNAWTVSFKVAPKGALDYELGYQQMRVHNAAYNSDGNVPNANIGDFSLTSGVGNGFKETLYGSVFYHLSKRTELYLAGDYMRLHGGYTVASTHGATNQLELTTGIRTRF

SEQ ID NO: 19098 - protein, 274 aa, Burkholderia mallei
MKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPSAKFRPFVGIGVAYSWFSNIELNGNFAKDINDNLGSVLAAGAGKPEPTSVEGKASSSFTPVYNIGASYAIAKHWALTATLSYMPLKTYSSLVIKAADGTTLATTRTRLKADPLITFVGISYKF

SEQ ID NO: 19099 - protein, 199 aa, Burkholderia mallei
MEQPVMMAEQAPAPAWTGGYVGGNISYGFGSLDANDDLASALTTNGFSDNLSEPDGVSAALRAGYDWQFGRGVFGLGAEYNFGSYDGDGEGILAGSGVDVEIQDMATIFARGGYLVKDNFLAYGLLGYSQAEGEVSLGGDSESEDLDGVTIGFGGEYMFTQNWTGYAEYTYTDFGDVDNTDGQLEADLQQIKFGVNYRF

SEQ ID NO: 19100 - protein, 685 aa, Burkholderia mallei
MRTPFVRAALAALSGLPCIALAQGDASASSASFASSVSYAPAAASPADADSALSTAPAAAAASPASGAARGAEAVSADAASAVASGAPSASPARAASAAQLAPIVVTARRGPQRLADAIPQTTLFDARDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVNETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 19101 - protein, 500 aa, Burkholderia pseudomallei
MQMKKLLPLLIGLSLGGFSAMSQAENLLQVYKQARESNPDLRKSAADRDAAFEKINEARSPLLPQLGLTAGYNYTSGYRDSRDTHSDTTSGSLALTQTIFDMSKWRQLTLQEKTAGISDVTFQTAEQQLILNTATAYFNVLKAIDTLSYTQAQKDAVYRTLDQTTQRFNVGLVAITDVQNARSNYDTVLAAEVSARNDLDNALETLRQVTGTFYPELASLNTDRFSTQRPEAVNNLLKEAEARNLSLLSARLSQDLAREQIRAAQTGYMPTVDFSASTAISNNNYGGSRNTTRDADLGENKVGLSFNLPLYSGGATNSQVKQAQYGFVGASEQLESSHRSVVQTVRSSFNNVNASISSINAYKQAVISAQSSLDAMEAGYQVGTRTIVDVLDATTTLYNAKRQLSDARYTYLINQLNIKSALGTLNQNDLLLLNGALGKPVSTAPDAVAPQNRAQDAYADGYQDNAPMQQTAARHRRPLGSAPAVTTSQPARNSGNPFRN

SEQ ID NO: 19102 - protein, 698 aa, Burkholderia pseudomallei
MDDHRRIAPPFARRLHPLSLLLAASLAHGETGAPPAERRSDAPPATALAPIFVTANPLGASALSSPTASLSGDALTLHRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 19103 - protein, 749 aa, Burkholderia pseudomallei
MTSTFLRHAPAARGDHARRRRRAITLTVPALAAGAFHLAPAVAQTSVAVHGHGTLGASGVASRADTDAASAKSDGAVREAASAAASRTTTGTAPNATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITQATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 19104 - protein, 748 aa, Burkholderia pseudomallei
MKSRSDELKLGKFTTLCSVLAASPAFAQDAAPPAASADHDKELAPIQIKGAAEHSYKADFSSSVKFTAPLVDTPKSVTVIPQELIHNSGAATLTEALRTVPGITFGAGEGGNPLGDRPFIRGYDTQGSMFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVSASYYHLSTDDLPDGGIPYFYTTANKPANVDTIYPANVDRHNFYGLVNRDFRKTTTDIGTLRIEHDITPSLTVRNTTRYTESTQDYIWTQPDDSQGNVVNGRVWRRNNNRNSAINSIANQTELFGEFRTGPFKHSFTTGIELSREWGKRDSYSVATGTGKICQQGIGAASGYNCTSLGSPNPNDPWAGSITRNNDYAHARTVTKSLYGFDTVELSKHWQVNAGVRVDDYSTRFTDTRANGGKTYTRDDTLVNWQLGLVFKPARNGSVYASYATSSTPAGALLGEGSETQSLTPGRGGVGANADQLAPEKNRSIELGTKWNVLDDKLSLTAALFQIDTTNARVTLPNNQYAMVGNKRVQGLELGFAGQLTRAWQVFGGYTYMKSELRDNGRNTADNGHQFPNTPKHSFTLWTNYDVTPKFTVGGGAFYMSKVFGDTANLRAVPSYWRFDAMAQYRINKKLDLQLNVNNLFNRTYFDQAYPAHYASIAPGRSAFVTLNARY

SEQ ID NO: 19105 - protein, 1240 aa, Burkholderia pseudomallei
MHANQAMAINDIYNYREQLTMSKAFTTPFKLSAISIALFMASNAFGQTQEEQNALNSPEAKSSETSDIEVIEITGLKSSLKKSINDKRFSQNLVDTINAEDIGKSTDQNVADALSRVTGVSLVTRDGEGTQVTVRGATANQNNITINGQQLTSTDFSQAVDLSSFSADILSKLEVVKTSSADQDEGSLGANINLITLKPLDQKKGVRSFTAQGRYNDFSEESDHKVQFTLTEKFFDDTFGVAFSAYDQTSSIRRDQYRIDRFAASTIIASASDMDGNAISGVKAIRPTATRYELHQNSTERQGITLGLQFLPDDVSELNLDITYSQQEYATRQDAVISRATGNQNFVEGIEPLGSQRPAAPFTDPQTDWYVVDTQNNTMLRELNRFGAGDLQSSQGGNDQKNGSISLTYKRELTDSLRVSSQFGYSKSESESLPSAFAAMQNFPQVPAIKLYDAGRDIEPVGYDCTSGTCRMVFGSSFADLGEQIVSQTDPETGLFVPGYEDNTVFTGYNPADINAQHLSFLSENDVTVSDELANGQVDFEYDFDDYGITSFEFGAKVTKRTKDVDNQKYQFNSVTATEVVEDEFGNPVAIPGGALLDIRANLIARDGVVPSDFMQSLGYERNEATTGWTPVDPAYAVSLLLDDENTVRTPNDSESRITDIDTQAYYFKTNFELFDGRLTGNIGMRYVKTDIAAEGYSGADFWQFTETLEREYDRVMLRDLRDTSLPECRSPVFADPNQPLGYEQKYQRVDGQGWDTSSGPDPSGWTRIADQGPCHDPLFAQWSAFQQDPSLPEPADPITWLNMWRYADVSTTRNNGWDGTIAYDGTTPIPTVNANQFSSSSIRNRELQSFRSSDSHTYTNWLPSLNLNYAISDEMVGRFSVSKTMTRPEIDQLRPGFQLNENGYWGSGNPNTGSKVSLFNTQLEPLESNNLDVSFEWYFNESSMLSVAVFHKDMSNFTTVENAVTYLKDVRNVDTPVSGSEIILLAEDDGTDDHGLNGCMPLRATADYGWWPSDPTRFSNDLRDLCAQYSVSKIINGKGAQITGVELGYVQTYDFLPGFLSGLGVSANYTYQDSQYDPDRSSIDPSKTLPSFPVADTPEHSYNATLFWEQDGHQIRLAYRGTSDSLVGTDYNTGLQGRTWNQGSIWNEGRGNLDLSASYKLNDNVTFSLQAINLLDDEFRTYYTSRELEVDRIFADNDVGYQFVAFEEGNPLDGDATRSRTYTRYKVGTTYRLGVNVTF

SEQ ID NO: 19106 - protein, 1131 aa, Burkholderia pseudomallei
MLMTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVRETALERLWTARGAPGRAGAWARLLGAWGSARGGDVNGYTSSTGGFLAGADAALLDGVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASLQSEHAVQGSLHWKF

SEQ ID NO: 19107 - protein, 362 aa, Burkholderia pseudomallei
MVKHAAATLLGALAAAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 19108 - protein, 400 aa, Burkholderia pseudomallei
MHIRTWIAAGVAGAAVAPACAQSGVTLYGTVDTGVIYSTNQQVTHADGSTSGGHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQVGDFSARRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQRASIAFDIAELNATYAFTPMLRGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 19109 - protein, 379 aa, Burkholderia pseudomallei
MRHSARLLACGALCVTAAHAHAQSSVTLYGIVDTGIEFVSHASAKGGSAWRMPAVTGELPSRWGLRGVEDLGGGYRALFALESGFNLRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSGSAMLKYDAERFGVAASYEEQRGGANAAANFFDGAAPMPIASSADKDTRAHVSAYANAGPVKLGAGWIGRRVSTDAPAAPDVRTDLFFVGAAYRATPFVTIDGEAYRIVDARHDARATMATLRASFSLSKRTAVYAQTAYLWNSAHARYSVSGGGGGTMPAAGVGQLGAMVGVRHMF

SEQ ID NO: 19110 - protein, 400 aa, Burkholderia pseudomallei
MKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 19111 - protein, 737 aa, Burkholderia pseudomallei
MRYGKCGSSNVFRAFLLLTTACAASAAMAQNSSGPEASVPAPSGASAENAEPGPQDIIVTGRRRSESAFNAPVAVSVLTSGAIESSGVARPVDVTRFVPNMNITSVGRAGENFVTLRGLAQARSADSIVAVIVDGVQLASAEELSQELFDIQQIEVLKGPQGALYGRNAIAGAIVIKTKPPSDNFETSATIGYGNGNAFKALGSVNIPIAKDGVYLRAGAFQTSRDGYFFDRTTQRDVDPANERGVRARLDIVAIPNLSVSLRGSMSRFIGAGINYHAQLGALDTNDATQPFVTNVIGRDRQRKRSASGVFDYDLGSGHVVFTPAYSYVHESVYGDGFPYAATADTTQRIEFVVRTKSAELKYISPQDRAFSYIVGGYWASIFRRDTTTQGIDTGQGVIDGRGPFPAGSINPTLSIQDDGYRYRVLAGFGQANLKLGERVNLSGAIRYDDERRRQTNLSPPSFSQYSGQVRRKTFKGIEPKVTLSYQPSSFVNVYADYGQGFVSGGFNPAQTRDLVVAADPNATVPNEYGKQINRAAEIGVKLRLFDNRVTVNAAAFHSKVRNLQQFQFFPAATLQAINPIDKTKIDGAEFDTTTRLGPVTIFAGAGYTNARIAAYSANRSYLGNKVPGVPKYTINAGAQYDVTLGSDLSANARIDYQRIGPQWFDIANTFGTRRSAVNLFDARINLVHDRWTFSVFSKNIFDKRYNAEAVVIFPTAQAVTPALPRTFGAELKVAFK

SEQ ID NO: 19112 - protein, 759 aa, Burkholderia pseudomallei
MARRPLRAALFGAFGLYAAAARAAGPASEPAAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRQYWNWSDVRGIAADSNVLDAYTAPGRSVAVSMKVDF

SEQ ID NO: 19113 - protein, 756 aa, Burkholderia pseudomallei
MSRAPHAPSRRRAFGRGFAAAARAAHGAPVAHGVHACFAAASRRATAVECCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQITFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWQATRDVDLALYARNLANRTYAASTSNGGAQWLLGPSRSAELVATLRF

SEQ ID NO: 19114 - protein, 688 aa, Burkholderia pseudomallei
MSGAQDARPDPPSAGATAAPAGGDAPELAGVTVTARRAEERAKDVPLGIGVIDGEEIEARRQPTLEEALRGTPGVNVWSDGSPHSANVLIRGTGSINPVSTDDGAVALSVDGVPMSVRNMSLGTLDVERVEILKGPQGTLFGSNSRAGAINVITNQPTRNLEGYVRGEIGQDGQHLEEAVISGPLSQSLSGRLAIRNSGSDHWVDNARTSEPLSKPRSLMFRGSLLWDGGPGTNALFVAEREETKRSPGLVVLRPYGDPPSMDVTPGLFDHNAKLVERYSVTINHDLPVGRLTSVTGYTKFDTDFVGGYDARAMQAMFGMPAENMQRSMMGGHTTSQDLRWSSRPGASVFWVAGVNLSRAERSFEQLYLSRNFGIDRRYETDSQALYGEVTWPLTNVLKLTGGMRHTWDRKSYDATYGGTVPDARKLRDDYSTGRVALSYALTPTTNLYGAWSRGYESGGIGDHPTQVADSVPYKAASTNAVEVGFKMESASRRFALNGALFATRVKDDHLLGFDAATLATSTVNADTQSRGAELQGVWRLGNGFSLSGGVSVIDAEITSNVSGVSGGAIRKGNRSPDVPKWSGSLGVAYTQRLSAFMGLPTPVLNARLDYQYVGTRAADPQNHFDLKKYQKVDLRIGVVSGGTEVYVFGSNLLDERYDLYGFAPTATAYVGAPARGRTLGVGFRYDF

SEQ ID NO: 19115 - protein, 778 aa, Burkholderia pseudomallei
MFHQLAAPGARRRLAAACAAALAWPAAHAASTAAAVPADSTPAAAAEMTASGKTLDTVKVAAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 19116 - protein, 610 aa, Burkholderia pseudomallei
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFADQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSVELQNTYLTADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDPILAQNVGVQRLKGVSAGAGVCFAAPLAAIGLRAGELSAEAQLRHDAFGDRTLVTAQRYAPGLPIGTAVDGASATYERLSVALTVNPAKRWRGKLVVQTDLGTAPRRSYTLLALLGGTF

SEQ ID NO: 19117 - protein, 795 aa, Burkholderia pseudomallei
MMKVKNRTKHPAVSATLPLRHGGRYAPLFVGPVFGLASLGVHAQEQAQTPVQTQQVAAPDAASAASAATPAAASGTAVPNAPPAETSKAQGKGGATLNTVVVTATRRREPAREVPMQVNVLSADELQKSGAKTMSDFLSSEPGVDLNASGGSGAGQVSIRGVTTGVQTGPTVGMYVDDVAFGGSTVFSQSATFSLDMSLLDLNHVEILRGPQGTLYGAGAMGGLLKNVTNEPDPSQFSGQVGTGVSGTAHGGVSGTANATLNIPLKTDVAALRVSVFGQHDGGYVDAVGPKADSHIDRGDTYGARASLLLTPTRDLTVRLTALSQNINRNDPNYVEYGADGKPVWGDLTTRQFAQQPFHQNIQLYSAGIEYELGWARLNSITSYQRINTSAPQDLTGVYGPLFAAQGLNLGSVVAKDVATTNKVTQEFRLTSPGNQRLEWLAGLFYTHERSNSSEGFLTTLPDGTPGPDLSELQAPSTYNEYAAYGDLTYHLTSRLSLTGGVRIAHNSQTYEQTTYGTLAGPTQTISAPSSDTSKTYMFTARYALTSNSNAYVRIASGYRPGGPNALLIDPLTGMRAAGSPTFAPDTLWSYEAGYKADLLDKRLSLETSVYDIEWKNIQQLGTVDGVNQVINAGNARIKGLEFSGTFRPTPHWNFSANLSLIDASLTSGNASAGTTAGQPLPNSAKFAATLSGTYLFTAQGYPSYAGVTQRFVGRRHSGFDASSGRPDYPLPGYAITDLQAGVDFKKFSLAFYVRNLFDRRALIAAGTSLIPMGGPALVSVIQPRTIGAALTVPF

SEQ ID NO: 19118 - protein, 407 aa, Burkholderia pseudomallei
MSARAARQLPGNRRLARLAGAAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGPFGNNAAWSAGLSYANGPLKLGAGYLRINRNPNAANANGALSTTDGSATITGGSQQIWAVAGRYAFGPHSIGAAWSHSATDRVSGVLQGGSIAKLDGKSLVFDNFTLDGRYVVTPRLSLAAAYTYTMGRFDARSGETRPKWNHMVAQADYAFSIRTDAYLEAVYQRVSGGNGIPAFNATIWTLTPSANGNQVVVALGLRHRF

SEQ ID NO: 19119 - protein, 780 aa, Burkholderia pseudomallei
MAGAVHLPFYLESLRMNNPTLLSLAVSLIFSPTIGMADSSDNSRQNGIPVKALPLLDVQASRMEGPAFEGQSLSSSSLARQRVNTNDTARLLEDIPGVSTYGAGGISSLPTIRGFADDRIRTQVDGMDLMSACPNHMNPALSYIDPSNVETVQVYAGITPVSVGGDSIGGTIQVNSARPKFAKDDQDLLVTGKLGTFYRSNGAARGGNIALTVASQNLSLTYTDSYSQANNYRAAGDFKKPGGWNQQNNPFLRPFIDKVTERTVAGTAYRGSRHRELSLGWKILDNHLLELKLGEQSIDWEGFPNQRMDMVSSEPDPANPGNFLLNTKKPANVNRTANLHYTGQFDWGELEMRYFHQSLEHSMDMLPHRYMFMMMPMLSEATTDGGMAKATIALSDQHIARLGTDFQFYRLDDWWPGIGLLPNSMCCDNFWNIRDGKRDRIGVFGEWETQWSRQWTTLLGIRTDRVKSNTGSVQGYSSGSYQADADAFNALHRSREDYHYDLTALSRFTPDDGQSYEFGFARKTRSPNLYERYPWSKLPMAALMNNFVGDGNGYVGNPDLKPEVAYTISASGDWHDADKEKWQVKTTGYVTYVEHYVDAVRLPGYNRNDEYMLLQYANADARLYGLDVSGSYRLGSLANIGSFAVTGMVSYVRGENARRATGDNLYHMMPLNGKFALEHKLGLWTNTLEMHAVAEKDRISQVRNEITTPGYTLFNLRSSVEWQRARLDLSVENLFNRFYYLPLGGAYLAEGNSMTTNGIPWGMGVPGRGRSINVALSYSF

SEQ ID NO: 19120 - protein, 166 aa, Burkholderia pseudomallei
MTTEPCQASNTNRHVIGAACAAVLGITATAAAHAQSSVALHGLLDASIAYTNNQSGKHAWGKHTWRQGRGLPSNTVFGLSGSDGPGARLRVAPRAGRIVDAYASRGDDRHPASVPTARRERHRASGARTRRAAAAGESALEGPTGGRMRSALAGVMKLVNIADLND

SEQ ID NO: 19121 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDAGDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 19122 - protein, 366 aa, Burkholderia pseudomallei
MKKFAVAAAGLAVATGAHASDGSVTLFGLIDAGVSYVSNEGGKRNVYFDDGIAVPNLWGLRGTEDLGGGAKAIFELTSQYALGNGAALPTPGSMFSRTALVGLWSERLGSVTLGQQYDFMTDSLTFGSFDGAFRYGGLYNFRQGPFSKLGIPDNPTGSFDFDRLAGSSRVPNSVKYTSANLNGLVFGLMYGFGNQAGGGLAANSTVSAGLKYETGSFALGAAYVEVKYPQMNNGHDGLRNWGLGARYALSAFDLNLLYTNTRNTLTGAAIDVIQAGVRYVGAPWTIGANYEYMKGNAQLDRNYAHQVTAAAQYALSKRTSAYVETVYQYAGGSAGAHAWINGVMGPDAQSSSRSQFLARIGMLTRF

SEQ ID NO: 19123 - protein, 1110 aa, Pasteurella multocida
MQKQNCNLPIGRKNSLSRVSKVTCGLLFCLTTCAFAVDGKVNMGSNGVDDKKVVPLVGTTKTKLDGVNQEGFKVKGQVSDNVGPLPGVNVMVKGTMTGVITDMDGNFEIVAPYSKATLVFSYVGYQPKEVSLKGERIVNVKMVEDAKALEEVVVVGYTTQRKATITGSVATITTKDLKQSPTANLTNALAGRMPGLMANQFSGGEPGVDGADLRIRGASTYGDQTPIFIIDGVERDDMAYLAPEEIETFTILKDASATAAYGIRGANGVVVITTKRGQASEKPSVSFKASVGTNSPAKFPEYLGSAQYAELYNEARMNMGVDPSSPDLFSTNVIEDFKNGKGYNWDYFDYAFKPGIQQDYSLSVRGGSERARYYVMANYYKQDGNYKHTDMADYSTQAVFQRYNFRANVDVDITKNFYVKVDLGARITDRNAPGTTASRVVSIANTQPPHLPITLQDNGNAANETYALNNPKGMLYGDQQHRYNILGELSRTGYLNEKKTFLNGTFSIGHKLDFITKGLKVEGSISYDAKEGRWIRRVLETRQDGYANYGRYATFQPDESVYGSYYLHSTEPYAGAYRLGNPWYSTDETISNGFSHNAAENKTYYQLKLDYQREFDRHNVSAMVLFNRSSRAYDNRVEYRYQGISGRATYAYDNKYLTEFNIGYNGSENFAPGNRYGVFPAGSIGWVISREAFMKGTEKWLDNLKLRASFGLVGSDKISDNNDDRFAYLQFFQGGDGYSFGFNEFGSGYDGLKEGNFANPNLTWEKARKTNVGFDATLFNGKLTIAADYFREHRYDIITTLSDGDKMGYPDIVGKDAPFVNSGIVDNQGIDFELGWNSTIGKDFRYYIKPNFTFARNKIKFMNEVDYGNEYRQKTGRRLGEHFVYVVDHFVYDQAEADKLNAMNDGRGFQPWGELHPGDVVYKDLNQDGKIDDYGDRTHMGFPRTPEIQFGIPFGIQYKGFDVSVMFQGSLNSSILLNGAAVWDFPSYEQDQYGKVKHMHLNRWTEATKDVATYPRLTYGAYENNKNGNSSLFLYNANYIRLKNLEVGYSLPKNIIRFAGLQNVRFYVQGLNLLTFDSLDDVDMDPETKEGSGDWYPIQRVYNFGVEITY

SEQ ID NO: 19124 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKVLYSTVGAEAGVAFNF

SEQ ID NO: 19125 - protein, 305 aa, Wolbachia endosymbiont
YGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 19126 - protein, 152 aa, Wolbachia endosymbiont
GEILPLYTKVNGIANATGKEKDSPLTRSFIAGGGAFGYKMDDIRVDVEGLYSQLAKDTAVVNASETNVADSLTEFSGLVNVYYDIAIEDMPITPYVGVGVGAAYISNPSKADAVKDQRGFGFAYQAKAGVSYDVTPEIKLFAGARYFGSYGA

SEQ ID NO: 19127 - protein, 167 aa, Wolbachia endosymbiont
GEILPLCTKIDGITNVTGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKNDAGIKNV

SEQ ID NO: 19128 - protein, 152 aa, Wolbachia endosymbiont
GEILPLYTKVNGIANATGKEKDSPLTRSFIAGGGAFGYKMDDIRVDVEGLYSQLAKDTAVVNASETNVADSLTEFSGLVNVYYDIAIEDMPITPYVGVGVGAAYISNPSKVDAVKDQRGFGFAYQAKAGVSYDVTPEIKLFAGARYFGSYGA

SEQ ID NO: 19129 - protein, 196 aa, Wolbachia endosymbiont
SYYVRLQYNGEFLPLFTKVDGITYKKDNSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKNTDPKDSTRQVTDAGAYKVLYSTVGAEA

SEQ ID NO: 19130 - protein, 116 aa, Wolbachia endosymbiont
SLEAFYTVEYEVDTGDDAKENFKARNQFVGLRGNFGAFSVGRNDTMLKVSQGKVDQFNDLSGDLKNLFKGENRIEQTATYITPSFSGFKVGVTYAAEGASSQYAQDGFSVAAMYGD

SEQ ID NO: 19131 - protein, 212 aa, Brucella ceti
MFKRSITAAALGAAVMAFAGSAFAADMMGGTDYTYNDPVAAGPHDWSGNYVGAQVGGSSSKFPSPFASRTGALGGIVVGKNMQNGNIVFGAELEGNFAEAEHRIGHGGTLQQSWNGNAKGKVGYTFDKTLVYGTAGYGVTRFKAKDNTTSASGWEGGVLIGAGVEQALSGPLSVKAEYDFQRFNDVKSQVNGIEQRNNLKNHSIKAGLNYKF

SEQ ID NO: 19132 - protein, 802 aa, Brucella neotomae
MFKRNTQKFRLCAISAAVMGLISTGAMAQQTSAAQNKAQEEDVEQIIVTATKRAESIGDIPFSINAQTQKDFERSGASNLEDIARNVASVAIQNLGPGQSQVSMRGVSAGQIVRDQPGVKEQVGVYLDESVISLSLFTPDLDLFDLNRIETLRGPQGTLFGSGSIGGTLRYITNQPELDTFEGKFEANLNSVSDGGTGGNVKGMVNLPISDSVAMRAVVYRTEYAGFIDAYGPDDAFKEDVNDGDRTGGRVAFVISPNDKLTITPRIIFQELEINGFNRQDAFNIFANPYTTTWPAKQLKDREQFLLLEEGFSDDTLIADLTAEYQAEIADFTFVYSYTDRDILVSRDASALSGSVSVDLGFPDAAVTLPSNLLDRTEVEQDTFELRAASNDDGALDWIVGAFYSSTDRTYKQTLPTPGYDSFTDATLGAGTSAAVANGFDVDSPYNAFLPYDLTQLAIFGEVNYQVNDDLKVTAGSRFYDYEEERQFISGGLFANGDNQTDATESDGFTSRILGQYRLNDNVNINAQISEGFRLGGVNDPLNRSLCSDQDEAIFGSFQDYEDEQLTNYELGFKSSGRGWSANVSAFYNDIEDLQVTLDAGSCSSRVSFNVPDAHTQGLEFELTRQFTDQLFFSLSGSIIEAEFDSTVVDGSGAVLGGVEDGNRLASVPEESFSISFTYDLASPLFSSNSTYFQGSYQYVGDRITQPSDQVAGAGTFVSGLAFGGATGQETTELDLVLDAYGTMNLSFGLAYDDYEILLYANNVFDENALLSLDRERGGRARLGFTTNQPRTIGATFRYFFE

SEQ ID NO: 19133 - protein, 212 aa, Brucella ovis
MFKRSITAAALGAAVMAFAGSAFAADMMGGTDYTYNDPVAAGPHDWSGNYVGARVGGSSSKFPSPFASRTGALGGIVVGKNMQNGNIVFGAELEGNFAEAEHRIGHGGTLQQSWNGNAKGKVGYAFDKTLVYGTAGYGVTRFKAKDNTTSAPGWEGGVLIGAGVEQALSGPLSVKAEYDFQRFNDVKSQVNGIEQRNNLKNHSIKAGLNYKF

SEQ ID NO: 19134 - protein, 230 aa, Brucella neotomae
MTFKNLLGASLVAVITSTSAYAADAIVAQEPAPIAIAPSFSWAGAYFGGQVGYGWGRAKLENRTNGGTSEFKPNGFIGGLYTGYNFDTGNNFILGLDANVDYNNLKKSRDFITSGNPVQTTGETQLRWSGAVRARAGYAIDRFMPYIAGGVAFGGIKNSLRIGGEESSKSKTQTGWTVGAGIDYAATDNVLLRLEYRYTDYGKKNFGLNDLDTRGSFKTNDIRLGVAYKF

SEQ ID NO: 19135 - protein, 228 aa, Brucella neotomae
MKLKALLFASTVVLVAATGANAADAVIEQEPAPVVVAPTFTWNGAYLGGQIGYAWGKSHFSYDSTGLGDIKPDGFLGGLYAGYNFDLGNSVVLGIDGDVTYNDVSKNIDFLDENNAAATFENRLRWSGAVRARAGYAVDRFLPYIAGGVAFGSLRNRGEFEGTGFSQSKTLTGWTIGAGMDYAATDNVILRLEYRYTDYGNKDYGFDDAAVTNNFKTNDIRFGVAYKF

SEQ ID NO: 19136 - protein, 272 aa, Brucella ceti
MNIKSLITTSVIALVSASAAQAADVIATHEAAPVITTPNFSWTGFYIGGQIGNFTSDNKIKGLGKETSIFTKELTPQLSGIVGGIYAGSNIDLGSGLILGVETDAIWADCEATKTSAIRTLSVPQANSLNDEFKAAGITLKDKFSENDTMSDHYTYKAKWSGATRARIGFSAFDRVMPYFAGGVAYARMQGMKSVSGMNAAKNKKLGGGLYDETKMMVGFTVSGGVDVAMTGNVLLRGEYRYSDFGKKKFLNNTQEFNYKTNDFRFGVAYKF

SEQ ID NO: 19137 - protein, 627 aa, Bacteroides fragilis
MNHKSEYTFKITSRGIALAGLGLALLATPARSQESTNELVHELDAFSISANRFEIPVQQVGSTVDVLDAFELQNGGEVFLVDALREIPGIYMRNNGGPGGSFGITTRGLSSNRPKVLINGIEVSNPSNGSMINLGNLFTGSASRVEILRGPQSSLYGADALAGVIAIDTLGLESAEGGRAFLGYGTYDTYDYGLGHSGSQDGFSWSVDGMIHESEGFSAQTPDYGSAWADDDSYDNTTLSSAVQYEFKEGGRVYASALYLDTYSEFDPGDPAWVWGIPGGDHYATTEQLFARVGGEFRVQDNWVSTGSVSYSDVDTASYSDGSPYFASGKRYKYDWVNTVEASEGWTFVAGLEHETEENLSDVGNRDDTSVFMENVVAVNEQLDLTLGGRYDDNSAYGEEFTYRATFSYRIDEMDARIRGSFGSSFQAPTFYQLFNESYGNVNLKPESGKGWDLGFEKSLLDGKLSFSSTLFGNDISDRIVWNGVYENVEEYKSVGVENAVRYFVSDTLRLKASYTYSDAEENGSVEALRVPRNVGSLGANWTGLDGKLGLNVDAQFVSSQFSDSGSRFDNVKLEGFEVVNFAANYELSDQYSFWLRVGNVFDNEYEEIAGYQTAGANVHTGVRLKF

SEQ ID NO: 19138 - protein, 202 aa, Bacteroides fragilis
MKRVLITALAGVFAVAAYAQQSQATVSTNNDSASVFGKRYVGADWTYYDINDQSSSYQLGATFNQPVHENVDAYASYSYGWVGGHTSHDSQQLSVGANVYFDIGNNIRPFAGVGIGYAWGSENNDDWFYTGRVGGEITLLQNLSLLAYAAYTDGGKNYGIDDIWTATAQATYWLTEKLALVGRATYFEEGDWAYAIGALFRF

SEQ ID NO: 19139 - protein, 813 aa, Bacteroides fragilis
MKHDVPSRIVAARAEFKLTPVALAMYAMFAGALILSVLPASSFAAEPPAAKVATYNFNVPAGPLSSAIARFSAQSGTYVSVNGALTDGKNSQGVQGNLSVPEAITRLLAGSGLEALMQTNGSYVLRLAPIADSTLPAVTVTSDVVLPGELPKPFAGGQVAKGSRVGILGNVDIFDTPFSTQSYTEEFVQDQQSRRVADIISVDPSVRSAMAEYGDSETYIIRGFPVFVNQVGVNGLYGMTESRRITPEFYERIDVLKGPAAMLNGISPFGVVGGNINLTSKRADDKPLTRVTGSYISDSQFGLHLDLGRRFGENNEWGVRVNLLKRDGDTPIDRQDDHMKNGALALDYRGKQLKASLDVANQDRLTNGYSANITYFENFALPRPPQVDKNYVDNWEFIKTKAKYAMAHVEYEFNPAITAYANYGKSEGNEEYFYAGSQGRKFINNAGDFTAKAGGYRGSYEVDTYDVGLRGKFMLGEVSNSYALSYSDFSRKAYGATVNVSAEYTGNVYNIPNRIPPVVKYGAIPQNGDLQLSSIGLVNTFGFMNDNVLLTLGLRKQDLYSGIFTAGIKTRAYDESKVTPAAALLVKLGSYSLYTNYSEGLAQGATAPATVTGNPNALLPPAVTKQVEGGVKYNAGTFGVTAAVFQISQPNTFTNSSGFFVADGEQRNRGLELSTFGQPLRGVRLLGGITLIDAVQTKTANGINNGKDAIGVPKVNVVLNGEYDVEALQGFTLTGRINAFSGAQANAGNTQSIPGWQTLDVGARYVTQVAGKAVTFRGNVINLTDKNYWNSVSRGFITLGAPRTLLLSASVDF

SEQ ID NO: 19140 - protein, 1085 aa, Bacteroides fragilis
MKDMRKKEYLKSRSVIVQGIHSPKRFWFACGLSLGLVSLPLSTFANNWSNQLGSSIQKSIQQNRIITGSVIDESGEALIGVSVLVKGTTLGTVTDLDGNFTLEVPTGAILVVSYVGYKTQEIKVGEQQKLAITVEADNKLLDEVVVVGYGVVKKSDLTGSVGSVKSETISAKGATSVVESLQGQVAGVNISQSSSRAGDGFNIQIRGKSSLNGGNPLYVIDGVVCENMDFLNPMDIEKVDILKDASSTAIYGSRATNGVVMITTKKGDKDIAKTTVSYDGYYGIKTKANMPDFMEGDDFMKFRFSRYLVSSMDASSGMTNWEMTDANFLNFWGNGSQIVKNMYLNKNYTDWVDIVTRNGSQQNHFINISGNTKNITYRVGLGYQNEEGIMYDGYERWNIKGAVDHKISDKISAGFSTNMATASKESGSNYSILEGFRMTPNMPCYYWEGEKAGQLISQPGKDTAIYPNGGGPTSSINPVVDRLNSKDDTRSYDVMANIYLQYSPVKEIILKTTFSPMYTKTHRGTFYNGETQLRSGKTNMAENYNDEIFSYTWDTQANYIKNFGDHSLNALALFSVYEQKLQGDYINVVDMPFDVDWHNLGSGTVQSQSSYYKKISMLSYVARINYAYKGKYMLTVSSRWDGSSKFQKDNRWGMFPSAAMAWRISDEDFMGFASKWLSNLKLRASFGITGNNAGVGPYDTQALANIKYYYNYGSSVANGYGYTMTNADLTWEKTTEINLGLDFGFLNNRINGSIDIYNKDSKDLLMEMETPFELGSYTGSIVSNVGKVNNKGIEIQLNTINVKNKDWNWETTFSFARNINSIKELNGTKEDLVGNKWFINHPIDVVYGYKYTGICTREEAQAYAQDPKMKTKFYEGEMKIYDKDGNGTIDANDKMILGHCAPTWTGNFTSNLSYKNIDFSFSIYTSQGGMVYSPFMAEFVDYGQRGMNRLNMDYYIPQGAPILGADGSIAYQEVTHYGSYPFPTNGGNGKGGGAYWQSGANEDRAQNFVDNSYVRIKNITLGYTFPQKWISKLHISNLRIYANILNPFTFTNYEGFDPEWADAQVGDGTGGVSSRTYQVGVNLKF

SEQ ID NO: 19141 - protein, 1221 aa, Bacteroides fragilis
MTKRRAIYHLRAAGTLLVAVLAPAGVLAQTTTTPPAPQDEDVVLLSPFEVSAEQQSNGYATATTLAGNRLNTDLRDLGTALSVYNAEFMTDIGATDQRSLLQYTLGTEVGGVLGNYSGSGGGNAPNTNASLSPQSTNRVRGLVNADNTRDLYLTSIPWDGYNVEAVDIQRGPNAILFGQGSAGGVINTRTKQASFRNLAEAAVRVDQYGSIRGTLDINRVLLPEELSLRLALVQNEGKFQQKPAFENFNRQFVAFRYEPKFLKKAGARTIIKLDGELGSSTSNRPRNMPPQDRITPWFSIGTPVYNLAWLNEGNWQIPGRGAAVRQDFATPANPNPNFQPLLGGQGAGYSGNYFGGSVFQYNGDSSTPLFAMALNPVTYLGLGANGQRDGNIAGLAPSGPRGMPGYRDYAFEMKLPFASLAKNKFITDTNVFDFYNNLLDGDIKREWYDFNTFDASISQTFFNDQLGFDIGYHDETYKDGGYNPVSDTIFIDVQARWTDGTNTPENGWYYDGTPNVGTGRPFVSVGNGEGRGRMDRESTRATAFATHDFAKSADSHWLLRILGQHTVTGMVSQDDTFRTTENWVKSTFVGDYYNHPQFAEIKDNNGRFWADFVPQMNVYVGPQLTGKSLGQDLGIRGPSATPIIPSTVNLRYFDSTWTATGVNPADPWYNQVTAGLPQGPALSTQSENPANYRGWGTRSVSLMTDADPNNIPALMSERTWDSRFNDATALVWQGKFWDDAIVATAGMRRDKVGQTFTRWNREESTDDPTQIRSTVSVLGPVQEDSRSWGVVAHFDQLPWVGRWMKRLPVSISATYNKSENFQTGTIYQDYFGQELPLPSGETKDMGVILATRDGKYAFKVNKFESAVKNNPSSGLQFWNYGNNVGIYAQAYHQIKYNYVNRSQPNSQRYGANIISDLPVPGPADPQTKWNFDYQPLNGQTLEQAQQLEVAVINAWDQWLTELAPLPQVMAKAWSFAWDGSDFTETALANFRYTEDLLAEGYEFELHAQVTDNWRMTLNASRIKSYRDNLGNTPVPGGGMTMTDYLVDFDRRLNETAMGDLRIWGPGGSANARDNWNGYANGDLKARLAEQGTVVPENRLWHFNLITNYDFTEGRLKGWSVGGAVRYQSAMTLAYKPIQQPKYIEYDLSAPYRDKALTDFDVWIGYHRKLFHEKIDWHAQLNIANVGVGNELLPVTVQPDGSPAAYRIRPPQQIFLTNTFRF

SEQ ID NO: 19142 - protein, 1086 aa, Bacteroides fragilis
MTEKTNLFPNLIRFRETNRLKMAIAASIMLWCATPQQAAADTYEKHEIASVQQQKVKTTGTVLDQNGEAMIGVSVKVKDNATMGTITDLEGKFSIDAPKGATLEISYIGYKTVTVKAEGTALHITMKEDAEVLDEVVIVGYGSQKKVNVTGAVGMVNSEVLEARPVQNVSQALQGVVPGLNLSVGNSGGALDSSMSINIRGAGTIGDGSGSSPLILIDGIEGDLNSVNPNDIENVSVLKDAASASIYGARAAFGVILVTTKSGKSGKAKVSYNGNVRFSDALCVPEMMDSYQFALYFNRAAENAGDSGPFSQEALDRILAYQAGTLKETMTMNEQTRKWQAYGGANANTDWFKEFYNDWVPSQEHSLSISGGSEKTQYTISGSFLDQNGLLRHGSDNFQRYTMNGKITSQIADWFTVTYSTKWTREDFDRPSYLTGLFFHNIARRWPTNPAYDPNGHPVDGMEIEQLENGGKQINQKDLNTQQLQFIFEPIKNWRINVEGSLRTTNTNEHWDVLPVYAYNADNEPYLISWNGGALGLSQVNEYSYKENYYTTNIYSDYFKQFDSGHYFKVMAGFNSELYKTRYVQAQKSTLISSSVPTINTATEDPKAWGGYAHNAVAGFFGRINYNYKDRYMVEANGRYDGSSRFIGDKRWGFFPSFSAGWNVAQEPFFERIAEKCSIGTLKLRASWGQLGNTDTKDAWYPFYQTMPTGSNYGWLLNGALPNYANNPGIVSMKKTWETIETWDVGLDWGLFNNRLTGSFDYFVRYTYDMIGPAPELAASLGTGVPKINNADMKSYGFELELGWRDRIRDFSYGVKFVLSDSQQKILKYPNEDYNIGTYYKGQKLNNIWGYKTIGIAQSQEEMDAHLAKVDQSALGSKWGAGDIMYADLDGDGKISTGSNKLGDTGDRVILGNSTPRFNYGLTIDASWKGIDFRAFFQGIGKRDYWLQGPYFWGSTGLGQWQAAGFKEHWDFWRPEGDPLGANTNAYYPRVARNGGKNTNVQSRYLQNAAYCRLKNIQIGYTLPKTWTEKAGMSSVRVYVSGDNLLTFSDITGIFDPEAIGSTYDANNGKLYPLQRVISVGLNVNF

SEQ ID NO: 19143 - protein, 567 aa, Bacteroides fragilis
MKYNNYILLGIAFTALPVSIQAQTQPKDTTVNRTVIVEQQYNPDIMDAAKVNVLPKVEEPSVSKKEVEYATFTTPATSIPAGTIGAYTGKEIQPGFIPGYVRLGYGNYGNLDVLANYLFRLSDRDKLNVNFKMDGMDGTLDMPFGDTRKWNAFYYRTRANVDYVHQFAKLDLNVAGNFGLSNFNYEPYGFKKQKFTSGDVHFGVKSTDETLPLQYRAETNLMLYGRQQCQLFGGVNETMVRTLATVSGSVSDEQTVAIGFAMNNLIYGNELKENKDRIKDIFKNRTTLDLNPYYELNNDSWRVHVGANVDLSFENGKAVRVSPDVKAQYVFSDSYVLYAKATGGRQLNDFRRLETYNPYLDPGQEVKDTYEQLNAGLGFKASPTPGLWFDIFGGYQNLKDDLYQSADAWEGGDGANYIGLGQTHTDNFYAGIKASYEYKDLFAISAGGTYYHWNADAQTTGSKSSDYNEALLMKPEFDLGIHTEIHPIAALWLNAGYQYTRRAERYTGLYAKSIPAVSNLSLGATYRIFKGISAYVKADNLLNKKYQYYLYYPVEGINFVGGLSFRF

SEQ ID NO: 19144 - protein, 1056 aa, Bacteroides fragilis
MNLKDLNNLRADTEGRIKTVFLICMFVLVSAGGFAQNTKSISGTVREKGSNETVIGATVQVKGTHNGVITNENGEYTIKNVSPGQVLVFSMIGMNTVEKTVGSQNRIDVLMDAGVLIDEVVVTGYQTQRKVDLTGSVSSLSSDQFMQTNPLSLEQALKGKISGVQVMNNDGAPGGGITIKIRGASSITAGSSPLYVIDGFPLPISDDPLESPLATISPDAIESISILKDVSSTAIYGAQGANGVVLITTKKGSAGMSEISVKATYGISKLANSILMLGAEDYMRAYMRDMIMSGRWQNADFYQEYKDQIWNTNPSRFQFYPDLCLQNGTKQNYEVSYRGGTDRIQNSTIFSLMNEDGIAINTGFKRFYFQTNNSIKLLPQLTLNTNLSYEHNIRSGAFWTEGNIFNEIQTFSPLVPKEWTFQEIDDNLYYTGKMDNPYRKLKDIDYSNKNNTFFGQAELVYNINDNWFVKGGIGVRIPKGEVKEFIPKTIQRGYDNNGLATYATQSGLNMRGVVQAGFNKVFNKVHSLSVNAVYEANTNKYETFNQEYSQFNTDLGWEGIYDAKSGNHVKSPGVSYEKIAMLSGVLMANYSYKGRYLLKASMRADGSSKFSPDNRWGFFPSGALGWRVSEEEFFKNVSWLEKNVNNLKLRFSYGQVGNDQIAPYAYAQTLSSSQRQAIFGDGAIPALYTSRMANPEISWEVTEEFNGGLDLDMFNNRLNISLDLYTKTTRDMLLEQNLPRTSGFGKVTRNIGSVRNRGFEISVGGVLIDKKDFTWNATVNFSSNQSKVLSLGAETQMLEGRPVGSASGSENVLIKKGYPLGLFYGLQMEGIRSNWHSDYNGIGSADSPWWYATEREMPYGFPSFADTNGDGKVDMSDRVVIGDVNPVFIGGLNTRLRWKFIELAMDFSWSYGNDIINGNVYNLMNNGDIRNKSAVYYKDAWFANNPTGTFTGPGAIDWSGYMWAASNSEMVEDGSFLKMNNLAVTFRMPKNILKAWKIKDLALTYTINNVFCLTNYSGYDPEVRSGSSVNNRILPGVDISAYPYARSHIFSLNFKY

SEQ ID NO: 19145 - protein, 998 aa, Bacteroides fragilis
MKKNLFTLCMMLLLSMLSFAQGSLTISGVVTEKKTGEPIIGASILLKGQSSGTITDFNGNYSIPNVPSGATLVFSYIGMKTQEVKVTASSKLDISLEEDNQLIDEVVVIGYGIQRKSDLTGSVGAVKSKDLTKVATPNVANALQGRVSGVYISANGAPGSSPEVRIRGIGTTNNSNPLYVVDGMFMDDISFLSTHDIESMEVLKDASATAMYGSRGANGVIIVTTKQGTEGKAVVNFTASEGFQFNNSSFEMANATEYATLLNEALVNTGGKPKFDDPASLGKGTNWFDEIFRVASVRDYQLSVSGGSEKVRYNLSAGYYQQDGIITGNTYNRFTLRANNSYKISKRLTLGHNLSASFSHKKNENSAVVKAAYTISPVKRPYNEDGSFMDSESASSANPVATLHYTNNDDWKERIVGSAFLNWNILNGLDFKTSLGIDYINGRRRNFVPKYYVSETQKNETNSLSKTWDRDFTWLWENLLTYDWKINDKNRLNLLGGITAQKRVYELLEGTGRDFFSDNENYWYLDQASAGSKSVANNGYHETMMSYLFRANYALMDRYLLTVSVRADGSSKFGPDNRWGYFPSVAAGWRVSEEAFLKDRVQWLSNLKLRGSWGQIGNDKIGNDKYRALANISPSYDAVFGGVFYPGGTITSLSNRSVHWERSEQMDLGFDLGLLNNRFSLELDYYRRDTKDMLVTVDVPASVGLTPVETNVGAVRNSGVDFTVKWEDSLKDFRYGIRLTGTTIKNEVISLGGKRIASGDIGAGKSVQMTEEGKPIKYFYGYNVIGIFQNEAQIKDYNERAAAATGNAGQQYQNNVGPGDLIYEDVDGDGYITANDRKDLGSPTPKFIGGLGISAFWKGFDLSIDFQGNFGNKIFNAKQVERFSGSDNWDRSFLDRWTPENPNTMTPRMTLEGNNYQVSSRYVESGSYVKLQTVELGYTFPKSWMQKVSVQNLRVYFSGNNLAYFTGYNGFTPEVLGGIDRQIYPVTATCRFGLNVTF

SEQ ID NO: 19146 - protein, 1067 aa, Bacteroides fragilis
MKITKSKTNNLIIMHNIITNTISHRGFITLLALVMSISLYAQNLVKGTVVDETDLPLIGATVLIKGNSGGTITDIDGNYSINAKKGSTIVVSYIGYKTQEVKYTGQQKVNIKMIPDNQALDEVVVVGYGSMKRSDLTGSVASVAAKDVVGFQSSSVIGALGGQIAGVQITQSDGGPGSGFNINIRGVGTMTGDASPLFIVDGFEVDNIDNIANSDIESMEFLKDASSSAIYGARAANGVVMITTKSGKSGRPTVTYNGSASYRKITKKLDLLSPYEFVKLQGEINEKYPDTYYKEGNDDNGIPYRYQSLEDYIGQSGVDWQDETFNPTWSQDHNLSITGGDEKTTYSLLFTRYNENGIFNNSGFDRTTAKFRLKQKLTKKISFDATINYAQTNRKGIGTTADSGRFNMLAQILSARPTGGLKLTDEELLASAIDPVMLEDGSSLAQVNPVKQTESVTNKKRAEMWSANVSLTWEIIKGLTFRTAATYNTTNNRIDKFYKEGSKEAFRNGQKPYGDTQMGRDLRWTNSNQLTWKQKINKKNSYDIMLGHEISYRSNEYLLGQAMDFPVDYLGNNNLGLGATPSKVVTDFGDKKLLSFFARGNYNYDNRYLLTATVRADGSTVFSKKNKWGFFPSFSAAWRVSEEAFMKDISWLSNFKVRLGWGIVGNDRISNYLSLDLYQNNRYGIGNSLVTVLTPKQIKNQNLKWEGSSSVNLGVDLGFFDSRLNFTADFFIKNTKDLLLAQELAHVTGHSTQYQNIGKIQNRGIELNLSSTNIQTKSFTWSTNFNISFIRNELKSLESGANYKTTRSGFDGNFTQDDYIAMVGSSLGLIYGYEFDGIYQSSDFYIDGYTDANNPKYILKEGVVNNTRYTDADGLRPGVVKYKDQNGDGIITSEDRTVIGNALPKWYGGITNTFNYRGIDLSFMFQFNYGNDIYNATRLYATQTRNGRRNMMAEVADRWSETNASNKVPSVKGYITNDVYSRFVEDGSFLRLKNVTLGYTLPHKWTKKFYVSKLRVYASGQNLFCINGYSGYDPEVSTAGSNPMTPGLDWGAYPKSRVFTFGIDLQF

SEQ ID NO: 19147 - protein, 463 aa, Bacteroides fragilis
MEKIFKRSVLSALVIGIVAGSALTVAPSAEASGFFEDSSINGALNVWMRDRTRGDVDANGNDTSKVPNLDHGSLYLSVDFNSGYVADTVGLDLNVYSTFDLWQNASPDHEMNFWGVDNPYDMEPTNRSGCDSAWDSGCNDNGAAFQTAAFKFKFGDTVTAKLGYFQPSVPTAMGVNWSFAAGTYTGGEIGANVGNLALGLVVADEYRAPWFKDSYEFRTGTGSSAEDAGTAYSLGGRYTFDNGLLLDAAYAALTDGDRKNAHVKVKYTTADGWYLSPQVYVVDDDNQYDSTAYQLAFLSAKSYGQYSFRAEATYTAADSSDTRGNVGNMAYRLTEVYGGSNGAYDIWWNNRSDFNHDGEIGFFGSVARDFSDLGAQGFSAGVNGVYAFGAKSDQAGIDELVEYSGSAFLNYAIQGGALKGANFGMYYTYYVNDSNAGNWAPYSNAFQDETDLKVTLTIPFSVK

SEQ ID NO: 19148 - protein, 998 aa, Bacteroides fragilis
MNNILKQAGAILSLSLLCGMQVYAFPDYPSLRGQIIEQSDICQGVVKDANGESIIGASVLVKGTTNGSITGLDGDFSLRNVKKGDIIVVSYVGYQSQEIAWTGEPLNIVLKEDAEVLDEVVVIGYGAVRKADMAGSVAVLDNKNFKDQPITQVADALQGRVSGVHVENSGVPGGSVKIRIRGANSISKSNDPLYVVDGIVRESGLDGINPEDIRSMQVLKDASSTAIYGSRGSNGVVLITTKSGKAGVREIMFDASVGVSNVYKRYDILGAYDYALALKEVKGIDFSNEEMQSYQNGTAGIDWQDEIFRTGITQNYKLALSNGSEKTQYYISANYMSQEGVVIESKNERYQAKANLSSQLTDWLHITADINASHGVRRGGSFASGKDNPIWIALNYSPTMTMMAENGNYNTDTYNSIASNPVGILKLQSGETMTNVFNGRVDLRLDIMKGLTFTTTNGVDYYDEKSYSFSSKRVGTKSGMGNNDTYRLMLQSSNNLTYTGSWNDHHLTATAVYEVTSSETRTMGITGNNLLTEGVGWWNVGMASSRDANNGYEQWALMSGVARVMYNFKDRYMLTGTFRADGSSRFAKKKWGYFPSIAAAWTLSNEDFMKDVSSVQDIKLRASYGIVGSQAISPYATMGLMSATAYNFGTNSNFTGYWANDIATPELTWEKTKQFDLGLEFSLFDRRLNFSVDYFYKRTTDALLKRSIPGYVGGNSFWVNDGEISNRGIDLSVTARIMQNDRFQWTSTLNGTYLKNRVERLSGGENDFINGSSPAAGMVDYATIIKPGEAIGTFWGYEWTGLDEKGHDTYTDVDGNQMIDGGDRKVIGKANPDFTLGWNNSLSYKNWDLNLFFNGSFGAKRLNLVRYTMASAEGNSRFVTLADAYLKGFDKIGSSATYPSLTEGGNNLQPVSTKWLENADFLRLENISLSYTFPKKTTGFADLRLTFSCQNLFTITGYKGMDPAGTTFSNSSVDVDAGIDMGAYPSPRTFTFGLRMNF

SEQ ID NO: 19149 - protein, 1033 aa, Bacteroides fragilis
MKNTQKYFILLLMLILLVPSNIWGQETKKEIIVKGVVEDDLGPIIGASVVAKNQAGVGVITNTEGKFSLKVGPYDVLVVTFVGYQPYELPVLKMNDPNNVTIKLLEDVGKIDEVVITASGLQQKKTLTGAITNVDVKQLNAVGSSSLSNSLAGVVPGIIAMQRSGEPGENTSEFWIRGISTFGAKSGALVLIDGVERNFDEILPQDIESFSVLKDASATAIYGQRGANGVILITTKRGEKGKVKINVKAGFDWNTPVKVPEYASGYDWARLANEARLGRYDSPIYTPEELEIIRSGLDTDLYPNIDWRDLMLKSGAPRYYANISFSGGSDNVRYYVSGQYTSEQGRYKTFSSENKYNTNTTYERYNYRANVDMNITKTTVLKVSVGGWLVNRTTPTRSTGDIWEDFAKFTPLSTPRKWSTGQWPRVDGQDTPEYHMTQRGYHTKWESKVETSVKLEQDLKFITPGLKFEGVFAFDTYNENIIKREKKEEVWEAQKYRDENGKLILKRVVNRSPMNQNKEVRGDKRYYFQASLDYNRLFAHAHRVGVFGMVYQEEKTDVNFDSSDLIGSIPRRNLAYSGRFTYAYKDKYLAEFNWGCTGSENFEHGKQFGFFPAVSAGYVISEEAFMKKALPWIDQFKIRASYGEVGNDVLDGRRFPYVSLIDTDDGGSYSFGEFGTNRVQAYRIRTLGTPNLTWEIAKKYDVGVDFSFFNGKISGALDWFLDKRDDIFMQRKHMPLTTGLADQTPMANVGKMKSYGWEGNIGFTQSIGQVNLQLRANFTYQTTDIIDKDEAANELWYKMDKGFQLNQSRGLIALGLFKDQDEIDRSPKQTSNRPILPGDIKYKDVNGDGVINDDDIVPLGYREVPGLQYGVGLSANWRNWNLSVLFQGTGKCDFFIGGNGPHAFRSERYGNILQAMVDGNRWIPKEISGTTATENPNADWPLLTYGNNDNNNRKSTFWLYERKYLRLRNVEVSYDFPQTWTRKFFVSNLRLGFVGQNLLTWAPFKMWDPEGTREDGSNYPINKTFSCYLQISF

SEQ ID NO: 19150 - protein, 645 aa, Bacteroides fragilis
MRKITPGDGRIAPNPMKYQSGSWLFKLAYHFSPQHSVNAVFEQTKQRYDIQDMAQAKYSNLLPNNKGEPDRKKTEVEYSLFGRNFYPDDPSQAIGYGNTLNPSLVRSAYWSRARFFDERHTKRRLGFGYQYKSENDKGIFDRLNLNLDQQDIRLLTKLHSLSCSRYPYFDKNCKITPDKRDANATYERNIYKERHKQVQLSFEKDLEIGKTQHLFNLSMSYDRMRSNHKRDQFERVYLVYSKEDESEHPYYDVGNQDKDVGYYNSGTYKYPRIIGKRQAIVAHNNYCKFDMHYGKRKDFSDCSAHITKGQHYAIGLSDRIFFGDKLDLGLGVRYDYHRFKSDDDWVNTGTYKNFSWNTGVTVRPREYIASSYRASNGFRVPSFDEMFGRRVPGAADNKYWRRDLLKKKLTSEKALNQEVGVAFNGNLGVLEVSYFDNRYRDLIVSAKEKGIDGIAGFYNLQSINLNGVNLLGKLNWHGIWSALPDGLYSNLAYNRIKVKNVDTKPNYVFVRSSVLDAIQPERYVASLGYDEPNGKWGVNYILTYSKAKKASELIGTTTYYTGDVVKGVTNQRTRPWYIYDVIGYYTFAKHFTVRGGIYNLTNRKYSTWEAVRQTAETNVIPIYNRGHASYAAPGRNYVLSVEAKF

SEQ ID NO: 19151 - protein, 892 aa, Bacteroides fragilis
MRKSNPDFHHIRSYILMCVVSLTFSTIYAQTPEPKLTLKLQNTSLSEVIRQIEQDTGFSFIYGEEVKLDHKVSLNVQKKPLREVLNLLFANKPISYKITGKHILLQKTPPKPVSRKFTVSGYVTDGASAETLIGANILESRHHQGTTTNPYGFYSITLPEGEARLSFSYLGYTGQQHVLNLTADTLLNIRMKDNNMLQEVVIVSDKAESGVMATQMGASEIPMTQIKNTPSILGEADVMKAIQLMPGVQAGMEGSAGLYVRGGGPDQNLILLDGVPVYNVDHLLGFFSVFTPEAVKKVTLFKSSFPARFGGRLSSVIDVRTNDGDMKNYHGVVSVGLLTSKINFEGPIIKNRTSFNISARRSYIDLLAKPFMPKDEKYSYYFFDVNAKINHKFSDRSRLFLSAYNGKDHFMTKYDDTYYGDEDKYRDGGKMNWGNTIVSGRWNYIFNNKLFSNTTVAFNNYKFDVSTFTKNEIHTNNQITWNRYKADYKSGIRDWSAQIDFDYNPIPTHHVKFGVQYLHHSFRPEVSTSKIFDKTGETIERDTTYYTTSNSEILAHEASAYLEDNFNLSSRLRMNLGLHFSTFQVQKKNYFSVQPRISARYQLSKDVVLKASYTKMSQYVHLISSMPFAMPTDLWVPVTSKIKPMQAHQVSLGGYYTGIDGWEFSIEGYYKGMKNVLEYKDGVSFLGSSTGWEDKVEMGHGRSMGVEFMAQKTIGKTTGWLAYTLAKSDRKFATGGINNGERFPYKYDRRHNIDLTLNHRFNERIDVSASWIFTTGGTTTIPTELTGIIRPGDNDSSIEEGDYVKHRNNYRLPATHRLNVGVNFSKKTKHGMRIWNVSIYNVYNAMNPTLIYRTYKKTEYTQGEQAQGNRIPVIRKFTLLPCIPSFSYTYKF

SEQ ID NO: 19152 - protein, 663 aa, Bacteroides fragilis
MNNGLITGTGTVQGDLYNEGTTAPGNSIGTLTVDGNYIQGLTNSNANLNIEVDGSTSDLLKITGDNRTILLGGNLNIASYNNAAVSPGHIYTAIDVTGDNAAGGELGLTTKLNVVGSSGMKFVRETDREFRLLDPAYYATCTSNDPAVQVGCTKLQFAWLKVHPDTGVAVNPDRHKTPGQSTIKAIKQTGGALTTASSGNSSTNTNTCIANGGSAASCQQQNKTGSGSGAHNANSTNAAKTLDAGWASLGAAVSSGVTGGSAIGTTGYTTNQTSAALVTPDFANVIAAFFSIPTRIELNQALHSITAEPYASMQSVALEAMEQFGKNSLALTDRAVPLTHTQTFCKTDDGSLVPADSPERPDTCDAREKTVGSRWSLLLDGSNTEASLNGTSELASLDYNVFSTIYGLQYAFSPEWSAGAAFGYGQANLYNYEYANAHINADTYGGSIWGIYRPSAELKISGLLGYMNLQYDSTRQMAFGGLNRTANANWDGNGFTTALEAQYNWALNGDSSDPDAIRLKPQTFLAYAVHNQDSFSESGAQSLNLAIDSHTADSVLWGLGFTLETPIRLSSSNRIIPRFTVGYEHDFMGSADEEHQLTSSFSELPALGSIDVLGQNRGADALDLGLSIEIETSDSVSLYASVNGGFWSNGTEVSYGGGLKYAW

SEQ ID NO: 19153 - protein, 1071 aa, Bacteroides fragilis
MRKPFMLISVLPITVHISHDTDTASNRIGGIPEKYALKNKVLRSICFVLFLLSIGLNSAFAQVRNAAGLVVDENGQPLIGVQIKLEGTTTGVITDVDGNFSINAKKGDILLFSYVGYEPQRITYKGEKILAIKMLPNTELLDEVVVIGYGKQKKNSVVSSINAIGPKELAVSSNRNLTNSLAGQVPGLIAVQRSGEPGYDNSEFWIRGVSSFKGGTNPLVLVDGVPRNMQDIEPDEIESFTLLKDAAATAVYGAEGANGVILITSKRGNSQKPKISLRAESTLLTPTRLPKFMNSVETLDLYNEALNNEGTASIRTAEEIAMYGPGADRDLYPDTDWLKEMLREHTYNMRYTLNVRGGSERARYFVSGAFYQENGIFKEGKKNEYDNNIGLKRYNLRSNIDFDATKTTLVKVDISGQYLQTNYPGTSTNTIFNSMCRTPSYLMPAEYSDGTIAGHPRPSGNRVNPYNLLMNSGYAKEWRTSIQSKLEVDQKLDFITKGLNWKGLISFDADMKYIAKRTKTPTQYLATGRDENGGLQFKKVVEGSDVLTEKLENSSNKKIYFETSFNYNRTFAQKHDVTAMVLYMQKETQYHNNALPYRKQGLVGRATYGYDGRYFIEGNFGYTGSETFAKGYRFGFFPAMGLAWYVSNEPFYPEVLKKVVNKLKFRFSIGRTGNDDTGGDRFLYRGTMKQDNGGYDLGFSDTGGMGGIGNGITEARFEAPYLSWEIEEKKNYGIDLGLFDNRIDLQVDYFNNKRKSILLQRNTVSNVTGFQQMPWQNFGIVKNHGVDASLILNQKIGQVNLSARGNFTFARNEIIEYDQVPQVYPWLEKRGTRLNSNKLYIAEGLYTYDDFIINGEGLNRTYELKPGVVSGLSSGVRPGDIKYKDLNGDGKIDSNDQKEDVGNPTVPEVVYGFGFNAEWKGFYAGIFFQGAGNTSTVLGTGADATFFPFQWGVEESAVRSVVADRWTEQNPSQNVMFPRMHSNNFQNNTVASTWWLRDASFLRLKNIELGYNFDKKLLKKLNIEALRFYVQGNNLCVWDHIKMWDPEQGNSNGGFPYPLNRTFTFGLDFTF

SEQ ID NO: 19154 - protein, 1089 aa, Bacteroides fragilis
MNFYRLKSIFFIIFSCFILQTAAFAQNNVKITIKKKNITLQEALREVEKQSDYLIAFNESKLEKTKRVNLNINAESLDKTLASILSGTGLSYKIKDKYIMIIPQSKVEVESKKLSGIVKDDKGDPLIGVNVSFKGSPTGTVTGLDGRFSILAAKGNIIEFSYVGYTTQYITVGDASSLTVVLEEDAKALDEVVVTALGIKRAEKALSYSVQQVKSDAINDVKDANFVNGLTGKVAGVSINRSSSGIGGATRVVMRGAKSIVGNNNVLYVVDGMPIGNPSKGEINNDYSTPGGGEGISDFNPEDIESLSILTGPAAAALYGSSAANGVILINTKKGQEGKLKISISNNTEFMTPYVMPEFQNRYGNAKGSYKSWGEMLQQPSTFRPKDFFKTGANIMNAANFSVGNKNNQTFVSVATTNSTGIIPNNEYYRYNFTLRNTASMLNDKLHLDLGASYVLQGDQNMLSAGRYFNPLVPLYLFPRGEDFEAVKVYERYDTNRKFPIQEWSYGDQGLNLENPYWIVNREMFVSKKKRYMFYANVKYDILSWLNIAGRIRVDNTNTTSERKLHASTIKLHAQSDKGAYNRSMEEYQQTYADIMLNVNKNFGNFNLTANAGFSYEDHLTTGMGIGGKLFTVPNLFSAYNFDPASGPGSQSHTHTRNNSVFVSTELGYKSMLYLTLTGRQEWASQLVNSDQPTYFYPSVGVSGVISEMISLPKFISFWKMRASFAEVGGPINYTGLTPGTVTDPMKGGVINPISVYPFPNFKAEQTKSYELGTNLRLFNNKINIDATVYLTDTYNQTFLSSMSPASGYSGFYVQAGKVRNKGIELSLGYNDRFGKVGYATNLTYTANRNKIMKMVHDYKNPSDGSLFSITELTLQDKGGVYLREKDAIGDVYVKGILARGKDGKLIEEEGGYKVDRSQRIKIGSVNPDFSIGWRHNVTWNNITLDLLFNGRFGGIVTSSTQAFLDDYGVSKDTYKARQNGGVWVNGTQYDAEKYYTTIGGEQLMAYYAYKATNIRLQEASLSYTLPGKWFGNVINRLTVSAIGRNLWMIYNKAPFDPEMTSSTGTYNRGDVFMPPSLRSVGFSVKIEL

SEQ ID NO: 19155 - protein, 1051 aa, Bacteroides fragilis
MKIKKHILIPLMVLLLFGSMDAMAAIEQAIQVKGKVVDNIGEPVIGANVVVKGTTTGVITSIDGSFAIDAVKGSTIVVSFIGYLSQEVKVTGNFLNITLENNTELLDEVVVVGYGVQKKANLTGAIATVGAKELEDRPVTNAAAALQGKVANLNISNGDGGPGKKASFNIRGYAGLDATYSPLVIIDGVTGYFDDLNPNDIETLTVLKDAAASAIYGAQAAYGVILVTTKSGKKNEKTVINYNNNFSFNSPTVLPKTAGSLEFSRLFREADINGGGSGIIDLETMERIEKYYYDPTSIPNNVPQRDNPDRWADWGDGRSNANEDWQKAMFKNNQLNQQHNISIRGGSDKTTYVMSLGYLKDEGKLRYYDDHYQRYNALAKITTDVTKWLTVGLNVRYSHEKSVSPAYGMNPGGSVNDMIGWTQVVWPTIPVRDPNGHFSPAGRMVFIADANPQTSYTDNFWGTANVVIKPLKGWTINADFTYNKWMNKRSYSKGLIYSYSVSNEPYLEGGFGTEDTRVWQESNNDDFTSMNAYTTYEKEFKGHNFKIMAGMQSEYKKNFGLYANKMGMVLPGQPSISTSTGKIEAWDSLDHYATLGFFGRFNYDYKSRYLFEFDLRRDGSSRYAKGHQWGTFPAFSAGWNVAKEAFFEPYTSILSELRLRGSWGELGNMRGKNYQYISTVPYNATTDYIMGDKRISAFGAPNMIAYNTWEKNRTLDFGVDIAALNNRLTMSFDWYRRDIIGLITKGVTLPAVLGVNSPDTNNADIRNEGWELTLGWRDQFSLASKSFNYSVSFNLSDYQGTVLKYSNPKGLIYDYYVGKKMGTIWGYTTDHIMTDPAEAKAINDSGVQNKFGGDWVVGDIKYVNLDDDPNINDGNQTLEDHGDLSIIGNDTPRYNFGFGFNADWNGIDFSMFLQGTMKRDLWLEGPVAFGLGGGQWGSNVWKNTLDCWREDGSNPDPWLPRLYLWSTSKNLQKQTRYMDTGAYCRLKNIQLGYSLPGAIINKVGLEKVRIYFSGDNLLTFSGINENFDPEAPWGGAYPISKSISFGVNVTF

SEQ ID NO: 19156 - protein, 1059 aa, Bacteroides fragilis
MTKRTNLFPSLIKTREMNCLKIAGASLLLLCISPQFAVADGLKQDAVTIMQQQNLKVSGVVTDEAGEPLIGVSVLVKGTTLGNITDLNGRFSLDVPEGSILEISYIGLKTQSIKAQREPMNIVLKEDAQKLDEVVVVGFGTQKKVNLTGSVSAVTGDDISKRPVANAAILLQGQIPGLRVNQGLGQPGGEGTSFRIRGQGTFSSAGSDPLILINGVPGSMTNLDPSVIESVSVLKDAASAAIYGARAANGVILVTTKQGAVGDKVHISYHGNVGLHTPTKLYDRVTNSVEYMELANLAWKNSGTGKQYTQDQINLYRNNVGDPQYPNFDWQDYMFRTAVVQTHNLSMAGSTEKTTYNVALNFVDQPGTMRGFKYRKYNATIDLTARITNFIKVGTYANLMYGETEQPRQGQNDAFLSTLSQAPTYMPWLPDDGTGIRRWTSSAYSFESHNKNMPAIIGDNAMKRDNNFDINAQLWLEINLAKGLTWYTKGAARLQSNKSKDWRGSTTYTYDYHTGERSSELDKGGLGLSVGDGRRFYTNLYSYLKYDLSLVDNAHNFSLMVGYNQESEKYETLNAYRKDFAFDLPVLNAGGTADWSNSGGEEEWAIQSLFGRFNYDFKERYLFEANMRYDGTSRISDENRWGVFPSFSVAWRATEEEFIKNLNLNWLNNFKLRGSWGQLGNQNIGLYPYQAMISGVDDYPFTKTSDGVIIGYQQTAYANRNIKWETTTITDIGFDLQVFDGLSVTFDWYKKTTDDILRSSQVSSLLGLSAPTVNNGSVENKGIEVALNYANMVKGGTFRGFRYNAGVYFDRSRNKLTEFGAEEIGSYSIKREGLPYDEYYMLECIGVFADQAEINASPKQFNDNTQPGDLKYKDISGPDGKPDGVIDNYDRRTFSGRFPGFEYGINASATWKGFDLSLIGQGVADKKYYTTDWGVQPFMQGSSPNKDYIKHMWTEENPYGAKHPKLYWQDMGGGKNTRPNSYYLKDASFFRLKNLTLGYTLPRVWTEKANISKVRIYFSGDNLLTLTPYKGLDPERNGDGRDAIYPQNRIYSFGLNVEF

SEQ ID NO: 19157 - protein, 709 aa, Bacteroides fragilis
MIFETLTMIAQKDTPIAAMRKRGAQQLLPLSCLLASLPVLAAEQPKELPKASETMVVTGTAMKVEVPMAETPRAVSVVNREDLDQHAVQQLDESLRYRSGVLSGLYGSDNNTDWFKVRGFDAASYLDGNRLFGTGYYVWTPEPFGLESVEVLKGPASILYGEAPPGGVINAISKRPTATPQGLLDLQLGSRDHRQIGVDVSDALTDNSRYRMVALYKERDGVLDGTYNDRVYLAPSVTFELSDRTSLTLLASFLHDEGVPTNGFFPVYGTLNTSGGQIDPSTNLSQPDYDRNRNTQISTGYELAHQLNQTWEFKQNVRFNYNDLLLRQTYIFPTYEGTTAFRGLVYRDGNTKSATMDNQMVGYWNTDSTEQTLLLGVDLQRHVNEGQEADNYGMGSINTMNPDYSGFPGFDESTATHQKSTKGQSGLYAQHQIRWDDRWLLTGGGRFDYVETHNISEAKGKNEKQYDHELSLSGSLMYLADNGLSPYIAYAESFEVLPGIDPNTSQSYKPLKGTLYETGVKYAPSFLDGYINLALFDLEQTNSLVSTGSGQQTQAGEVTSQGVELEGSVQATEALRLTAAYTYTDAKTNDTGKGDRRASLIPRHQASFWGNYKVQQGPVSGLELGSGVRYVGSSVGIGAVNADYTPIYGSAEVPAHTVWDAMIGYDFAKNWRAQLNVNNLLGDTYVASCDYYCYYGEPRSVVGSINYRW

SEQ ID NO: 19158 - protein, 1051 aa, Bacteroides fragilis
MLKITRQVTLLLLAGALSFPAYSYATQATEVLVPEVTQEKVTGTVEDALGPVIGASVMVKGTTNGVITDLEGKFSLNDVKKGDIIVISYIGYVTQEIPYTGKPIQVKLAEDSKALEEVVVVGYATVKKANLTGAVSAVDGKVLEDRPIVNLGQGLQGAIPNLNVTTSGRPGQGSSFNIRGTTAMSGSSPLVLVDGVEMDPNLINPQDVKSVSVLKDAASASIYGARAAYGVVLITTKGGRKDQPTQVSFDASVSFNGPTTRPTYMNSMQYATWMNTAQQNTVGRDYFDAEWMQHIEAYYKDPVNNSPVFIHSDPSISKNGTKYTYAGNTNWMKELYKKNYPVQKYNVNISGGGKKATYYTSLGYTDQGSLIRFGNEQYKKFNVMNNINYDVNDWLHLSMKTSFNRTKLRGLNQDNVHGDNFMGGDTRPIMPVKHPDGNWAGQGDFTNFPAILEDGGSRLTNKNDLWNTITMKLTPIKGMSINMDYTFNYYSENNKVHMKSFDEYGANGQFLQTFAWTNPNSVSQSQANDTYNAFNFFGDYEKTLGKHYLKGMIGYNQESKHTTGFNAGREQLISNDLGSLSYATGDRWVGSSDNSWATRSGFFRINYGYDERYLLEVNGRYDLSSKFPKHDRAVFNPSFSAAWRLSNESWFKSWTNSFFDELKIRGSYGSLGNQALNNGWYAYLSNYSTGQISWIMGSNQPQYVVPGGLVSSSITWETVTQWDLGLDFNFLNSRLKGAFDYYQRRTSDILAAGKILPGVLGANEPQENAAESLTKGWEFEISWNDQLANGFHYTVGFNLSDYQSEVTKFDNESKELGNWYVGQKQGEIWGYETYGLFQSEQEIAGAANQDKVSGGIKLMPGDIRFVDRNNDGVIDWGDNTVDNPGDKKIIGNSTPRYHYGINLGADWKGFDLGIFFQGVGKRDLYLPGTSFRSHYGSEWQVPSAYNNDYWTEENTGAYFPRARFNGGSAINQAQTRYMVDASYCRLKSLSIGYTLPKVLTQKASIEKIRIYFTGENLFTISDTPDGLDPELDNPYTYPMQRSLSVGLSLTF

SEQ ID NO: 19159 - protein, 1085 aa, Bacteroides fragilis
MKRNKWLLSLSIGLLCCGSAYAQTTVKGKITSEGGEPLIGATVAVKNSTDGTVTDIDGNYSLKTKKTLTQKDLLVFSYVGYKTLQKNYAGNTMNVKLAEESQQLNDVVVTALGIKREEKGLGYATETVKGDMITSALPTNWSTALNGKVAGLSVISSGGPLNSSRISLRGDVSLNQNGNDALVVVDGVPMSSPMTNPGVAYGAGSNSELSVDYGNGFSDINPDDIESIQVLKGASATALYGTRAANGVIMVTTKSGAGAPKGIGVSYSGNFSIDDVMRWPDYQYEFGQGLPSNIGPAGSIYEGQPYYSYGKAEDGSYASTSGTSSAYGARFDANRLFYQYDPVTQGRASVATPWVAYKNNRKDLFQTGYTLTNSVALTGKSDRGSVRASITHTKNEWILPNTGFQRITAMVSAQQQISRALRINFKSSYTYRKLNNTPALGYNSNSISYFLIFQNPNVNLDWLRPMWRTGQENVKQLQPYSSFIGNPYVILYESENPSEKHSNVSSISANLRINSKFDFMIRSGIQLSADQREQHRPISDVVFGNGFFKKQNVFDYELNSDALFTYHDSFANGLRVNASAGGNMMQQSYDMLAASVVGLITPGVYKLANGVSNPNVQTVIKKKALNSLYFTANFSYKDKLFLDVTGRNDWSSTLPKSNRSFFYPSVSVSAVMNEWFTLPEQISLLKVRGSLAQVGNDTDPYKTSPYYGTSDFPGSAIVSSTLYNQDFKPEISTNYETGFDFRMFHNRIGLDFTFYYNRTKNQILDAPMDPTTGYSKATINSGCVRNRGYEIQLDVTPVVSRDFRWNATFTWSKNENRILSLAEGADENQLISSIGSVSIIGRVGGTTGDLWGYKLVRDPEGNVVINDNGLPERSGEIEYVGTAYPKWKAGLYNEFSYKNFTLSVLLDGQVGGKMYSHSHHKMTEQGKLQHTLNGRLPGTEFYMSKDDPRIAAAGLSPQDGMYMIAPGTVKNDDGTYSPNTKVVTVESYYKEYYRMVNVETNTFDTSFLKLREMRLEYKLPNSTLKKTPFSKASVALYARNLFCITDYPLFDPESAALNGSSMVTGVETGSLPTARTFGLNINVSF

SEQ ID NO: 19160 - protein, 757 aa, Bacteroides fragilis
MGFRKRAIGVTMVMIGCPSAPLMAQGAVDGGGDIIVTATKRSDTLQNVPLSISAIGAASLEQRSASTFIDYAASIPNLGFGYTGDGAFSARTISLRGISGDNTTGFYLDETPVIDSIDPKIVDVDRVEVLRGPQGTLYGARSMGGTVRMITKQPQLGETAGRIHASLGTTRHTDRPNYAADGAINLPLGDKAALRASAFYQYDAGFFERQFAQGSNGAPGRHDNIGRTKSWGGALSVRLEPTDRLSITPRLLYQKSVANGFPYADATPADLNPRDLVQRRPFDIAEGGSDRWYLASLDAHYDLGSASLISSTSYFNRRVYETEDQTGVISAFFLDPFGAAPLPAAIDQGVPFKRFVQEIRLVSSDEGALSYVLGGYYSWTRDGEYYPPVPTAGLDAATGGALGSDLFFSDAYRNTVREPAVFGEATYKLGHGLSATAGLRWYRITTTNLGFQDGLAAGGRIEDLADAATGGVFPTGRPFRLRQSGVNPKAQLSWKLTPDDMIYATAARGFRPGGVSPAVPPSPALGCAADLAALGTSLSAAKFYKADSLWSYELGAKTSWFGRKLVVNGAAFYIDWKNIQQQILPPCGYQFRANAGAARSKGFEIELQARPLPGLELDAALGYIDARISKAGSISALRKGDRVLQVPDWTSSVSLTYTTAIGDDAHLSTRIGYSYVGESFSANNDPFNPRRRAPYELWDARLAVTWSRYELALFGKNLGDRRANLADNRSISVETPGRARVVVNQPRTIGIEMRSSF

SEQ ID NO: 19161 - protein, 1060 aa, Bacteroides fragilis
MKQVNLRIYRTILTLLLGLFLSAGAYAQQISVKGTVKDQTGEPVIGANVLVKGTTNGVITDVDGNFNVSADKNGVLVISFVGYVTQEVPVAEKQMVIVLKEDTELLDEVVVLGYGANTRKQDLSASVGVVSNTEELAARPVTSTEGMLQGQLAGVTITADGGDPTSSPNIVIRGQGSQDGDNVLWVVDGVPGAPISSMNDIESIVVLKDAASAAIYGAQSGAGGVVLVTTKKAKQGAPSLTYDGTFGIRQATNLIEPLNAEQQIEMRKISHQNAGLSLPVGWDVTKNPWIGTTRTDWMDEIFRTAFYQRHNVALNVGSDNFSNRISFAYDNDEGVLINTFKKNLTLRYNGKMQLNKWVSVSEDFVWQNTTQRSKATDNDAYTGPILSAIYMPASATVYNPLDGSYGGVTTEDPAYIEKYGSNFSDIHGDAVNPVRLLEAENLYDKISDIWSTTSLEIANVLPGLKFTSRFTYNMKTNHYKKFNPIRDEVGKPALSNNLQETTYRRDAWKTENTLTYDKTFGEHTVGALFSTTADHSETRGLEVTGKDFADESEFLQYMAYAGSVTASDYLTGPDANVSLIARLAYSYNDRYFATASWRRDYAGRLPKENNYGDFPAVTLGWKISNEKFFKKSDFISLLKLRASWGRVGNLSSIGLNYKSALLKKSSWTEQAQYGPEANNIWNTLIYNGSALNPDLTWETSEQTDLGLDVEMFKNRLSVSLDYFDKRTFNLIQTQSMGWPSTMGLDAMLINQGEVRNRGFEIQANWSDKINKNLSYFVSGNFSYLKNWVSDIGVKDADGNPGLWPNDKRFRSIPYMMQSTEGEPLNSFYLIKTDGLFQSDAEVAEWNAKHGTYVTNDNGEKEWVGIQPNAKAGDLKFVDHNGDGKITDADRQYMGSATPKTTFAFTLGMTWKKLSFSAMFQGVGGAKALYVGKYMLLSDVEGNFNRSSGILNAWSPTNTGSDIPRLSKNDPNGNFTTASDWYLENASYLRLKNVTLSYDLSDVFRKWSHLNDRNSRLSVYFSGENLATITGYSGMDPECGGWDALKYPVSRVLSVGVKLTY

SEQ ID NO: 19162 - protein, 1031 aa, Bacteroides fragilis
MKNTDKMKNIITFLLVFFTATTVWAEKVIVSGTVVDSNKEPLIGVNVTVKDAPGLGTITDIDGRYRIEIDAYSTLLFSYIGFDTYKVLIKENMKVVNVQMKESSNNVIDEVVITGTGAQKKISVTGAITTVGVKELQTAPGGNLSNALAGNVPGIMAMQTSGQPGQNTSEFWIRGISTFGANTSALVLVDGFERDLDDVNIEDIESFSVLKDASATAIYGSRGANGVVLITTKHGGAGKINIDAKVETSYNTRTITPEFADGITYANMMNEARITRNQEPIYSPGELEILRRGLDPDLYPNVDWMGMLLRDGAMQYRANLNLNGGGSTARYFVSVSYLQENGMYNTDEALRKDYNTNTNAGTWNYRLNTDIDITKTTLLKVGVSGSLRKWNEPGLSKDIWKSLMYQNPISIPVMYSNGYVPAYGTGEQTNPWVLATQTGYKEHWENTVQTNITLEQKLDFITKGLRFVGRFGFDTWNKTNIDRIKWPKQWKAQRQRDEYGNLVFTQVSDEQLMTQSSSSEGNRKEVFEAELHYDRAFNEHHIGGLVKFNYDTQVATVNIGDDIKNGIARRHMGLAGRFSYNWKFRYFADFNFGYNGSENFADGHRFGFFPAFSVAWNVAEEPWIKKIAPWCNMFKLRYSWGKVGNDNFGGTQNRFPYLYTIGDGGSYQWGDYSYDRKYVGLKYTGVASVGATWEVATKHDVGVDLSLFNDKFTATVDYFHEQRDGIWMERKYLPAIIGLSGITPRANVGSVLSEGFDGNFAYRQKIGKVDITVRGNITYSKNTVLEKDEENNVYPYQMEEGYRVDQAKGLIALGLFKDYDDIRNSPKQEFGTVQPGDIKYKDVNGDGVVNDGDRVAIGATTRPNMIYGFGISGTWKGFDLNVHFQGAGKSSFFIGGPTVYAFSSGEWGNVLKDVAESDRWISADISGNPATENPNAEYPRLSFGGNSNNYRASTFWLRDGSYLRLKTLEFGYTLPKQIVNKIMFNNIRVFFRGSNILTFSKFKLWDPELHSSTGTEYPLSRSLTFGLTVNI

SEQ ID NO: 19163 - protein, 476 aa, Bacteroides fragilis
MKLKHLSTAMILATLPATGVFAAALDRSGQSMSAFFQSGNYFEAGISVLDPDVAGKEAGSSATRRDIGDMANDYYFPSAALKLQINDQFSFGLLYDQPFGADAEYSGNNVFVSQPGSDSVLSATAIDGIVTKKAKEALEAKGLPVNDQTLALAKKEVVASQKFQDLSKALTAANGYLGTGGTKVKVDTQNLSFVFGYQPTKNFNFYAGPVLQTVKGNVSLRGQAYSLYNGYDADIKETTGAGWLAGAAYQIPEIALRASVTYRSEIDHKVDINENLSLLNFPGLTSVLAGLDVPASKLQAINSSGKTTITTPQSVNLDFQTGIMADTVAFANVRWVNWKDFSIQPYKFGKVSEAVGGLVGRPNGFNLVEYSDDQWSVNAGVGRKLNDKWAGNVSVGWDSGAGNPVTTLGPTEGYWNVGLGVQYSPTPQTFIAGGVKYFWLGDAKAQTGAQAGSDQYVADFSDNNAIAYGLKLGYKF

SEQ ID NO: 19164 - protein, 912 aa, Bacteroides fragilis
MIRKIAYTFFSFLICCNVSLAWGQTFAFRGTVLDEQTHKALDYATIQLFVEKQFAYGGITDANGHFELLHIHPGTYRIIISYLGYDSTEKEIKVVGNTSDIFYLKPSKMALNEVVVTASESKRATSASIVDRTAMKHLQPSSFSDLMELVPGGKSADPQMGQANLIRIRETGKTEDISSLGVGFYIDGIFQNTDANLQYMPSSTSAVNATSTMSKGVDMRTIPTDNIEKVEIIRGIPSVAYGNVANGAVIIQRKTSESPLSARFKADKTSKLFSVGKGFRLDGNGRYVLNTDLSYLDSKIDPRNSVKNYTRLTASARLDGKWLWNERNIHWNLSTDYTGSFDDAKRDKDATVKEDSYKSDFSSFKMAGKWNLKFSNHSWIREIHAATSVSWQWEKMRETKSVSLNRPAAIATQTETGESDGIYLPYNYVAQMEIDGKPLYVTVSARTHLAFPLGGLQNRMNLGVEWNYQKNLGKGQVFDVTRPISEGLSTRPRRFKDIPGLQPFAFYAEEVLSLPVKRHKLAFTAGIRLQSLLGLDRKYEMQGKIYPDLRLDLQWSLPTSNGWNIAFSGGLGWISRMPTTAQLYPDFKYVDLIQLNYYHNHPDYRRINMMTYKWDNTNYQLEPARNMKWEVRADIGYKGNRLSATYFRERMNNAFDDLTYYKSLAYKLYDPASIDGSALTAPPELSQLTYANEYNLDVYSTQGNGMKVHKEGVEFQFASRRIESLKTRVTVYGAWIKTVYSSDSPKYKASSILLDNKQLKYVGLYQGENGTESQAFNTNFMFDTYIQRLGLTFSTSAQCTWYTNRRNLWNDGVPVSYIDQSGETHLFREEDKNNIQLQHLVEKYSATYFERTTVPFYMDINLKASKRIGKYLNLAFYVNRLLGIYPDYTLRGVLQRRTSESPYFGMEMNLTF

SEQ ID NO: 19165 - protein, 1051 aa, Bacteroides fragilis
MNSKFLLLLCSMLLCTSLAFAQSVKVTGTVTDKMGAVIGATIMVKNSSNGTVTDIDGRYSIEVPKNATLLFSFVGYSTVEKEVGNNTVINVELSDDIQAIDEVVVTAIGIKQQKKKIGYTTQQINSEVLNATPSLNVGSALSGQVAGLLVANPTGIFQAPSFKLRGNAPLVVLDGVPVETDFFDISSENIESVNVLKGTAASALYGSRGKNGAILITSKTAKKEGLEINFSTNNMITAGFAVLPETQHQYGSGSNGKYEFWDGADGGISDGDMTWGPKLNVGTKVAQWNSPIRDKVTGKEIPWWGDVKGTQYDDKSRYERIPIDWVSHDNLKDFLQTGLVTNNNISIAYKGEKARYFVTGQYAYQKGQVPSTEMHSGGINFNSTFDLAKNLQLDANLAYNKIVAPSYPRYGYGPKNHMYTIVVWMGDDVNGKELQKHKYVPGQEGYRQASYNYAWYNNPYFAAEELQQSESRDVVNGQVRLNYQILPNLNIQGRAALRQKTILQEMKVPKTYMNYGDSREGDYKVWNDRQTNVDADVLATYTQDLTPDILFTLNAGTSVFYRNYRQEYQSTDGLIVPFVYSIKNTQGPSITDANRNEKSIRSIYGSINLDLYKYAYLTLTGRNDWSSTLAKGSNSYFYPSVALSTMVSEYIKLPTFMDYLKMYGSWAVVSTDLSPYQIMSTYTKDSNYGSNPSISYPSSLVNYYIKPQKTTSWEAGLSTAFFRNRLSFDLTYYHTIDENQIIDLNISNASGFTSRKVNGNQYTTNGWEIMANVQAIKNKDFQWDFSLNWSKSVKKLTEIYGGQKKFGDLKVGDRADAFYGSQWQKSADGELILDENGMPTKDAYKQYLGHLDPNFRMGMQNTFRYKDFTLSVDLDGAYKGVIYSVLSEKLWWGGKHPESVEYRDAQYAVGHPIYVPNGVVVTGGELKRDIDGNVISDTRTYKRNTTAVDWQQWCQNYPYQAYVSSKENAKFANVFDRSYIKLRRVALTYNFTKLLSKQSPVKGLTATVFGNNLAVWKKVPFVDPDYTGDSNDGGANDPTARYIGMGVNIKF

SEQ ID NO: 19166 - protein, 1125 aa, Bacteroides fragilis
MNKFLFSCQKRCLKYIVMALLLYPLSALAAQGQIVVKGQSLTIPQAIRLIEKSSQYTFFYNANDLKNTTLKSIDCKGSIDDVLNEVFKGSNISYVIKGNEVILKVEKTESTQQKKAKIIGIVTDSKTGEPIIGATVQLLGTTTGVITDVDGKFELAAFPKNEIQISYIGYVTKKVKVGSQKVMSITLAEDAQQLDEVVVTAFGTGQKKETITGSIQSVRPSDLLVPSANLSSSFAGRLSGVIAYQRSGEPGQNSADFFIRGVATMNGATSPLIILDGVEVSKADLNSLDPEVIESFSVLKDATASAMYGTRGANGVLIVKTKSGSDLDRPIIGVRLEGYVNTPTKKPEIVDGPTYMRLYNEAVTNQGTGAVLYSDEKINGTIHNLNPYIYPNVDWYKEVFKDATFNQKANFNVRGGTSKITYFMNVNMNHETGMLKDRSSDFFSYKNNIDYMKYAFQNNVDFHLSKSSTISLHLNVQLNDMHGPLTTKDGNGVGDIFSAIMGTNPVDFPVMFPQGSDTWYHWGGILAGNYQPLNPVALSSAGYKDTFESTVVANVNWDQKLDFITKGLSFRALVSFKNWSYNQKFRLQGYNSYQLSDYKQNEDGSYDFTNTPIGEPSNHTMDAFFGTNGDRRFYIQGYLNYERSFGSHNVSGMLLYNQDDYNTNVNSSLIASLPKRKMGVAARLSYDYDHRYMLEVNAGYNGSESFAKGHRWGLFPSISLGWNISEEKFWKPIKPVISNFKVRGSYGLVGNDQIGSDRFAYLAIVNLTESPSYTTGYGGSTTSLSGPTYNRFQNNELTWEVGNKLNVGVDLQLFNSLNITVDGFREIRDNIFQQKNSIPNYLGTASTKIYGNFAKVKNTGFDLALDYGKQLNRNFSIQMKGTFTYAHNEVLKYDEAAGLRPALSQVGKSLNSIWGYVADGLYIDEADIANNPQSTIGNIAIAPGDVKYVDQPDASGNYDGKITSDDRVVLGYPTIPEIIYGFGPSITWKNWDFSFFFQGQARVSFMMSGFEPFGTQSKNNVLKWISDDHWSKDNQNPNARYPRLTQYNNNNNTASSSYWLRNASFLKLRNAEIGYRFKWARIYVNGSNLLTFSPFKLWDPEMGGGAGMKYPTQRTYNVGIQLTFK

SEQ ID NO: 19167 - protein, 666 aa, Bacteroides fragilis
MPLSFPLRWPAALAWAPLAAAAQAPAPGAPLPEITVTVGKQAENLDAVPASVSVFDGAALESAGVHGLDALSAQVPGFGFQAFGQSGVQPPVMRGLTANFVSFSSSTLLLVDGVPTLMAQGFEHDLQGVERVEVLRGPQSTLYGRNAEAGVVSIVTRQPGDMPRASVSAEAGGHGRRAGSFELGRALVPGRLFIGLSGEWRAQEGFIRHQGTGDRVDDRDRASGRLALRWTPTAGTEATLRYAGQRWDDGAAQWGGIAAPRATVNSGTAGWNRSRGQTLSLDVSHRFAPGLRLRSITARNVFDDRVLQDTDFQPADLLHVGRDYRLATTSQELRLEGESRALRGARWLAGLYVDRDDHDLRYEQKLPAALMRPTARLQGGTAALFTHWTIPLADRWTLAAGARIERNRVELAPAGAAARSDAWSRLSPKLSLQYQWSPQALVYTSVSGGYRAGGFNVFSPAMGYAAYAPETVRAWEIGAKGRLSGQRLRYAASLYTQQVRDMQVQQMGLPGAVYITNAARARSTGADLELDYVFGDGWQLRTALGLNRTRFDRFRDGTALYDGHRNPFAPDANLHAALRYDAPRGWWAQAAVQGTGKVYLDAANHHRLPGYGLVHLSAGYASGPWEIATYLRNAADRRYDAAGYLNGQVVVYSPPREFGLRLTWRL

SEQ ID NO: 19168 - protein, 788 aa, Bacteroides fragilis
MKRCLLYILCCFGVVQLSAQPADNIRNSFVKAETFYKSGDIDEACRILEENLSSFQGTMHTEACRLAALCCLALDRFPEAEKYVSLLLKDEPYYYISLQDPERFADMVRKHRETKVTLVTASQQVETPEEAPVPVTLITEEMIRAIHARCLRDVLIAYVPGISGLSSNEEMNLAMRGVYSPEQENILIMQDGQRLNSYITNAVSPDYGISLAKVKQIEVLRGPASSLYGSVALTAVINIVTKDGVDVRNGSVSVSAGNRGQLAADLLLGKHDMNMDFMAWFSLYRATGESVFVPAEKQYALYPRDGFIRLDNYSGFPAMDGGIKLQRGNLLFSFSMNYAKKRQPYSMWLFSSPYSYERFRTFDGSGPGYSRWSAREQAVYSHTWQRITFSTAFYTDWNKNVHYETSGDTLQDYPIFPNYDYQPIIYPTRGAFQYIRWMDFNVGFNGRVNYAYDWGKLGKGNMLGGVEWNRYTLYDSEYLEGMNFKEIVRTWIEKRLYTGHEMNTDAFLQIKHNLHKNWIVNAGIRYDYKRRSNKRTLQAFSPRLSLIYLRNGLNIKASYSRAFVDAPYYYRNNEMDTYSGGENLQAEYLSSYQVTCAYHHSPSHIDVECNLFYNRASHFLFTQPETRVYENAGSLDMGGVEVVARYKADRLSLDGNLCFQKVLNYTNFFVTDGSVNNVPGFSMNLVANYFLLKKKVQSWSAHLKLNCSSHCYTQVSVLEDGLNGDATNYTVRLPGYAVFSFTTRYKHKRIEGSLGIENLFNNRYECGGATVPIRQKGRWISASILYNF

SEQ ID NO: 19169 - protein, 767 aa, Bacteroides fragilis
MKKYIFFLVSLCCALLPAMADQPEHPELKASDANIIGHVLDKKTGEHLSYITIALKGTTIGTVTDATGHYFLKNLPEGNFVLEASSVGYKTISRNVSLRKGKTLEENFELEEDAVALDGVVVSANRSVTKRRLAPTLVNVVDMKMFENTNSPTLSQGLNFQPGVRVETNCQNCGFQQVRINGLDGPYTQILIDSRPIFSALSGVYGLEQIPANMIERVEVMRGGGSALFGSSAIAGTINIITKEPLRNSGQLAHTLTSIGGSSSFDNNTSLNASLVTDDHRAGLYVFGQNRHRDAYDHDGDGYSEMPKLKNQTVGFRSFLKTSTYSKLTFEYHHLQEFRRGGNLLNRPPHEADIAEQIQHSINGGGLKFDYFAPNEKHRLTVYTSAQHTDRDSYYGSKKDQNAYGKTTDLTFIGGSQYVYSFGKCLFMPADLTAGLEYNRDNLKDDMWGYNRYTKQTVNIGSAFLQNEWKNEKWSILLGGRLDKHNLINHVIFSPRANLRFNPSEDINLRLSYSSGFRAPQAFDEDLHIENVGGTVSMIERAKNLKEEKSQSFSASADMYHRFGAFQVNFLVEGFYTRLSDVFVLENIGERDGILIKERRNGSGAKVLGLSMEGKMAYLSLFQLQAGVTLQQSRYDEPEKWSETAPAEKKIFRTPNTYGYFTATYMPIKPLSLSLSGTYTGSMLVQHMAGYIDKDVAVNTRDFFDMGVKVAYDFKLYKSVDLQLSAGVQNVFNAYQNDFDQGVERDSGYIYGPAAPRSYFAGIKISY

SEQ ID NO: 19170 - protein, 784 aa, Bacteroides fragilis
MKRIILAALGSALLLPSQAQQKNKEYTNFNDSVFSINEVVVATNYRRKTDALKLDVPAKFIPISTNSITSGMLEKRNIRDIQEASRFLPGVRFRTSYGAFTQFSIRGFDNSVIMVDGVRDERSSIDNSYPFMDLSAVESIELLKGPASVLYGQSAVGGVLNIVRKAPVSKQSVYARLAYGSYYNKQATMALGGKLIGPLNYRASVNWQDQEGWRSNATKRLSGYLALGGHLTENDELDIRIGANRDFYPTEIGLPPTMSYDILSATDGSKYLSKGDALPGLNKKARYNSESDFMYNRGFNASAMYKHTFSEAFKLMEKLSYTYDDIDYFGTESLDYLTSDRPIYDHYYMTKDKQGNDTKKYICLDSIYYSYPLRFSHIAKTVNNQLEASGKFYTGDVAHNYLGGYSFVSLMRDSYMAYGNGSTGATGPGTTGHGSVYNPHSIGWMEAPFRFVTAQKTFTHGFYLQDLVEFSDKLKMMLAGRYDLFMYKTANLNTSDGGRHYDKPDDDAYNKITNGAFTFRAGLVYLPIEKLSVYGSYGTYFKPIRAFYDANTIYIDKDGKEFTPVNGKEVFKPEKGFQVEVGARYEITRTLQTNVSLFYINKDNIRQTLANKGDISNGVELDKKVVGQVGRMDSKGFDIDITWSPIYNLSMSAGYGYTDAKVRDLADNPYMPTTSSKGKQYAYIPKNTFYAFGAYTVSKGVLKGLGVNFSTSFQDKVYRNSDNTSSFDAYWLTDLGFSYTLKSNVRLGVNINNLFNKEYCNQALGNQLIPSMPRNFMLSASYTL

SEQ ID NO: 19171 - protein, 784 aa, Bacteroides fragilis
MPSRFRSPLLRPVLLGAIACTALPAPAQPASEAPAIAARQSFAIPAGPLDEALNRFGRQAGLLIAFTPEQTEGRRSPGLQGEYGPREALDRLLATSGLQAVAQGAGFSLRPAEAASAARAPLELGAETVVGDWLGAGDEEDVFNHPGARDVIRREQFERFGASSAREVLNRIPGVYAPENNGTGSHDMALNFGIRGLNPRLASRSTVLMDGIPVPFAPYGQPQLSLAAVSMGNMDAVDVVRGGGAVRYGPQNVGGIVNFVTRAIPEDFSLEGGIQSEVSPSSSQDAWKRTGNLLLGGTGDNGLGGVLLYSGVRGSDYREHSDTRIDDMILKARYQPNGAHSLHGIVQYYDGEAEMPGGLSKADFDDNPYRSSRPLDEFWGRRTLVGLGYDYTGEARKFSVNGFFTRTLRSGYLDQGSFVSLSPRYYWVRGIETRFTQGFALGESWHEVGIGHRFISEASHELRYREAQGNGLPDTGSRNDRDTRGYTHANAFYIDDRIDIGRWTITPGLRLERIRSEQTNKLSGVEYDADYNTSLPALNVLYRLTDSLNLYFNTEESFGSIQYSQMPNRAQTNEIEPEKARTWEIGARYDDGVLKAELGAFLIDFDNQYDSNQTNDSIIARGETRHRGFEGSLAYALSDLHPALAGLDVYATYAYVDATIRESGPNQGNRVPFSSKHKGTFGLGYSRNGLRLDLDGTFQSSQYADNANTVEESLDGSTGRIPGHVIWNARAAYDFGPGAADLKVALGVKNLFDTEYFTRSYDDNNKGKNLGQPRTVYLQTSMGF

SEQ ID NO: 19172 - protein, 356 aa, Bacteroides fragilis
MNLYKYGIIYNGQSGMSIVGIANPDLKWEKNKTWNIGLDLSFIDRISVTFDYYQRKTSDLIYDLPVSQVGGYYDGNYGYTTPQNIGSLKNSGFELTITSTNFRNKDFTWTTSLNMAHNSNKLTKLDGQQNEIVSGPLIHRVGEPYYSYYVYEYAGVDAETGKEMFYLNDGTENARKTTTNISEANKTIVGKHQASIEGGLTNNLKWKFIDLGFTFTYSLGGDAFDYSTWQHSNGGSYLYGGAVPTYYDISKMWTGPGDTNATLPKFEYGSAASLSSRWLMPTDYLRLKNLTLGVSIPQNYISKLGLSKARIYFSGSNLLTWKSKDLFVDPEMRVDGLCTFETPALRTYTFGIELNF

SEQ ID NO: 19173 - protein, 1089 aa, Bacteroides fragilis
MTKKSNLSLRFTRVWEKHCLKTAAATLLLCCVLPVQAKADTYKTQETASIQQQTVKTTGVIIDNTGEPLIGVSVKVQGTNTGTITDLDGKFSIDTPPKALLEFSFIGYKTIIMEVTGKELHITMQEDSKQLDEVVVVGYGSQKKVNVTGSVSMVNADVLESRPVQNVSQALQGVIPGLNMSVGSSGGTLDGKLNVNIRGAGTISDGSSSSPLVLIDGIEGDMNTVNPNDIESVSVLKDAASSSIYGARAAFGVILITTKSGKSGKTRVNYSGNVRFSDAIQLPDMVDSYTFAQYFNRASTNGGESPTFDEKALQNILDFQNGKFTDPSTPEYYGVEAGPDGKWKSYAGSFANTDWFKEFYKSWTPSTEHNLSISGGTEKLTYMISGSFLNQNGLIRHGEDNFNRYTMNAKISAKPAEWVTLNYTSKWTREDYDRPTYMTGAFFHNIARRWPTCAPMDPNGHYMPNMEIIQLEEGGVQTSQRNWYTNQLQAIFEPVKDWRIVVEGSMRTYTRKQHWAVLPIYGYDVNNKPYLLSWNGGAAGYSEVQDEREDEDYFSGNIYSDYAKTIGNHYFKVMGGFNAELFRPSGMTGFGTDLISSNVPSLGLTQDNQKANAWARERAIAGFFGRVNYNYKERYMLEANLRYDGSSRFVGDKRWGLFPSFSAGWNIAREDFFRPLAGVIGTLKLRGSWGQLGNNNTDKANAWYPFYQNMITGSANSGWLIDSKKQNTAQLPGIVNSLMTWETIESWDIGLDFGLLDNRLTGSVGYYNRYTYDMIGPAPILPPVLGALPPQVNNCDMKSYGWELELSWRDRISEFDYSARFVLSDGKRKILRYPNPTNSLSSDVYYNGQILGDIWGYKTVGIAQTQEEMNAHLANGGTPNWGTNWGAGDVMYANLDGKEGVNNGSNTLEDHGDLTIIGNNTPRYNFGLTLTGAWKGFDFSVFLQGVMKRDYWLDGPYFWGANGGLWQSTAFKEHMDYWRPEGDPLGANTNAYYPKPYFNTDKNQKVQSGYLQNAAYCRLKNAQIGYTLPKTWTRKAAMESVRVYVSGDNLVTFSGISGVFDPELLGSDWGDGKLYPLQRTISIGLNVNF

SEQ ID NO: 19174 - protein, 705 aa, Bacteroides fragilis
MKRIYLTFVFAGAVCFQVAAQNADEDRILSADSLITMDGRLDSLYRSLPEVMVVGERPVVKAMQGKLVYDLPRLIQNFAVDNAYDAIKELPGVSEMNDNLTLGGKSVTVVLDGKVTTMTQEQLNTLLKSIPAGRIEKAEVMYSAPARYQVRGAMINICLKQGDFGKSTLQGEFFSDYRQKHYEYLTERASLLYSEHKFSADFLYSYSHGRNYFLTDKEALHALSDGTIHPISTNESQRSRSNRHNLRLAGDYVFAANHQLSVTYNAQFVNGFNLSTVDGTQISNARTRMTDQLHNARLDYHMPFGWKAGVEYTYYHSPSSQLLHSRMGSDELDFRVKDSQRINRWKLFLSGEHDLGNGWGMNYGAVYTTSLDNSHQYYHDPETDEIISGNSNMKSRRREQTLNFYAGFNKAFGDKLSLDASLAAEQFHTTVWNEWSLYPTFNINYAPAPGNVWQLSLSSDKSYPDYWATQDAVSYMGGGYSEIHGNPYLKPEINYQLQLTYVLNSKYMFNAWYSHTKDNATQTLYQSPERLVEIYKYFNFDFEQQAGVQAVVPFAIGRWLKSRFTLTGVYDRQKDSDFWDIPFDRKAYYAMLNMNHTVTLFSHPDIKLIVSGMIRSKAIQGIYDLPASGNLDIALRYGFANGKALLTLRCNDLLETGQISPRIYYAMQNVTNHYSAFREFGVSLTYKFGGYKEKKREGVDTSRFK

SEQ ID NO: 19175 - protein, 1101 aa, Bacteroides fragilis
MKRHVFILLLSFAGVLTSAFAASRQVQGVVISSEDNMPLIGASVYIKAEDLSKDGNSPTITGVITDIDGKFNISVPEGVTRLFCSYVGHEVQELKLVPGKDQYEITLFPSAQMLDAVVVTGYQTVERRKLTAAVGKLNISDETIGAVKSIDQALAGQIAGLSVTSTSGAPGAPAKIRIRGTSSLNGTQDPLWVLDGIPLEGTDVPQSNVLNDVSNIQQSSIAGLNPADIENITVLKDAAATAIYGARAANGVIVITTKKGKVGKPVINFSSKFTYMPTLSTNRLNMLNSQEKVDLELELLRSNFAYGDNKGGVSKIISGYGLTDAYKKGGWSALTPEAQTDISRLRNTETDWGDILFRDAFNQEYSLSLSGGNERVTYYTSIGYYQENGNVKGVGLDRLNIVAKTSYKVNRMLKFGVSLFVNRRNNKTYLTDTYGLVNPVYYSRKANPYYQPFDANGNYVYDFDVQNNSDTDLGFNIFEERKNTSNEETINALSSIFDAELRFNDKLKFTTQLGLQLDKASKEQIADKESFSMRIIRKNSKYWDSASQSNKYFIPDGGVHKAYENTNSQITWKAMGEYRDSFNDIHELEVMVGTELRKTWYETLFSAGYGFDRQTLTTKPVVFPDEDRARQFPLHQKTYKENAYVSFFSTASYSLMNRYTFGGSIRFDGSDLFGVDKKYRYLPLYSVSGLWRLSNEPFMQGTRKWMDNLAFRVSYGIQGNIDKNTSPFLLGKYIVDNILPGGSEHMIDINSAPNKKLRWEKTQSVNVGLDFSVLNQAINLSVDYYYRKGTDLIGKQMLPLETGFVSTNINWASMVNKGVEVSLSTRNVATKNFSWYTNLNFAYNNNKVLREAIPEAQTIPGREGYPVDAIFAIKTAGLDEEGYPLFYDKEGKKVTLKELYRLQDPFGLGFTVNSDVTPAEERSFYSYIGSQDTPYTGGLINTFSYKNWELTANLSFNLGGYVRTTPSYNFINFDRGQNVNSDILDRWTPENTDGRLPALITSEKRADEYYWYDQKSEIYKNLDIWVKKLNYFRLQNLRLGYRLPEKMTKSLGMGSASVAIEGRNLLVFGSSYKNFLDPESMYNPYAPPIPKSITFSLNLNF

SEQ ID NO: 19176 - protein, 347 aa, Bacteroides fragilis
MKRVQVNKTSKLFFLNVLLLSCASANASDVESSFYGSLRLGADYVDSGTSDDAANGRDYLSRIGVKAEVQLADGLTGVGKVEYGLRGDDGVNFNQNQKAGMRQIYVGLKGKFGTVTYGSQTIIWHQYVRSAYFSDGLDSLRQGAIRDDDMLQWQKTYNNWKFGAAIQTEKQDGDSIDQYQVAAQYKNQKLKLQAALAADQQGENTGNLYGFRAWYDISKAFTVSAFYHLAEEDFDLYKGNSSGNVRLVSAEESGKVGGVTACVDEDRSTVGLYGKWRQDNNQVHARYAVNSCDIKGDVSSIKVEYIRYFSKKFRMWASFEQLDNDTTRLPSTGEDMSEAQVGVRFDF

SEQ ID NO: 19177 - protein, 241 aa, Bacteroides fragilis
MKYMKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 19178 - protein, 869 aa, Bacteroides fragilis
MNTSLNKLTKSIRYVIATSTAVAVTAISPVYAQQVKDDSAEVEKIAVVGSRSAPRSVADSPVPIDIIGGDELGKSASTDMLDMLVSTVPSFTARAQPISDAATLIRPVNLRGLSSDSTLVLVNGKRRHRASVIAFQGGGINDGAQGPDISVIPSSALKQVEVLRDGAAAQYGSDAIAGVMNFVLKDDADGGSLSVKRGEYYEGDGATTTVEGNVGLPFTKDGYANLSFQLKNADATSRSVQRPDAANLIAQGNTAVGDPAQIWGNPEINDDISLFGNVGLDLGDDKKFYMFGNYSERDIVGGFYYRNPHNRGQVYSNDEGETLLVGDVAEAAGAERTCATVAIPKVTLADGTVVDGNVLDTAAYQQMAADPNCFSMNQIFPGGYTPAFGGNITDTSLVIGVEGELKNGFLSGAFFDLSGSVGRSESSFNLTNTLNPSLGLDTPTEFDTGKYIQLEKMFNLDLSKQIDVDSIDSLNLAGGLEWREESFEIVAGEEASWKAGDYASQGFNIGSHGFKGFGPEAQGTNTRRSVAAYIDVEAYITEDLLLGAAVRYEDFTTFGDTTNYKLTAQYSVTDELSLRASTSTGFRAPTVGQANVVNTQTSIVGGDLIQSFLAPPTDTLSAFYGGKELSPEDSQSYAIGAVYQSGDFFMSADLYSITVEDRIAQSSKIDVNPDDYEELRTLGVQNPELISAVTYFANDFDTKTQGLDLVANYTHPIFESGDTKFSLAYNWNETEVEKFNPDTTSVGKVKLLEEGIPHHRATFTVSQSWDTVSAFIRVNYFGEYFAVHADDAEPGGWNEDAGSSATVDAEVSYFVTDQITLSAGASNLFDNDAQELPASSFAAVGGQYYESGPFDYNGGFYYVKAKYNF

SEQ ID NO: 19179 - protein, 725 aa, Bacteroides fragilis
MTNRKFSLNLIVLAMSSGYAAHALAAEQAQQLASQNAADEQLVVVGSVMPKSISDIPGTVWFVGQEEIAQQYRAGKTLGDILSATIPSLDVGTGGRTNYGQNLRGRAMLVMIDGVSLQSSRPISRQLDAIDPFNIERIEVLSGATSIYGAGATGGVINIITKKAYSDELAFESFVGGTSGFNSSDDFDYKVAQSVAGGNDIVKARGSVVYSETQGAFDGNGDIVTPDISQGSLQYNSTLDVMGSAEIQISDASKLNLVAQYYDSQQDSPYGLYIVNSKFVDVRKGFDSDREHGTERVLLSANYAHDNVFGHQLIGELSYRSEDQTFTPYYQSSSQQETEVFAGRLALAKSWGAFSAVYGVDAYLDRFDSNQALFDKTIADNSGNLINRTYAEVGRYPGVDVTSYAMFVQGDYHINQDWSVQAGYRYQYMDNKIDDFVAYSVQKNIASGKGVSADAVPGGSTDYSVSLFNVGTIYQLNDESQLWANFSQGFELADPAKYYGQGSYEAVDANGHYALKGSINVADSKMSGIKTDSYEIGYRLDTDTVALQAAGYYSVSDNSIKYDKKTLLITNVDDEQRVYGAEANINYWVSSDILLGASGHYVISELKTNGKWEDLSAGKASTSKANAWAAYYQDDYSVRLQSQTMFDYEDDANNKLDGYTTFDLLGNVNLPVGQLGFGIQNLLDEDYTTAWGQRAQILYAAHYDAAAYDYKGRGRTFTLNYSLEY

SEQ ID NO: 19180 - protein, 689 aa, Bacteroides fragilis
MIKRLFFLLPFSTIVSANEPDTIQVKRIDLDEVTIVAFKQNTPNREPLSISTLDNRFLKENEISGAKDLSSLLPNFYMPDYGSKQNSPVYIRGIGAKKDAPSVGFYVDGIPYFETSAFDIDLSDISSIEVLRGPQGTLYGRNSIGGTINVYTHSPLDYQGTYFRLGYGSYNDMRLIASNYTKVNEQLGLSFSGNYHHNDGFFTNLHTHKKADKLDNGAGRIGLTWKPATHWTTRFITSYEYSNQGGYPYGLYNADKGTTEAVNYNNEGLYRRNLLTSGINIRYNGPHISFNSQTSYQYIQDKMGIDQDFSPRNIFYGQNKIRQHMYCQEFTVKSVNKSRYHWITGAFVFRQTINRKVDLSRFTDTTRHLTNSGIPTQGIAFYHQSTLDLLQGLSCSVGLRYDYEHARCDFSKVQQPLNGNGETKSLEQFNRSLHFGQFTPRFSMQYLSSHNQLFYASVSKGYKAGGFNVSFLNNDDYLYSPEYNWNYEIGTKLSFLNNRLSADLSLFYIDWRNQQITNTIPTVGNVIRNAGRSRNKGIEASFQARPTKSWMMYMNYGYTDARFVHYQKEERGILKDYGGNYLPMVPRHTFSLTTGYSFYDICSWIDRLTLNAGVSVTGPIYWYEDNQAKQSPYALVNLRISINKGCFTWEVWSKNLTNTDYLSYYFVTSKAYAQKGKPITLGTSVSISL

SEQ ID NO: 19181 - protein, 379 aa, Bacteroides fragilis
MKHYIAASVASTLLATTAMASGLDRTGQPIGLIFEEGTYAEFSFATTSVDLSGNDRTSLNPAGSASGDVGERFNMLSGGFKTDINDELSLAIIYDQPWGVDVDYPTTNGSALLGGTMAQADSNAITALLRYKLNDRFSVHGGLRYQEIDGEITLAGAAYNATVPLSGYNVKVDREGGFGWVAGVAYEIPDIALRFALTYQSEIEHDFNLTETTPAGVPVIGGTTLNTTTTTKTPQSVNLDFQSGVAKDTIVFGGIRWAEHSVTDLVVLSALGGRDLIDLDDSITYTIGVGRRFNQNWSASLAYIYEDADGDNLVSPLAPTHGMEAIRLGVQYQTEKMKIGAGVRYTKLGDAVASPGGTPVANFNDNDALSFAVKVGFYF

SEQ ID NO: 19182 - protein, 947 aa, Bacteroides fragilis
MKQVNLRICRTILPLLLGLFLSVGVYAQNITVKGHVKDALGGVIGANVIEKGNPSNGTITDVDGNFTLSVPKGAILQVSFIGYKTQEIEATSSVIVTLKDDSELLNEVVVIGYGVAKKNDLTGSVTAIKPDEKNKGLVVSAQDMIQGKIAGVNVNTTSGAPGEGAQIRIRGGASLNASNNPLIVIDGMPMDNNNTKGVNNPLSLVNPNDIETFTVLKDASATAIYGSRGSNGVIIITTKKGRKNQAPKVSYNGTLSVSTIADKLDVMNAPEYVEFIKNTYGEGSAAYAGLGWQKYNEDGTPDFSAGTYNTDWQDEIYRAGISHDHNVSVTGGVGNESWSMPYRVSVGYTNQEGILKGSDYNRFTAGFTLNPSLLNDHLNFNINAKYSYSKTNPGGTDAIGAAISMDPTRPIMSEDEQFKNWGGYWQWTKNTSEYDPTFPFARNDDAPKNPVELIEHYTFDKSATVLLGNFEADYKIHGFEDLRLHMNLSGEYADGTPKAGTINSSSTKNWRGQIYLVSWYGRVNYSLLDRYLFTFTARYDGSSRFADGQRWGFFPSAAFAWRVKDEAFLKDVDAVSDLKLRLGWGKTGQQDTGKEYYTVIYKVSTSENHRYPVGPNNPGTLYQPLPYNDDLTWETTTTWNLGLDYGMFDQRLTLNLDAYYRETTDLLSTPTIPAGQNFDNALMLNAGSLKNTGVEIALSGKPVQTKDWFVELGMNIAYNKNEITGLYGGRDVIEAGMKVGTDQQITYHKVGLPANSFWVYQQVYDESGRPIMGCYVDRNADGSIDENDRYYYKNIIAPWTGGFNFKVAYKNWDLGTNFRASFGNYVYNGIESGKANSAMLYNSKGYYENSTADIVSLGWSSYNYALTDYFVQNASFLKCDNITLGYNFDNLFKAGKYKGVSGRIYASCSNVFTITKYKGLDPEQTSGKESSLYPRSRTFLLGLNLNF

SEQ ID NO: 19183 - protein, 843 aa, Bacteroides fragilis
MEFPNSRKHINILRRSVLATAVAATVASSVAVAQEESGSGAAALEEVVVTGTKRDISQQDLPIAVSTITAEQLSKTFQNSVTELAQFAPNVTLTPQNGFNAIAGGMRGTGFISILVTKDPSVGITVDDFAFNHVQSQFIEVFDIEQVEIFRGPQGTLFGKNTTAGAIAFTTVKPDVGGEVAGNVEVNFGRYASNDSDLNKFKFALNVPLTDTLAARISVIRDYSDGYYSNTKPMGGTFTCFVCSDGLFPTPGNPSTAEIKSTYPTTGDGSDIGGKDVLAGKLKFRWEPSDWYEADLIFEYLDDQSETVATANETPGNEGYVWPAIGFPGIEAAGVDSPFTTGQSYTQNAIINMSGGHQVEASGIYLNQAFTLGDYQLKSITGMRDQDEILASTYTGEAYTSLYDASRNTKREQFQQEFRLASQFDGPFNWVGGVAAYRDDVEFIVFGNLGFFGPLAATNFYDNRYEVQETTQDRTAWAAYVDGSFDVTEQLTISAGVRYTEDKKDFQRFNLGTADNPVSNIIDLDQYQGPYINPLPESAFGNVQKNSKTFDKVTYRLVADYRFTDEIMAYASFATGFVAGGFSETCGSAFSCSPYDSEENENFEVGLKSDLLDGTLRLNLAAFNTEYENLQRDTVVTIQDAAGNTFQETVSVNEGTSTARGVEAEFQWAVTDNFRLDGMMGYLDHEYDDYRPGINPADLGLPAGDAINPDLSGLRVPFSPELTYALGATFFQDLRNGATLTYNLNMHYQDDAETSPFPANFQGADASGSPIIVQKANTQMEERTLVNGYITYTGPNGGVEVSVYGKNLGNETYRVAANPVATLWNFTRHGAPREYGIQIGYNF

SEQ ID NO: 19184 - protein, 1089 aa, Bacteroides fragilis
MKKTIFLILCILCSLGAMAQKKSITGVITDGAGESIIGASVVEVGTTNGTITDFDGKFSLTIATGAKFTVSYIGYKSQTITVGAENTYNIVLKEDTEVLDEVVITGYGGSQKRATLTTAISKLDNSVLKNAAFSNAGQSLQGSVTGLRVVNKTGQPGSEPDITLRGGATITGDNSKALIVVDGIVRNSMSDINPSDIESIQVLKDAASTAIYGARANGGVILVETKSGKEGKASVNYKFKMGVNFARKGYDFCDAHDYIYYNRLGYKRTGRTNVDTQMGYGIGNNLFDIRYLTDENANLKNEGWASMADPFYDGKTILYKDYSGELDDVVFNNSALTQDHYVNITGGNDKGTFSASLGYYKEDGQIRGTGYERFNGALNGSYKVFPFLTVKANATYSWSTQPELWIGQYEFFYRTRSQRPTWNPWNEDGTPASGFGTGDGNPDYYRDKLTSENSTNKSTYSVGFALDILPKKLVLNGNASLYRYDWQREKFNKSYQAQSSATPDNTRQAEAYVQKYNQIQLNGTLTYTDTFAEKHNLEAMLGTEYFTYDQFDFEAKTQNSPTDDIPTLNAGSTRTYTSTTKTAYRILSGFGRINYNYDMRYLISFVARYDGISKLKDNRWGFFPGVSVGWNIMEERFWKDSKISGVISNLKPRLSYGVNGNVNGIGNFDVYGAYSQVGAKTYGGSTAFYNSGLVNTGLRWEQSQSFEAGLDIGFLNNRLSFIFDYYNRTTKDLLTKQALPGYTGFTEIMTNMGTLRNYGFEMEVRANILNNPKGLTWDVTANLSSVANKIVKLPYNGNPNNRVGGYEVATGRKKADGTDETKWIAGRQEGGKLGELVAYKQNHIFKDWDDVKKYANNRIDEVANLYGPGLAAQYAGKEGWQPIEPGDVCWEDINGDGVINGYDRQVVGNIFPKVTGGFSTTLGYKNLSLYARFDYALGHTIYNDLAARSLGQYQGSFNIIKEVKKTWSETNTDTDLPAFYYADQLSKKNITRSNNGLTAIDNNSSRFYEKGDYLALRELTLNYNLPKTWISKVGMTDASVYVTGQNLFYITGYTGVSPEPAVDTTYGRGIDNGRYPTPRTVLFGLSVTF

SEQ ID NO: 19185 - protein, 1107 aa, Bacteroides fragilis
MKKTIFLILCILCSLGAMAQKKSITGVVTDASGESVIGASVVEVGTTNGVITDIDGKFTLMVDPNGKIKVSFVGYQPQTIDVKGKGSFNIQLKEDSEMLEEVVVTGYGGKQLRTKVTNSIAKVKEETLKQGMFTNPAQALSGAVAGLSVSQTSGNPGSAPTLVLRGGTNFDGSGSPLILIDGQVRSSLSDINPDDIESMEVLKDAGATAIYGARANDGVVLVTTKRGKSGRAEVNLKAKFGLNYFKDSYNFMNAGDYLYWMRTGYMNAYVGDMKHPDGAGIKGWSSLSGLTTATPYGTGNLYFDKDGVTPLDGNKTSSAIWSPMLYSDNLSFLLDQGWQTMIDPIYGDKIIYKNTNIADFNINTPSFSQDYNLSVSGGNDKGNYYAGLGYNKSEGTAVGNWYQRITFTFNADYKLKEWLTSNSSFNFADATWNGLPASQTAEANYFSRCLSLPPTFRGYNADGDMLLGPNSGDGNQQYNFKQFVRDNNTDKFTMNQSFTIDFMKGLSLKLGAIWYYSEEKTEAFNKDYLSSPGNLITSHSTSASYARTLDQTYNAVLNYNYQINKDNFLDAMVGFEYYDSYSKGFSASGSGAPTDDFMDLEYTSKEEGKRSIDSSHSRQRIMSFFGRVNYDYQSKYLLSLVLRRDGYSKLAEENRWGVFPGVSAGWVFSKEEFMKNTASILSFGKLRASFGLNGNVNKNFVGNYTVQGAYGSNRYNGSTGFLLSNIPNPYLMWEKSRTFEVGLDMGFLENRINANLTYYNRLTSDKYANITVPSTSGVSSVTSNNGEFQNQGFEFELGFRIIDAKDWKWNLNWNGALNKNKVVSLPDNGLERNRQSAYQVYTGNGDEKKWVGGYQEGQRPGDLYMFVAEGLYKSQDEIPANLIDLTTGNNGSSGRPLYGGAEGYNKLTDSQKSNALPIQPGDVKWKDVNNDGVIDNYDMVKVGNTVPKWTGGINTTVSWKDLTLSARFDYALGFTAVDWKTMWIMSCAQGTYNTIEETKNTWTPENPNAKYPTYVWADQLGKRNYCRSSSMFAYNGNYIALRELSLSYKLPSILVQKAKLSNVELSITGQNLGYLTEAKHLFSPEKADNNGGYPLPRTVIFGINVSF

SEQ ID NO: 19186 - protein, 1083 aa, Bacteroides fragilis
MKKTIFLILCILCSLGAMAQKKSITGVVMDASGESIIGASVVEVGTTNGVITDISGKFTLMVDPNGKIKVSYIGYQPQVLDVKGRNSFNIKLKEDSEMLDEVVVTGYGGKQLRTKVTNSISKVSEESLKVGVFSNPAQALSGAVSGLKVTQSSGNPGSTPTIVLRGGTEWDGSGSPLVMVDGQLRDGLNDINPEDIESMEVLKDAGATALYGARASNGVILITTKTGKVGKAEINLKAKVGMNYINNPYDFLGAKDFITAIRTAYDTTPWASKSSLDGASAYGTGNKYGSDLVWNLLVKDSGNEFLLNKGWQQMQDPLNSSVTLLYKDIKPSDYNLNNPSLTQDYNVNMSGGNDKGTYYAGLGYNKSEGLPISSFYERYSFIFNGSYKLADWITASSNFNYNRANWRSMPGSQDNEGNYFGRIMSLPPTVRYEDEDGNPVLGPNHSDGNQSYQPEKWLVDNQTDKFTMIQSLEIRPMKNLVIKGTANWYYSEGVYESFTKDFETAPGKFNTTRSSSAKFERDFSQTYNVVLNYNNTFAQNHNIDVMLGSEYYDKKTKGFSASGSGAPTDDFADLNLTDNGEGKRTIDSWHSQYRILSYFGRLNYDYQGKYLLSGVFRYDGYSSLLGDNRWGFFPGVSAGWIFGKEDFIKNAVPDLSFGKLRFSYGMNGNATGIGAYTLQGSYNSQKYNGNVGYLIGSLPNPGLKWEKTRTTEVGLDLSFFDNRLNANFTYYNRLTMDKYADLSLPTTTGFSSVKNNNGDFRNSGVEMELSGTILKIKDWTWKMGGNISYNKNKVVTLPDNGQPKNRIGGQQIYTGRKVLDEAGNQVDEVIFVGGKQEGQEPGILVGYKAEGLYKDWKDIPGDLVVKTGNYQGKYQYGPKAYAALSDAEKAKALQIEPGDVKWKDINNDGTIDAFDQIVIGNTTPHWFGGFNTTLTWKGLTLYGRFDFALDYWIYDNTTPWFLGCMQGGYNTTTDVFNTWSEENPNAKYPRYVWADQLGTANYYRTSTMFAYKGNYLAIREISLSYSLPQNIARKFYCQKLDVSVTGQNLGYITSANVATPEVSSAGSGYALPRTLLFGINVTF

SEQ ID NO: 19187 - protein, 1107 aa, Bacteroides fragilis
MKKTIFLILCILCSLGAMAQKKSITGVVTDASGESVIGASVVEVGTTNGVITDIDGKFTLMVDPNGKIKVSFVGYQPQTIDVKGKGSFNIQLKEDSEMLEEVVVTGYGGKQLRTKVTNSIAKVKEETLKQGMFTNPAQALSGAVAGLSVSQTSGNPGSAPTLVLRGGTNFDGSGSPLILIDGQVRSSLSDINPDDIESMEVLKDAGATAIYGARANDGVVLVTTKRGKSGRAEVNLKAKFGLNYFKDSYNFMNAGDYLYWMRTGYMNAYVGDMKHPDGSGIKGWSSLSGLTTATPYGTGNLYFDKDGVTPLDGNKTSSAIWSPMLYSDNLSFLLDQGWQTMIDPIYGDKIIYKNTNIADFNINTPSFSQDYNLSVSGGNDKGNYYAGLGYNKSEGTAVGNWYQRITFTFNADYKLKEWLTSNSSFNFADATWNGLPASQTAEANYFSRCLSLPPTFRGYNADGDMLLGPNSGDGNQQYNFKQFVRDNNTDKFTMNQSFTIDFMKGLSLKLGAIWYYSEEKTEAFNKDYLSSPGNLITSHSTSASYARTLDQTYNAVLNYNYQINKDNFLDAMVGFEYYDSYSKGFSASGSGAPTDDFMDLEYTSKEEGKRSIDSSHSRQRIMSFFGRVNYDYQSKYLLSLVLRRDGYSKLAEENRWGVFPGVSAGWVFSKEEFMKNTASILSFGKLRASFGLNGNVNKNFVGNYTVQGAYGSNRYNGSTGFLLSSIPNPYLMWEKSRTFEVGLDMGFLENRINANLTYYNRLTSDKYANITVPSTSGVSSVTSNNGEFQNQGFEFELGFRIIDAKDWKWNLNWNGALNKNKVVSLPDNGLERNRQSAYQVYTGNGDEKKWVGGYQEGQRPGDLYMFVAEGLYKSQDEIPANLIDLTTGNNGSSGRPLYGGAEGYNKLTDSQKSNALPIQPGDVKWKDVNNDGVIDNYDMVKVGNTVPKWTGGINTTVSWKDLTLSARFDYALGFTAVDWKTMWIMSCAQGTYNTIEETKNTWTPENPNAKYPTYVWADQLGKRNYCRSSSMFAYNGNYIALRELSLSYKLPSILVQKAKLSNVELSITGQNLGYLTEAKHLFSPEKADNNGGYPLPRTVIFGINVSF

SEQ ID NO: 19188 - protein, 1089 aa, Bacteroides fragilis
MKKTIFLILCILCSLGAMAQKKSITGVITDGAGESIIGASVVEVGTTNGTITDFDGKFSLTIATGAKFTVSYIGYKSQTITVGAENTYNIVLKEDTEVLDEVVITGYGGSQKRATLTTAISKLDNSVLKNAAFSNAGQSLQGSVTGLRVVNKTGQPGSEPDITLRGGATITGDNSKALIVVDGIVRNSMSDINPSDIESIQVLKDAASTAIYGARANGGVILVETKSGKEGKASVNYKFKMGVNFARKGYDFCDAHDYIYYNRLGYKRTGRTNVDTQMGYGIGNNLFDIRYLTDENANLKNEGWASMADPFYDGKTILYKDYSGELDDVVFNNSALTQDHYVNITGGNDKGTFSASLGYYKEDGQIRGTGYERFNGALNGSYKVFPFLTVKANATYSWSTQPELWIGQYEFFYRTRSQRPTWNPWNEDGTPASGFGTGDGNPDYYRDKLTSENSTNKSTYSVGFALDILPKKLVLNGNASLYRYDWQREKFNKSYQAQSSATPDNTRQAEAYVQKYNQIQLNGTLTYTDTFAEKHNLEAMLGTEYFTYDQFDFEAKTQNSPTDDIPTLNAGSTRTYTSTTKTAYRILSGFGRINYNYDMRYLISFVARYDGISKLKDNRWGFFPGVSVGWNIMEERFWKDSKISGVISNLKPRLSYGVNGNVNGIGNFDVYGAYSQVGAKTYGGSTAFYNSGLVNTGLRWEQSQSFEAGLDIGFLNNRLSFILDYYNRTTKDLLTKQALPGYTGFTEIMTNMGTLRNYGFEMEVRANILNNPKGLTWDVTANLSSVANKIVKLPYNGNPNNRVGGYEVATGRKKADGTDETKWIAGRQEGGKLGELVAYKQNHIFKDWDDVKKYANNRIDEVANLYGPGLAAQYAGKEGWQPIEPGDVCWEDINGDGVINGYDRQVVGNIFPKVTGGFSTTLGYKNLSLYARFDYALGHTIYNDLAARSLGQYQGSFNIIKEVKKTWSETNTDTDLPAFYYADQLSKKNITRSNNGLTAIDNNSSRFYEKGDYLALRELTLNYNLPKTWISKVGMTDASVYVTGQNLFYITGYTGVSPEPAVDTTYGRGIDNGRYPTPRTVLFGLSVTF

SEQ ID NO: 19189 - protein, 1042 aa, Bacteroides fragilis
MKTNLRLLFTLLFVVSVVALRAGTMNDIRVSGTVVSEGDPLPGVSVLVKGTGVGTITGIDGKYSINVPSDGTLVFSFIGLKSVEHKVGGRSVINVELVPDSKQLEEVMVVAYATAKKYSFTGAASTVKGDEIAKLQTSSVSRALEGTVAGLQASAASGQPGTDATIRIRGIGSINASSAPLYVVDGVPYDGSVNSINPEDIASMTVLKDAASAALYGSRGANGVIIITTKQGQSDSKTTVNVKASFGGSNRAVRDYDRIGTDQYFELYWEALRNQYALDTKNYTPQTAAIKASKDLVGKLMGAGPNPYGSKYPQPVGTDGKLADGAVPLWNFDWQDAMEQQALRTELGLNVSGGGKTNQYYFSAGYLNDKGIALESGYERFNLRSNVTSQMTKWLRGGVNMSFAHSLQNYPVSSDTKTSNVINAGRLMNGFYPIYQMNEDGTYKLDSEGQRMYDFGSYRPSGSMANWNLPATLPNDKSERMKDEFSGRTFLEVTFIEGLKFKTSFNFDLINYNSLDYTNPKIGPAVNTGGSSSRENDRTFSWTWNNILTYDKTLGEHHFNLLAGQEAYSYRYDVLRASRSNMALPDFPELAVGSLVTGGTGYRVDYSLVGYFLNAQYDYQSKYFFSGSYRRDGSSRFAPETRWGNFWSVGASWRIDREDFMVAASDWLSALTLKVSYGAQGNDNLGTYYASSGLYSVVSNNGENALVSDRLATPKLKWETNLNFNAGIDFSLFNNRFSGSFDFFQRRSKDLLYSRPLAPSLGYNSVDENVGELKNTGVEIDLKGTLIHTRDFMWRLGLNLTHYKNVVTDLPLKDMPVSGVHKLAVGRSVYDFYMKKWAGVDPENGDPLWYKNVKDANNKITGRTTTNDYAQADYYYTGKSSLPKVYGGFNTAFSYKGFELSTIFAYSIGNYIVDRDVTMLWHNGSSTGRAWSTEILNRWTPENRYTDVPALKTVSNSWNANSTRNLFNNSFLRMKNITLSYNFPQPMIKKISLNSLQLFVQADNLLTVSKNQGLDPEQDISGLTYYRYPAMRSISGGINVSF

SEQ ID NO: 19190 - protein, 793 aa, Bacteroides fragilis
MNILPIAKSIIAMSVASALLVNNVAAEELNESTVDTKDVEVIEVRGGQRVKTLREVPASVSVISGESLSQMKINKLDDLSQSLPNVSISENAVQDTISIRGVNSDLQAGGEQSVGIFLDGVYHGRGVQSRFSFMDVDAIEVLRGPQGSLFGKNTVGGVISILPAQPKDYFEAKLTAAYEFEYEKVDYSGYVTGALNESGSLTGRFAFKGSNSEEGWVENEANGETMPTKEDSALRGILNWQVNDDFKVNLRAENGTFETKGAPYEILYLEDSQPITGLARMFGAEANIDGKTNISNGNYPGLGFNGEETPYFMDANFSEYALKSYYKIDQGTISATIAQSNLDFVRSQDADFGPLPVIQFSESEDYQQNSVELRFVSEDNDDFEYLFGVFWQNSDLLVDAVADFATAPGTPVAGAFPIPIEHAVTSRFNELEQETDSLALFGQVTFGLTESLKLELSGRYSKEEKTGRQTVEVYGGTGDGSKSGLPLTNPTELFIWSQAIMEAFPHSVPVSREENLFSPSASLTWLASDSASFYVSVSKGFKGGGFNAIAMSPDLDEIEYENEEAISSEIGGKFEFFDGTVLLNTAIFNVAYDNMQTTLFTGGTTFVVENAAKATSRGLEAELRWLINDEFTLDANLGYIDFEFDDYKNAGCTAQQVIDSGLTGSACAAAGLNDLSGKTNQDVPEITLSLSLQHEFAINEYVVTSRIDSNYVDDFFATADLDPITVQEAYIVWNAAVSIASSDGLWKTDLIFKNITDESYFYYANDVPLFAGSQFASFSQPSTVTLQFSYLFE

SEQ ID NO: 19191 - protein, 1117 aa, Bacteroides fragilis
MKNNTLSGRYCFKNPRFKQIFRIMRISTFLLMVCVFCSYAGNAHSQNAKVSIRMNNVKLDKILNEIENQTDYLFIYNNQVDINKITSVKVKNEAVAQVLDRILSGTGINYELEGTHIILTTEAIKDLHAQQQAKTVTGTVTDVSGEPIIGANIRIKGTTTGTITDIDGNFSIKAEPQSVIEVSYIGYLTQETVINNQKSIRFLLKEDTKTLDEVVVIGYGVQKKADLTGSVANINTEKLNTQSNANIGQALQGKIAGVDIVSQGGAPGSGTRIMVRGIGTLNNASPLYIVDGMYMNSIDHINPNDIASIDVLKDASSAAIYGSRAANGVIIVTTKEGSNTEGKPIIDLSVNLGISTASKFLDMLDAKGWAEVTTIARQAIGKPALDMATDLANKPDNDWQDIMFRPALMQNYNLSVKGGGKYSTYYTGLGYFNQDGIVKGTNYQRYNIQSKNDYKRGIFSAGTNLIISFSHDKPLHQELRGGMIGTILQSVPTLEKYDDTREGGYGGTYGDVVNIPHPLAIIDDNIMDRYNENVKIFANLYAQIELFKGLKYKLNLTPDFSFERYKNYLNKYDFGLATNSITQLTERQRRRRNILVENLLTFDRTFGEHKISALAGYTYQDSRFRHIQAYGEGLPQGLEEIDAATTNRSNEGNSWRSVLTSILGRVFYSYQNKYLFTATIRRDGSSKFGKNNRYGYFPSFSLGWNVAEEKFMENVHWLDQLKLRGGYGVLGNQEIDNYQYSSTITTGINYPDGNGGLLQGAFPKNFANPDIKWEETAMTNVGIDFMAFNNRLSLTADYYVKNTKDILLTVPIPISSGGANDPIRNAGKIRNNGFEFNLGWMDQPNPDISYGINLIGSFNKNKVIAMGSESGSIKGGSTNQNITTSETKAGYPIGGYWLISTAGYFNSQEEVDAYAKDGKKIQPAAEPGDIKFVDANNDGVINDDDRVFQGSPFPDFTFALNGNMRYKNFDLSIGLQGVLGNKIYNATRQTLEDVTKGSNFLASCLDYWTPENKNASHPRLTWDDPNRNTRAESDRYLENGSYLRLRSVQLGYTFPQTWFKGAIQHARVYINAENLFTITSYSGYSPDVNADNANYRGFDNFIYPTNRTFMLGLNVTF

SEQ ID NO: 19192 - protein, 1035 aa, Bacteroides fragilis
MKKNTIVRHCFSRKYISLCIFLLLGIIGEKAFAYSVWETYANETEGIYFSLQESIKITGVVKDNKGEPIIGANIVELNKKGNGTITDIDGKFTLSVSKNAEISISFIGFDEKKIKIGQQTSFDIILEESSQFLDEVVVVGMNNRQTRRSVTGAISTIQTKELKQSPVANLSNALAGKLPGLITVQTSGQPGEDASSLFIRGVGTYGTSNPLVVIDGLPRSQTDFNQLDANEIESVTILKDASSSSLYGIQGANGVIVVTTKRGVDREKPLISFTVQQAVQQPIRLPETMSSYEQALYYRDMDMNDGQTERYTPEVLDIIKNGSDPYLYPNVNWFDEILKKNSMQSQYNINISGSALGKLRYFISGSYVNQGTLLKHQDIFEKNYGVKSKFDRYNFRSNVDLDATSMLNIRIDLAGRLETRVGPGSDFSNVFSVITTRSPSSQPVFNPDGTLGAGSALEIPFQQNPYGIVTQSGYYTRHTNVMSGTLSAKHKLDFITKGLSAQVYFSFESNNYQHTTRLQSFDSFWYKGKDATGEAIYQPHSVKSRLSTTDSRWVERYTYLDVRLNYDRTFAEKHQISAQLLGNRTLRSQNAELPYAYQGISSRIAYNFDTRYYLEANIGYNGSENFPPKKRYGFFPSFSAGWVLSDEKFISLPSWIQLIKLRGSYGTVGNDKIGGQRWLYITEFTPGGTAMGTYQFGVSPQSVAGYNESRVGNKFVTWEKSAKGNVGFDLSLFKDNAVQFTFDYFWEKRNNILTTPGDVPDYVGITNVAPRNSGKVENKGIEAELRFNKRINKDLSIFANLQMTYARNKVLENDEPIPAFDYQDLRGYEIGYVLGYKSAGLFQDEEDIRNSPTQSFGTVVPGDIKYVDTNKDGVIDAFDRVPIKVNNVPRSMSGLSLGVTYKNFDFSMLMNASTGGTAYLYTYPSSKINLERWTAENKNARIPAAHSTTNNTVVTDHFVQNTDYIKLRNVEIGYTLPKKFLSSLRISTARIYLNGQNLAVWDKMWLKDRDPESAGGAALAYPLQRVFNIGIHVEL

SEQ ID NO: 19193 - protein, 841 aa, Bacteroides fragilis
MMKTTSVKSKKHFSIKKHKLKIFFLCSSLCPSLWCSAALANNALEKEQYSEKKIDKSDIQENKNDRPSMIGQTAPTDEKSIVVTGRHSYIDGVNRRAIGGGLMIKEDAPKSKSTITRDYIEKQTPGLNPMQLIALLPGVNSSDSDPMGLTGGHTSVRGMNEASMGYTLEGFPLNDIGNYAVYPQEIVDSENLSTIQVAQGSADLDSPTISAAGGVVNMYMIDPAKKMGGRANFTYGSYKTFRGFARFDTGEIGNSGTRAYFSFSDTHENLWRGPGTERKLHGEMKVVKEWGKDNRASLVVVGNNLNNYNTPSVNMASWDKYGIGVMGGPVSGTANTVYSSDYTGNTKANATYYRLHPNPFTNIYISAPTRLNLGHNMVLTETPYFWYGNGNGGGAYWTDMNKMSYGSQTMSGTVDGKNYGQTLLYEPSITKTYRPGAVTKWTWTKGINRLMVGYWFEYSNQRQTAPYSLIDENGNPYDKWGGGSNVILANGEKAEYRDTRTRTVIHTPFIGDSISLLNNKLTIDAGVKYSIIKRMGRNYLPDTSTGEVINQTYRAVLPTGSIRYKINDEHQLFFSVSTNYRVPMNSSLYDSGTYYAGSGYSNHAATGLKPETTISEEFGWRYQGKVINTSLTYFHYDFHNRLFSQTIIDPENPTSYYSTSINGGNQTTNGVDFEIGTRPIYNIRPYVSAEYIDARTKSNLMASGSGVSALLPTKGKFAPQTPRYQVGFGLDYDNGHIFGNFSLKYVGSQYSTFMNDEQVPSYVRMNIGGGYRFNSWGGLKSPTIRFNLANVTNKHYLNYASGVTTNAQYVKALNGQMVKGSAPTYGIASPFSAMMTLSTGF

SEQ ID NO: 19194 - protein, 1061 aa, Bacteroides fragilis
MKLRYSIAASLMAISAATVVAAPVQAQETSSSVRGTVESASGPVSGASVTITHVPSGTVARSTTDASGNFSANGLRVGGPFTVEVTAEDYESAQVTDLFLQAGQPYRLPIVLEDAAIVVTASSVGGALEQSNGPITALGREAIEGVASINRDIRDLARRDPLVTMDLTNARTIEVAGNNGRLNRFSVDGVQFSDDFGLNNGGLPTSRGPVPFDAIEQFSVKVAPFDIAEGDFQGGAINVVLRSGGNKFHGGAFFTYTDDSLTGNRTRGRDISLDFDSKQYGANISGPIIKDKLFFMFAYEKTKETDPFDDGFGPGFANQVPGLTQAVIDQVSSVAQSRYGYDTLGLSPNAVEEDEKIIGKLDWNISDTQRASLTYIRNVGTQQFQQNTFLTSPFALGFQSNGYELAEEVNTGIFELNSTWSDQFSTTFRASYRDYNRDQTPFGGRDFPQMEVCTDATSAGSATSCNGTRLFFGPDVSRHSNDLNTENLSFDFTARLDAGDHSLRFMAGYTDVSVFNLFLQRSLGDFYFDSLADFAAGNANRLRYANAVPSLDPNDAAASFGTQNYTFGIQDDWQATPDLTLSFGIRYDLFGNDAKPPLNPNFLARYGFHNRETFNGRDVIQPRFGFNWQATDKLIVRGGVGIFSGGTPDVFLSNSFSNTGLLTNLVDINRSNCAASATCDALNGIDDGTIPASVNDFLARNTGSLALAPTDNIDPKLKIARKWKASLQADYEIGDGWFVGGQFLYDKNIYGYTWTDLRSVPIGTLPDGRTRYGPFGGVATTNRDLQLTNSERGRAFFATARFSKAFDFGLTLDGSYTYSNVKDEGALTSSTASSNYGNNAFVDPNRAAYGRSIYEYTHQWKGGIDFKREFFGDNETRISLFGEYRSGRPYSVTMLDNSGGRGAVFGTVGNLGNMLLYVPTAGGDPRVTFDSAASEAAFNTLISELGLEKYRGRIVKKNSQTSPDFFKVDLHVSQEIPAFVGDAKFKLFADVENVLNLIDSDWGSLRQVSFPYNAAIVRVACAATSGTNCTQYQYSNVRAPNQVLTSRVSLYGVRVGVRVNF

SEQ ID NO: 19195 - protein, 821 aa, Bacteroides fragilis
MKEKTIKLSVIALAVSAVCSASPVLAQQQQAEEVPENIERIVTLGSRVNGRTATESASPVDIISSEQLAETGASELGKAIQMSAPSFNFSSTTISDGSDIIRPATLRGLGPDQVLVLVNGKRRHQQALVNVQETIGKGSAGYDINAIPITAVERVEILRDGAAAQYGSDAIAGVINITLKSGDGGSVSAEIGQTYEGDGEVNQVGLNLGTTNDKGYFNFTLEYRDRGMTNRAAPATLEATGGQLIGDWWDRNGDPVVRLHVGDADSENYYAWFNSAYTLTGSTELYAFGGISSRDGGSAGFFRGRGHPRTIETIYPDGFLPQLKTEADDQSIAVGLRGDLPNAWLWDASIVYGKNEFGFNSANSANVSWYYEPAPGGGIYADTPTEAFDGELVFDQTTFNLDFNGTIDVNNELLYLALGVEFRTDGYEINAGDPVSWAYGRSNDPSITILTPSGAPAEAGIQGFPGFSPGQEVDASRDSYGAYVDAEYYVTPDWLLAGALRYEDYDIAGDNISGKISTRYDITNDFSVRGTLATGFRAPGVQQIYYSQVLTNIVNGTLVQTGTVSNDDEVARQFGINRLEEETSESASIGIIKRWRNGLDLTIDLYQINIDDRIVISEPLTADIGTEFATILDNNNLGAAQFFTNSVDTKTQGVDIIASYPTEVLSGDLVLTTALSFVNTDVERVNSVSSLIPAEQIFNETQVLRIEEGQPSEKASIMADWERDRWSVNLAFNYFGAVEGQAFTGIKHKWDGKWLTDLSVGYDLTDDFKLVVGANNLFDTYPDEWGSAGVPFSQAGFKYGWETLPFGINGGYYYVKAKYSF

SEQ ID NO: 19196 - protein, 629 aa, Bacteroides fragilis
MRKAPLLRFTLATLALACSQAFAAPSPYSTMIVFGDSLSDAGQFPDLTGGTAGMRFTNRDENGNFAPVSPMILGARLGVNPDELNPSTSFGIRPDGNNWAVGGYTTQQILDSITTTSETVIPPGQPFAGLVLRDKPGYLANGLRADPNALYYLTGGGNDFLQGLVSSPADAAAAGSRLAASAQALQQGGARYIMVWLLPDLGQTPNFSGTPQQNALSQLSSVFNQSLVSQLGQIDAEIIPLNIPVLLNEALASPTQFGLASGQNLVGTCYSGNSCVENPLYGINGTTPDPTKLLFNDSVHPTIAGQQLIADYGYSILSAPWELTLLPEMAHASLRAHQDELRNQWQAPWQAAGQWQAFVATGAQDLDLDGGRTSADADGRGYNLTLGGSYRLNDTWRVGLAGGIYRQKLEAGEQDSDYKLDSYLASAFAQFRKDRWWADAALSAGHLDYQDLKRTFALGVNDRSEKGDTDGEAWAVTGRLGYNLAADSSRWQLAPFISADYARVKVDGYDEKSGRSTALGFDDQERTSRRLGLGLQGSVQVLANTRLFAEVAQEHEFEDDQQDVTMHLTTLPANDFTLTGYTPQSNLTRASLGLSHELAAGVQLRGNYNWRKSDELTQQGISLGVSVDF

SEQ ID NO: 19197 - protein, 1103 aa, Bacteroides fragilis
MKKCNQKWFNPQKVKKQIAIAVAISLVCAIPISTFAQVLKFSIKKSNTSIQSVLQELEKESGYTFFYNDNQVKLDKKISINIEDASIEVVLNQIFENSGYSYRIVENQIVIYTTPTTTVQQTVQQKKQQKVTGVVKDIAGDPIIGASIIEKGSSSNGTITNVNGDFSLIVTGNELQVSYIGYIPQTINLKPGVSSYNVIMKEDTKTLDEVVVVGYSTQKKESLTGALQTVKSDKLKDITTPSVENMLNGKVPGVYVAPGSGQPGSGGAVVIRGQATLSGTTAPLWVIDGVIVGSNAGALNPSDIETMTILKDAASTAIYGSQGANGVILVTTKNGKAEKMTVNVSAKVGISKLGRGNMEMMDGAELYDYYKSFSNQEAITFSRYNDKLRNCNFDWFDLAAQTGVTQDYNVSLSGGNEKIRSFLSIGVYDEEGAVKGYDYTRYNFRLKTTYKPFEWLSIKPALAGSRRDIEDKQYDVTSMFQRLPWDSPFDEEGNLVPNRYTGWVNSSNSNYLYDLQWNKSNSTNYEFMGNLDFDIRITDWLSFSSVNNYKYIGYNYSEYTDPRSSSGEGVDGRMREYQTTTVRRYSNHIIRFNKMFGKHSINALAAYEFNDYWAKATDMYGIGFIPGFEVLDVVAKPEKVGGSISEWAVQSLLFNANYAFDNKYLAQLSFRRDGASNFGDNAKYGNFFSISAGWNINREKWFHASWVDILKLRISYGSVGNRPSSLYPQYDLYSVSSKYNEESGALISQLGNKDLTWEKTYTTGTGIDVAFFDNRLRASFDWYNKYTSNILYAVPISGLVGVTSMWKNIGEMQNQGFELSIGGDIIRTKDWDWNIEINLGHNKNKLKKLYKTKNAEGQFVEKPIIISDGTSIAGTAKRVLQPGYPCDTYYLKEWAGVNPENGAPQWYKTVENEDGTLSRQKTSNYSEADQVKCGSSSPDIFGGFSTVLRWKDIDLNAVFGYSVGGQIYNYSRQEYDSDGAYNDRNQMKLQKGWNRWEKPGDIATHPVASYSNTSKSNSSSSRYLEKNDYLKLRSLSIGYNLKLPQYYINNMRIFFTGENLFCVTNYSGVDPEIPASDGSVIGTALPSVYPTVRKFMFGLNLTF

SEQ ID NO: 19198 - protein, 1127 aa, Bacteroides fragilis
MRKCNMRWFSPQRMKKHLAFALAVSLVAMVPVSAFAQVLKISMTKTNVSIENVLRELEKQSDYTFFYNDNQVKLNKKVSINVSDAPIETVLDEVFKNSGYTYKIVDNQIVVSTAAAAAKEVQATQQQKQRKISGVVKDAMGEAIIGASVIEKGNPTNGTITNIDGEFTLNTAGKELQVTYIGYIPQAIVLKPGVNSYTVTMKEDTKTLDEVVVVGYGTQKKVNLTGAVSSVGADELKERVNTDVLASVQGQVPGVTIISRPGSTPSINMRGRGNLGTSSPLFVIDGAIADASFFSSLDPNSIESISFLKDAASSAIYGSRAAYGVVLVKTKGGKEGDLKISYDGSVAVKMATYTPDVLGSEWYARLSNEAALNENPNTSTLPYTDKEIQMFRDGSNPDMYPNTNWYDLVLKDEAVMTKHSVSFSGGNKVKYFTSLGYMYDDKFTPGAKSERYNLTTNISSDIKSWLTMRSNINYIQSTSDNDKGGVVYTHLLTIPSTYVARQSNGEWGSYEGGKPAATVNMERNPLRRLEEGGWSNSKTQNTLINLALDIKPVKGLVLTGEMIYKAWDYKSKTYTANKSKIKDFQTGTELNGTDVTNSKMEYSWEENSRLTYNALANYVWSNEKHNVNVLAGVSYEHYKYQKQKSYRLKFPTNGMTDMNGGSSAPDDTYAEGGSNEDKLMSYFGRVNYSFMDRYLLEANIRADASSRFHKDNRWGVFPSFSAGWRISQEGFMQDINWINNLKLRASWGQLGNINNVGQYDYFSSYQQGGNYNFEDAIVSGIVESKPANPTLGWETVTITDIGVDFDIFNGLLNFTADYYNKKTDDILLAYPSPKEIGIGSDFKVSQNIGTVSNKGLELSITHNKTLGDFAYTVGFNMSKNWNKVTNLGANDPIIESPWIKKVGYAIGTFYGYRSDGLLTQEDIDTGNYITDGLVPQAGDIKYVDLDGDGKLTDKDRTYIGCDVPDITYGVNLNLRYKGFELSMFGQGVTGTKVNFSMENAWAFSDYASPRKYHLKRWTVDNPNPNAAYPRIYPRTSKHSTYNQYFSDYWLFNADYFRIKNITFGYSFQKPVLQKLSLEALKLYVAAENPFTIRADHRMEDFDPETASGRGVNTRGTSSIAFGVNLTF

SEQ ID NO: 19199 - protein, 1061 aa, Bacteroides fragilis
MKKISILFMLLLGITTLYAQQLNITGTVIDKKLNEPIIGATVQVKGTNNGSITDMEGKFSLKNVSKGGILTVSYIGYTTQSIPLNGTQTSFRIELSEDSKTLDEVVVVGFGTQKKVNLTGAVTSVDTKALASRPVSQVGQALQGVVPGLNLSTPDLGGQLGQTMNVNIRGTGTIGKGSSASPLILIDGMEGNMNNLNPEDIENISVLKDAASSSIYGSRAAFGVILITTKKGKAGKMQVNYNNSFRYSGPTNLPNQLDSYRFANYFNDAAINQGGSVIFDEETIDRIQKYMAGEITTTTIANGTNWHFHEKANDNVNWWKKHFQWAWSNEHNISLNGGTEKLQYYVSGSYLNQDGNLRYGNDNYKRYNATAKVNTQINKYVDFNINTKFVRFDLDNPVYLEEGGLLYHDIARMWPMMPFKDPNGYYMRNGKLNQLTDGGRAKTHNDNIYLQGQLVIHPLKGWNIYAEAGMRVINQNKQTNLNPIYEHDVNGNPLALAFSGSYSPGSSFARSAYHNSNFYTTSVYTDYTLQIKDHYFKALVGMNTEEYVYRELAAQRPDVISSLIPEISAATGEDKINSSKYNDWSTAGFFGRLNYSYKDRYMAEVNVRYDGSSRFLKDQRWNVFPSFSLGWNLARESFFEPINNIINTLKPRVSWGMLGNQNTDSYYPFYLTQSVTANGGNWLMDGSRPTTAGVPGMVSSTLTWEKIYNTNLGIDLGMFNNRLNMTFEYFIRRTKDMVGPAAEVGAILGTALPNTNNAELKNKGWELQANWRDNIGKVNYNIGFNLSDNRAKVISYPNASKALWDSNGNTLYYNGMTIGEIWGYETEGIAKTDAQMTEWLASNDQSKIGSVWGAGDIMYRDLNGDGIVDKGNSTATDHGDLKKIGNSTPRLRFGLSLGADWKGFDIQMFFQGVMKRDLWLSGPMFWGADGGEWQSVGFDEHLDYFRPENTTSIFGANLNSYYPKAYLGDKGNKNKQTQTRYLQNGAYMRMKNLQIGYTFPKAWMNKAKIEKLRIYVSGENLFTISGIADMFDPEATAGNGFSNGKTYPLSKTISFGLNITL

SEQ ID NO: 19200 - protein, 899 aa, Bacteroides fragilis
MKQQIGRLLSTLLLATFSLGITAGVIQGTIIDKQTKEPLTGATVQIAGTTTGTVADVDGNYTLTLSNGTYTIEVKYIGYKTLRMNEVKVKANATLNFELEVDAQTLDAVTVVARKNLEGEKALLQERQKATLAIENMGAKEMTLKGISNVQDGVKKITGISIASAGQLIVRGLGDRYSTTTLNGLPIASPNPDNKLIPLDLFPASTVKNITVSKVYAAGAFADYSGAHIDISTKENTGSDFFSIGFNVGGRFNTVGKDFYYSDRKGGLFSTGNLRNKDRILAMGKSEFRDYARNNDPFGTNFAISKHRSLPEFGGNLGGGKSWTLPNGNRLSVLASVGVSNENQILKDAYVTTMTAQGTHLDKFNYDSYSSALKIAGLGNIGYSFRQADHINFTVFYARNAINDYMSREGIDAEKNNITSSNSVFHAYSLLNNQLLGHHELTSQWDVNWSASYGLTNSDEPDRRQVVFFRNEGSDKLNLFKLNQTTNRYFGELQEKEIVGDLRTSYKWGDANLIRVGGTYKSKKRDFESVNFYYDINALNADVTNIYDTNGYLNQENIANGTIKANIDAQPRYNYYAGMDVWAGFAEIEYYPMESLLVNVGLRYEQAKQWVRYWTDGGQEKKTNLDKGDFFPALNLKYSLNETNSLRLSVSRTVTRPSFIEMAPFLYQESYGSAYIRGNNELKNAYNYNIDLRYDFFPKRNNGDMFSVTGYFKKLKSPIEQTQESSGGTVIRSFRNAEDGIATGVEIEFRKELFKNFRIGANGSYMYTNVVLPEGGVYTDSERALQGASPFLINADLSYTPQLRGESDLTLALVYNVQGPRIETVGIYGTGNIKQQTLHTMDFIASYAINKHLSLRLQMKDLLNSTIRFKQELPATGQKVEVESFRPGTSAEIGVSYRF

SEQ ID NO: 19201 - protein, 998 aa, Bacteroides fragilis
MKNMKTTFFPGSILVLTLVAFLSACGGSGLVRPPTPTPTPTPTPTPTPTPTPTPTPTPTPTPTPTPTPTPTPTPTPTPTPTPTPTPTPLPDLDPALAAKFRVHLDVTNTEPAHTLGFTGKGYMIGVVDSGVNRNHVTLHDQVIHNNVYVDYQDPASPDDVSGHGTNVAQLIAGQPVEYWPGGIAPGATIFSARVFSSAAESAKEGPIGGNFFEGEAAQLKRVNADMIAAGVRIQNNSWGYENQNTGDKQVWIDPAVTDGFVNVYRDLVLNNNVLVIFASGNYSQQQPGRLSRLPSLPTVEGGASPADLERGWLVVAALDSFDHPDQLTSYSNHCGIAMHYCLAAPGDLIEIDTNVTTSPVDGDKGYLNGYLIQNGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLMLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGANNAYVTLQRLNVSAAAQALGIVDRVAQASAQRVEQAFRAIDAQQAQGRGALPTSFIGAAAALQQSSSAAVAAGSLQSLSGQSHVAAAAASLDAIDLGRRSLATRLDVLRSGERIVTWHQALGGPGQNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 19202 - protein, 916 aa, Bacteroides fragilis
MKKSTYLWMLPLLFAWPQQMTAQHPLSLPADSITIDSLLETVEKNTPYRFFSTISAPFKVLVKGKASPLQQLKEALEPTPYKLSVSGNNLFVLKEQELITLLPAKLTGEPEKGESYYGDVYTYLSGEPEKASSENKVYNVGDVRIKQPPRKAVLKGQVTNFKTGEPMIGINLILKDPWIATTTDVKGNFTLELPTGHKQIDIKGLNIKDTRRQIMLYSDGTLDIELEETTHMLDEVTITSGRIQNVKSTQLGAETLRPTQLKNIPMALGEVDILKMVQALPGVKTVGEASSGFNVRGGATDQNLILLNDGTIYNPNHLFGFFAAFNSDMVKEAEIYKSSIPAQYGGRISSILDITGKEANKEKFTGSAGIGLVTSKLNLEIPIIKDRTSVLLSGRTTYSDWIMKQLPEKSGYKNGTAGFYDLAAIVAHKFNDKHSLNVYGYYSHDRFAFNSNEKYGYNNLNASARWRAVFNEKLIGYFSAGYDHYDYNNRETVNASAAYKLSFDINQYFVKADFTNILADKHTLNFGFKSMLYHINSGTYEPEGSESFVKKDVLQKDKALETAFYLGDEWEITPKLSVNAGIRYSLFSALGPRSYYQYASGMLPHESTITDTITAGAGKFMKTYHGPEFRLSARYAFTDNFSVKAGFNSMRQYIHKLSNTVIMSPTDTWKLSDVNIKPQRGWQAAAGLYLNSPSGIWEYSVEGYYKRMSDYLDYRGGAKLLMNHHIETDVINTQGHAYGVELQVKKQVGKLNGWMSYTYSRTFLRQNDKRIEKPVNNGDWYPTEYDKPHDFKFVGNYKFTHRYSMSINVDYSTGRPTTIPAGQYYDESTQSMRVYYTERNSYRIPDYFRTDISFNIEPSHHLTLLTHSSISIGVYNVTGRKNVYSIYYMPEEGQIKGYQMSIFGVPIPFITYNIKF

SEQ ID NO: 19203 - protein, 1138 aa, Bacteroides fragilis
MKNKILFQRPRLLKASLVLLLAAAPIQWSFAQFTFSTSRTTLGQVIKTVQSQSKYQFFYDDQSSNMPIENLNVKNVSLEQLLNTALKGKNLTYKIEDNIVYLSQASKQQDPVQASAKRQISGTVVDANGEALIGVNVSVKGTSTGAITDLEGKYTLTVNDPKAEIVFSYIGYKQQVLPAKESILNVTMSEDTQMISEVVVTALGIKREKKMLGYAVQEIKGDQLNQTGDPSVTSALQGKVAGLQMNTAGTGLGGSTKITIRGNSSLADNNQPLWIVDGVPFSDNNNSDATYYGGVDRGGSSVDINPEDIESISVLKGPNAAALYGSRAGNGVILVTTKKGSKKDGFGVRYSGNFTWSQVAETLEMQDRYGQGHIVTQDENKNPLSQYYAKYDPTDSSSWGPVLDGSMQKAWNGDTYAFSKYGNKLKDYFDTGFAQNHNVSVSNVTDKSHFRASFGSSNNKGVFPNEKLNRINLDLNAGMEMNKYLSMDGKISLSRTKAEDRPYFGTYGAIAQLMGIPNNIRLDDLKQYSTDGNAHVNWTGPTAGIRNPYYVLNQRHNSDERWRAFGYYGMKINFTDWLHLSAKYAFDYYRTRIEETNAGDGINGESSIKDITDDEMNREEQNFFESNAEIVLMGDKQLTDNFRLGFTVGGNFMYQNYESLNAGVRNMLDKGQWIFNAANMLNTAGETGHERATNSVFGSLQLSWKEYLSLDLTARNDWSSTLPKKNNSFFYPSANLSFVVSDFVRSLDKTLPNWLTFAKVRLSAAQVGKDTDPYQLYNTYGFKFEKGELIPSKSNVKMNDQLKPEISSSYEAGLDMKFLNNRLGFDFTYYYSRTKNQIMKVPAAAPWSGGKWVNAGLITNKGFEMMIYSTPVQLKDFSFDLNVNLAKNVSNVEKLADGVDYIYFNGDSNFPINVGARPGHKLGEIYAKTLYKRDEQGNIIINKENGLPMTTTDADERLAKPIGNIQPNLLMSVSPSFTYKGITLSAIFDMKFGGDIISISEMNATGSGMAKRTMNRGESDNFMMIFPGVYEDGTPNTQKISASNYYGAQNAEDFIYDASFIKLKELAIGYTFPKSMLKKTPINSLNVSFVARNLAYLLKHTPGTSPEGGYDTTMFSQAIDFMAVPYTRTFGFSVNLGF

SEQ ID NO: 19204 - protein, 824 aa, Bacteroides fragilis
MRERIAMSTLHTMRLHALACAVVSCLCAPAALAQDTAAAAPATPPAADSAAVNLDSVFVTGTSTATTKLKSSVSVSTVGAEAVEQSAPRSTAEIFRNIPGIRSESSGGEGNANIAVRGLPVASGGAKFLQLQEDGLPVMEFGDIAFGNSDIFLRSDFTLDRIEAIRGGSASTFTSNAPGGIINFISKTGDTAGGSVGVSRGLDYDNTRIDFNYGAPFAEQWQFNIGGFFRQGDGVRDAGYTTDKGGQLKANLTRLFHNGYVRVYGKYLNDRAAGYLPVPTSVRGRDGSPDLGGFPGFDPGNDTLYSRNFRTDVGLDGNNQPRRTDLGDGMHPISRTIGAEAWFDLGNGWNLSEKFRVADNSGRFVSPFPVEVTDAASLAASIGGAGAQLVQASGPDAGQAYTGNAIRTHLFNVAINDLGNVTNDLSVSREFGGDGRTLNLRMGYYSSRQTIDMDWTWNSYVQSLGRNSRLLNVVDAAGVSRSQNGLYAYGTPFWGDCCVTRSYDVRYDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEISRDQITPENAGNVPRRQADVVWQLTPSYRGDNYQFGVNLIGTTDAYTQDANQLKMPGYTQVNLFGDYRVTDALTVALNVNNLFNTFGLTEAEEATIPANGIIRARSIAGRTTSISLRYDF

SEQ ID NO: 19205 - protein, 333 aa, Bacteroides fragilis
MQTAAKKDEEIVNTMYNPTIVHNMNQLNSNIISNRIMHTTLPASAVAAGDEDEKVLDKGIWLASIYGTNKQGVQKEFIGYKGRTSGGTIGFDVGFENVNDLLGIAYTKLDSKFKSKGKNLNTKIDSHIVALYGQKELPKNFMMQAMFAYNHNIINSKINRLGTVANGKYKNNNYNFEGLLSYNYLLNSSISLTPNIGIKYGYSKDGQYQEGNTGIQSLSVAAKKHNLWSSVLGGKVILTPQKIYKNINITPALQASVENYFHNTSKKLHTKVKWKDKEINETVALPKQPKIGYNIGASVLTEKDKVSVLLEYNCHLQKKYQSHQGFIKLKINL

SEQ ID NO: 19206 - protein, 594 aa, Bacteroides fragilis
MQTVDAPPLEPVVVTAQRAPQALADAIPQTTVFDAQDIAAHPGADLATLLAFAPGAQIVRNGGPGANTTMFLRGAQSTQSLVLIDGVRVDSASLGTAQLSQLPLDQIERVEVVNGNVSSLYGSGAIGGVVQVFTKDGGNHPPRFNFSVGIGSYGTQTQQAGVSGRLDGDGNTTFSVSIAREKDNGFSALDPARKPNANPNANGYLNESITAALRHRFNDRWDAGVSYFQSNGNNSYDNAWGAPTDVNNLYSRVQQVRAFANGKLTDWWTSHVSVATGNDRSQSALNGVYTDHFNTDNRQYTWQNDFRIAPDHRVQAGYERLDQQFMSNVYSAPQRHVNSGWLRYAGRVGRQQFQASVRRDQYSDFGGANSYYVGYGIDLTDRWKVTASYSDAFRAPTFNDLYYPMAGNPSILPERSHSVEAALQYASDAVGVVRVTAFQTRYSNLIDYRPDARSFYYIAQNVGRAKVQGLEGSWQGHVGATDVRVAATLQNPIDETQNRDLDRRARRFASMAVSRPFGGWRVGGEWLVSGARTDAGGERLGGYGIVNLSARYDITKSWYVSARIDNLFDKDYELAYAYNTPKRGAYVTLGWQQR

SEQ ID NO: 19207 - protein, 991 aa, Bacteroides fragilis
MKRKLMLLLACLFVGIGLVTAQTQTITGVVISEEDGQPVIGASVLVKGTQLGTITGVDGDFTLSNVPSSAKTLQVSYIGMQTQEVAIKPNLKIVLKADAALLDEVVIVGYGSSKKLGSVVGSVTAVSGEKLEKKPVANIGDALQGQVAGLQVFTPSGEPSGTVQMRLRGVSSINSSSEPLFILDGSPISSGAFTALNPNDIESMTVLKDASSTAIYGSRAANGVVILTSKRGKRGEKAKITISAQYGVSKMTGDNITMMNAEQWLNLQEVLDPSLKTNQSFQSEKDFYIKNGISTDWADVFFGGTAPMQQYDLSISGGTESLNYFLSFGHYDADGIMDDSNLRRETLRSNIETNITKWLKAGVNLNLSYQKYATAAFGTTANQVYNKAYAARVYRPDQSYYEVLRDDNGNFIGYGDRLDYFDKLNYYNPYYLSEIQPASRDMARINGNTFININPIKGLNIRAAQAVEAFDYRYSYKALPIGPFEGAGSATESFQRYYSFTYTNTAEYKFTAWNNHNFSALIGQESIITKNQSFTSEVEGLTDPRLMLLSAASNATMPSHSKYDKIFNSYFATFSYNYDEKYYLDLTYRRDGSSLFGLNSQWGNFWSAGAMWDLKKENFLSDISWLNQLQLKASYGSVGNSSGLDPYMSFGLIGTGPLYGGQSGTAVANPANPDLTWEVVKSTNVGLSTRLFDRVSLDIEFYNRMTENMLMEIPYSFTTGFASGWGNVANMRNRGVDITANVDVLRDVNGFDWTISANVNYNKNEITQLFNGLDEYVLANTGLKLEVGKPYGEYYYTRWAGVDPRDGYNTWYDKNGNLTKTYSADDAVFLGKQRYAPWSGGFGTRLAWKGITVSADFSFMLGQYMVNNERWFTENPQMANSRNQTTEMLTMWQKPGDITNISTPDSPMQFDSHLLENASFMRLKNLTVSYTMPQRIMKKTGFIEDAKIFFVGRNLLTVTKYKGFDPEINSNMQLGNYPNTKQFSFGLELTF

SEQ ID NO: 19208 - protein, 779 aa, Bacteroides fragilis
MKYRILVLTAILFTACNLLHAQVQTGKLSGVIIDANNEETLVGANIYVESLKKGTSTDKNGEFSIEVPAGHYRIVISYMGYRTRQEEVRISELKTKKLVIRLEPETQSLGEVVVTAKSEARQLREQAMPMSVISMQQLQGTVSNVQDVLSKTVGVTIRNTGGVGSSSRVSVRGLEGKRIGFFIDGSPMNDNSDFIDINDIPVDMIDRIEIYKGVVPARFGGSSVGGAVNIVIREYPPKYLDASYSIESFNTHKLSLVTKRNIATKGLEFGGGGFYTYSDNNYKMESPFEEGLIIKRNHDKFKKLAVAGSLKARKWWFDLAEFEPVFIHTFKEIQGIEYNIEKAHTYSDAFIFANKLEKENFLTEGLDMESNLAYAYTVFHMVDTAAYRYNWDGTTYPAVSEYGGEIGKWASNARNEKHTITHKLHLNYVINNNHSINLNSLFSFASGHPKDDLKNKVVGYKTNFRSTMASWIAGLGYDFRTDNDIFLNSLNVKYYMYGMNTHMSSIMSSEAEKVDMLKRDFGISNALRYRFTPDFMGKLSVGYDVRLPAESELLGDGYTVAPSGNLLPERNTSVNLGFLLDRTGKDASNLQVEVNTFYGYLENMIRFTGGYLQSQYQNFGKMRTLGVEVEVKADLTHWLYGYCNMTYQDLRDVRKFEPNTHITNPTKGSRMPNIPYLLANAGLEYHKENLFGGKGQNTRIFTDGSFVEEYFYDFEQSRFQERRIPRTFSANIGIEHSFMNGRFIISARMNNLTDARMMSEFNRPLPGRNWGVRLRYVLK

SEQ ID NO: 19209 - protein, 1093 aa, Bacteroides fragilis
MKTRTRTKMLLLLGVLLFGFTVSAWSQKVSLNFNNEKVEKILSSIKAQTGMGLVFSDQLIDVNRKISIQVKDASLDEALSKLLAGTKVTFEIKNNKIYFIEKKADQQSGSRKKKVSGVVKDATGEPIIGANVVEKGVGTNGVITNLDGEFTLEVPENASLIISYIGYLQQDVSTKGKDAFNIIMKEDTKTLDEVVVVGYGVQKKVNLTGAVAAVDSKSLQNRPVTNVSNAIQGLLPGVTVISGTGQPGSDNTTIRVRGVGTLNNSNPMYVVDGLPVSSINEVDPSDIENISVLKDASSAAIYGSRAANGVILITTKKGGDKAPTLRYDGYVGWQKPTALPEYLHSWEYAKLYNKAMVNEGKNPIYTDEEIEKFRNGSDPDNYPDTDWQGLFYKTGLQHSHRAEISGGTDKMTYMFSAGYLGQDGIIDIAKYDRYSVRGNMNAKMGKFTAGMNLSFTYGEAQEPVSGFTGEMSNIFSQINQIAPFIPYKYSNGYYGYANDGNPLAFIEEGNLRTTKQHITRAIGNVSYEPIKGLKIQEIVGYEYKSISDEKFIKDIQYYNWKTGEPTKYQGPNNQTDERKNGLKLNLQTLVSYNNTFGKHTVGALAGYEQEYYREDWTKGYRKNFLNNDLWELNAGSPDGQTADGSANEYALRSFFGRLTYDYDNRYLVEANIRRDGTSRIFKDSRWGVFPSFSGAWRIINEPFMEGTRNVLSDLKLRGGWGVLGNQAISYYSYQSVLDQANYSFGGTVVQGVAPVDGANRNLIWETTETLNFGLDMGFLGNQYTLSIEGYRKLTYDILMKLPVSTLYGLNAPYQNAGKVKNTGLEITAGYKLNTHGWNFQVSANAAYNKNEVMDLKNGGARIWSGKYFNQEGYAINSIGGYIAEGLFKTEEEVANSATIPGTDTAPGDIKYRDINNDGKIDGEDRVYIGNTMPKWTFGLNLFAEWKGLDATFLFQGAADVQGYLAGPGVVGEMIGAKGKPSYMYRDCWDAETNPNGKFPRAFSSYRQNNSIYNPSSFWIVNSSYLRLKNFQLGYTLPKEWCNMMGISRIRVYYSGQNLLTFTKFDKGFDPESPEGGSSYPQVKTNTFGLNITF

SEQ ID NO: 19210 - protein, 739 aa, Bacteroides fragilis
MKKMIFAGCLMAGASVFAQAGETDSLKVVNLQEVQIVSTRATSKTPVAFTNVSKEELKKQNFGQDIPFLLSMTPSALTTSDAGAGIGYTTLRVRGTDGTRINITANGIPMNDAESHTLFWVNMPDFASSVKDIQVQRGAGTSTNGAGAFGASVNMQTEGISMQPYAEINASYGSFNAHKETVKFGTGLLKDHWAFDARLSNIGTDGYIDRASVDLYSFYAQGGYFADNTSVKFITFGGKEKTYHAWNYATKEEMKKYGRRFNSCGMYTDDDGHIRFYKDQTDNYLQMNYQLLLNHTFSAAWNLNAALHYTKGDGYYQEYKEDRSLKEYRLHPFMYDGKEVEKSDLIRQKKMDNHFGGGVFSVNYRNEKLDASLGGALNYYDGWHFGRVIWVKNYIGELLPDHEYYRNKAKKTDGNLYLKANYNLVAGLNAYADLQYRYINYKIHGDNDKYDYNTDGLQKLAVNDHFNFFNPKAGLNWDIDSNNRVYASFSVAQKEPTRNNYTDGNADEYPKAEKLYDYELGYTYRNTWLSAGVNFYYMDYKDQLVLTGELNEIGEAMARNVPDSYRTGVELMLGVKPCRWFQWDINGTLSKNRVKNFTEKLYEDEWKNPIEVEHGNTPIAFSPDFILNNRFSFSHKGFEAALQSQYVSKQYMSNAKQAEQTLDAYFVSNLNLAYTFQLRHVKSVTVGFTIYNLFNEKYENNGYAGSGYTLKDGKPERYNYAGYAAQAGTNVMGNISIRF

SEQ ID NO: 19211 - protein, 795 aa, Bacteroides fragilis
MKKNSILIALALFSAGGTWAEELPKDTLKVIDVEEIVVIAAPKENRKLREQPTAVTMLSQQDMQANQVNSIKSLTALVPNIFIPDYGSKLTSAIYIRGIGSRINTPSVGLYVDNVPYIDKSAFDFNYADIERIDVLRGPQGTLYGRNTMGGLIKVHTKSPFSYQGTDLRLSAGTYDNYNASVTHYHRMSNQFAFSTGAFYEYGGGFFKNTYLNKKIDKSQAAGGRFRGIYLPSENMKLDLNVSYEYSDQGGYAYGAYDKHTGTYLKPAYNDPSSYYRNLLNAGLNLEYQGDHFTLSSVTGLQHLRDRMFIDQDFSPANIYVLEQKQKLTTISEEIVLKSKSGRRWEWTTGAFGFYQWLTTNGPVTFKEDGVTEMLEKGINSHFPDLSAMGMKMNLNITNPTLLVDGRFHTPILSGAVYHQSTFRDLLIEGLSATVGLRLDYEKNWMKYNSGSTIDYQFNMTSPFMPVRLEQTSSPRLNGKFSNDYLQLLPKFALQYEWKKGNNVYATVSRGYRSGGYNIQMFSDLIQGNMQNDMQGQIKAGTKQIFDRLVTQGMPQAIADRILSNIPDAGENADPKASTIYKPEYSWNYEVGSHLTLWEGKLWMDLAAFLMDTRDQQIAQFAKSGLGRITVNAGKSRSYGAEAALRANLTDALSMNASYGYTYATFTDYKTIDRGQNEISYDGNYVPFVPKHTLNVGGQYIFRIAPRHWLDHVQVNVNYNGAGRIYWTEQNDVSQSFYGTLNGRVSLAKGNGQIDFWVRNALDKKYATFYFESMGNGFMQKGRPVHFGVDIRCRF

SEQ ID NO: 19212 - protein, 1152 aa, Bacteroides fragilis
MNKNRINSVKGLTLSASIVALAVSGPAFAQTVGTPEPLEGDECALSADGTLPEGCEDEQTPDITSNPEDVVPPEGQIVVTGSRLKRDTFTSISPLQVLQTEQSRDAGLFDPSQILQRSESAAGTQIDATFQGFVLDNGPGSQTLNLRGLGADRTLLLVNGRRLAPAGVEGAPTVPSINLLPGSLIERYDLLLDGASSIYGSDAVAGVGNIILRKDFDGLELFARGEINPEGAGEDYTLSAAWGVNGDRGFFGIGAEYDYRDAVRLRDRDFFSGCDTHREIDESGNLLTLGVADNAVVQNRTPGVSVSESECKIGGISGRIFQPFARFGSVYFPANGNIANFPRDPRTGRPFNFGESTNFFGTDLDSNGDGIRDVDFQNVNTNGANLDQTFLSEQKLFNVMAYGEYTFPSEVNLTPFFEVNYSRAEIFSDNTGFPQLFPSVPDLNPFNPCNFITNPDGVDCRAVDNALQAQAGRPFRPLSTGFPLPTSPIVSVVGDRNNVDIVQEQFRAVVGIRGDAPIFGPSWTFETSLVYSRSEGSSVRRGIREDRLALAIGLDPTADYDGDGVIDNNGNGIADDYDSNLDVFGFFGDPQFIGVCNGAGLANPDAAAPDLNAAGCVPVNLFAPSILGAPIGDFATQAERDYVFGVREFDTTYKQIVWNGFVTGDLFELPGGTAGLVLGGEFRRDEINSQPNLTASDGLLFGFFADRGAIGSKEIQEGFAELDLPLIAGQPGIQELNVNLSGRVTNEEFYGTNFTYSAKIGYRPIEPLLLRASYGTSFRAPNLRENFLLGQSGFLTLFDPCAVPDDAFVGGAYNAATDPRDPVILQNCRREGRDPTVAGVGTNGFNTLQTASVEIVRQGSLDIDPETSTSLTAGFAFEETFGPIDFSLGFNYYRIKLKDSVVEPSSQFILNDCYTRDDGQRSPFCDDIIIDASPTGRFLVEQTTPNFLNLDQEKVEGMDFNLFIGSEVSLFGTLVDLGLTVQANHLMERSTLFIDDTGEETFDDDAGEFSLPKWTGRSTLTADIDNFRVTYQIRYTGPVEQDILGIDEFDDAFGSRGTGFFGDTCTGAGGANFAGDGVFCRDVGFADEQFLHTVSFRYRTGTWTFRAGIDNLFDTAPPLVDGNEVLAIANTAIGNGYDYDGREFFFSVEKSF

SEQ ID NO: 19213 - protein, 1063 aa, Bacteroides fragilis
MFATSLETYENQSVAAVQQARKITGTLTDAVGEPIIGATVLEKGNPSNGTITDINGKFSLSVHPNAVISISYIGYITQNIKITNQTSLKVVMMDDTQALEEVVVVGYGSQKKANLTGAVSSVKMDEVLGDRPILNASDALQGAVPGLFVSNGGNAPGTSKSFQIRGAYSVGVKNSDGSYGNTIKPLVLIDNVEGDLDMVNPEDIESISVLKDAASAAIYGARAAGGVIVVTTKRPKGAAKFSLNYNNNFAFGTAVNLPKQAPLMDYLQAYLDCGYSDAYWSLGSPSVSKWMEYLSEYQKNPSAFNTVGDGIYMDESGVPYYLNEKDLYKNFMETSFQMTHNISASGGTDKLRYRISGGYTSNDGVLVSDRDKFERMNINTFISADVTNWFTQEVTMSYAHSLQTSPGGMGGVYNTRLVSYYPEGDLPASVNTLANEDLPLFIPRNQILLSNPVNNNNDNPRIFLKSILKPLKGLEAVFEYTFDKNIYDYHWYTGQYDYTTIQGGSSKSFVDDYLRKYKQHTNYNAINVYATYSKKFGDHNFKVMAGFNQESSYQETLDAYSYNQAVIDVPAMGSGTGTIKATDSYSEYAVRGGFFRVNYNYQDKYLLEVNGRYDGSSKFPKSSRFGFFPSVSAGWQIAQEKFMESTRNWLDGLKIRASYGVIGNQNVNPYTFTPTMSVSNKSTSWIIDNTYVTSISSLPALVSQNFTWEKVGTVNVGLDINLFNNRLNGVFEWYQRNTNGMLAPGVQLPAVVGASAPYQNTADMRTRGWELSLNWRDQIGKVGYRLGFNLSDYKSKITKYDDNATTKLLSSFYPGQVMGEIWGYIADGYYSVDDFEDTSSWKLKEGITSINGYNVRPGDVKFKNLRDDESSTNVITSGDNTFDNPGDRKVIGNTTPRYQYGINLGANYAGFDLNVILQGTGKRDYWISNVLTFPMNGDNFIPLFDGLSDYWMPKDPDNGDWTAVNPNAKYPRLYGNRGNSGSNLRQSDKYLSDASYLRIKNITLSYNLPKKWLSQIFLSQMKAFVSVENVATFTSLPSGIDPERIEWNYPAFRTVSFGINITL

SEQ ID NO: 19214 - protein, 808 aa, Bacteroides fragilis
MKMIRNTLLGATILMGVGTSSAWAQEPAAEGEPAGGSGEIVVTATRRATSLQDVPINISAVGAEQLSRQRIDDVRDIADFTPGMTISDTGPGSTGTIVLRGLNASDTDTTGASYDDSLGVYLGEVPIYYDFKMLDIARVETLLGPQGTLYGLGTLAGAIRNIPNRPDLTAYQAEAHGRAYGKSHSSQVGYQADGMINIPLVTDHIAFRSATGYFYDPGFIDYPLLLQTPGVSLPQPSGPDGVTEADYAANLKRRKDLNFERTFTTRNQLLFQLNEDLKVNFTYAYQQTKTDGGQYNSNGVLGTGKYESAGRYVEPVNRHAHLGSMEVNANLGGIADLVATTAYTTVKNRAQSDNTDLLLDLDYGYETFPAFSSWNESEDERKQFNQEVRLVSRHGGPFSWVLGGFYNQQKRHRDYIEHVPNHPWVEFGTQPNPDEVEYASYVTSKVTEKAIFGEGTFRVTPAWQVTAGARYFGYNSKIAGALVVPLIGDPVSPYDLTPAGGTAKKTGWVWKFNSSFNFTPDIMLYGTYSKGYRIGGPNSVAPCPNPLPNDPDGDNINNTQLPCGLPNEVQYGPDTTRNAEIGLRAQLFERKLTFNFNVFQIKWDGIQVDSATLNGIVGITVNGGKAKSEGFETSFQLRPVDRLSIQGTYSYVNARLTEDVPDNIPVNDPAGTYPSAPTKLDALAGDRLPGSAKNSGSLGVTYTMPFKDGQLVADWTATYRGNVVTRLGWDRAYGDKLPGYVLHRASLTYDTDRYSIGLFANNIFDKYAVASVANDRSRVGLNDGVVLRYYKRTVINPRTVGIEARFRY

SEQ ID NO: 19215 - protein, 1111 aa, Bacteroides fragilis
MNEDRKKRGLANSNLLIAMAITALIIGSSNAMANQTASGSSYKVTEQMQIQTVTGVVVDANGEPIIGASVVEKGTTNGIVTDMDGKFSLNVKVGTTLQITFVGYQPQDVKATKSMKVVLKEDNELLDEVVVVGYGTQKKANLTGAVSTVDVSKTLEARPQSDVSKALQGVVPGLTITNTSGKLNSKPTMTIRGTGTLSNSATSNPLIVVDGVPMDDISYLNTQDIDNISVLKDAASTSIYGTRAAFGVILVTTKSAKKTDKVTINYTNNFSWDTPTILPNYPDVATQARALRAANTRANLENELFGMYMDDNFIAKAEAWKQRHGGKKAGYREMIPGDDFDLGEDGSALYYADWDVVGIMFRDWKPAQSHNISIQGTSGKTSYFLSVGYNHEEGVMTFNPDKLNKYNANMNVTSDITNWLQIGGRFSYSDKAYTTPNTRRNTYTYMWRWGSFFGPYGTYQGIDMKNDIAYLKQAGDDKTNDSYTRIGAFLKATIIKGLTLNADYTFNINNKTTKSVGLPVICWNSWGGKLNTPTTAAGANGDTWVYQNSVRDNSYALNVFANYELTVAKDHHFNFMIGANAEEGEYQNHWSQRKGLLDDKLPEFNLATGDQTVGGTHNEWGTAGWFGRINYDYNGIWLLELNGRYDGSSKFPSSDRWAFFPSGSVGYRISEEKFFEPIKKVVSNTKIRASYGEIGNQAVGSNMYISTVSKRTDGNTHWLNGSNKVVAYDLPSLVSPTLKWERIQTLDIGGDFGFFNNELNISFDWYQRTTKDMLAPGQTMPDVLGAGAPKINAGTLRTRGWELSIDWRHHFNEVNVYANASIGDFKTVITKWDNDSQLLNENYSGKVYGDIWGFETDRYFTKDDFNADGSYKEGIASQKKLEQDGFVYGPGDIKFKDLNNDKEINGGEGTVKDHGDLKVIGNTTPRYQYGFRLGGEWKGIDIDMFFQGVGKCDAWTQSAFVMPMMRGADAIYANQANYWTDENPDPNADFPRMWPGNAGKGTVSVLDLGNHNFYPQSKYLVNMAYLRFKNLTIGYTLPKDWTRKVYMDKVRVYFSANNICELINKSNAPVDPEVNTSEAIANGGSSDYGNGTWGRVDPMYRTVSFGLQVTF

SEQ ID NO: 19216 - protein, 716 aa, Bacteroides fragilis
MRNLITIVTLFLITLGNAQTTISGKVVDNKNQPIFGANVYLEGTYDGATTNEEGKFSFTTDEKGTQTLIISFLSYETKTIVENVSKLSNLQIKLREDVETLDAVVLSAGTFEANDNSKVSVLKPLDVVTTASALGDFVGALQTLPGTSNVAEDGRLFVRGGNADETQIFIDGIRVFTPYAPTTNNIPTRGRYSPFLFDGITFSTGGYSSEYGQALSSVLLLNTVDEPDQEKTDIGIMTVGVTLGNTQKWEKSSLSFNASYINLAPYLAVFEDRNDWESPYQGAQGETVFRQKLNNGILKFYAAFDTSKFELTQEDINLEEGLDFKLSNNNFYLNTSYRGVLSNNWSLQTGLSYTYAKNEIGIITSDINDNENSAHIKLKLKKRFNSRFKLSFGAEQFITDFEENFKDASFDETYGFKNNITAGFAEADLIFSKDLALKVGLRADHSSIFNETNVAPRAALAYKTSKNGQFSLAYGNFFQNPNSSILKFEQNLKAQKTSHFILNYQYVNDGKIFRAEAYRKDYDNLVKFDSEFESFDSNYNFSGDGYAQGLDLFWRDNTGVKNLDYWVSYSYLDTERDYRNFQESAQPSFATKHNLYLVGKYWIEDWKSQVGFSYGFSSGRPYTNPNTNKFLSERTKSFNSLSVNWAYLLSPQKILYFSVNNVLGFKNINGYQYANTPDMNGNFSRRALTPAADQFFFVGFFWTISEDGTDNQLDNL

SEQ ID NO: 19217 - protein, 839 aa, Bacteroides fragilis
MVKCCKKVSGIEKFYAVNLLHSGIISYVRSALLFRFCTLDNEVRAHIAKSRKIVRARNEYIAQHKKPLNKSAYKRLKPDMKAIKKSAIATIINAALLSAAGTSVSSFAAEEETAKKNNQLEVIQVTARKRVENAQEVPVAVSALQGDNLDAYSSAGMDIRFMNAKIPSLSIESSFGRSFPRFYVRGLGNTDFDLNASQPVSLVVDEVVQENAILKGFPVFDVERVEVLRGPQGTLFGRNTPAGLVKFDSVKPSQEFDGYGAVSYGSRGAVDTEGAVGGALTDRLSARVSLLWQDKDDYIDNQAPGFEAKDQQGGYTEKAARIQFLYEGDDFSALLNYHTRDLDGSPIAFRANVIESGSNELVDNYEHDVVYQDAGARSTQQVESEGMSLRLEWDLENHTVTSISAWESAEIYSRGDIDGGYGAVFLPDYMGPGFIPFPSESADGIPEQDQITQELRLSSNFDGDLNYQVGVFYFDEELTIENFSYDTFSSPAGALNGYVKQQQDTTAWAVFGSVDYVVSDDLKITAGLRYSDDEKDFSADRTLSPIGGGALFIEQDVSDSHVSWDLSANYKVNEDVNWYSRVANTFRAPSLQGRILFGDEVTTADSETVTSFETGIKSDVLDGQGRVNATVFYYTMSDQQLTAVGGGANFNRLINADKTTGYGFELDTEWVLSDELNATFNLSYNKTELKDNDLAVAVCGQCTVTDPTFQVAGAFGPEDRAILDGNSLPHAPEWISNFTLRYTKELEDGDFFANGDISYRSKINMFLYESVEFEGKPLTEVGLRAGYRWAEGDYEYEVAGFVRNLFDEQQAIGAIDFNNNTGIVNEERYVGAEFKVKFF

SEQ ID NO: 19218 - protein, 1117 aa, Bacteroides fragilis
MRKSKLHLLPLSSKRVLVSTSLIMLLSGSAWAVSSQETVENGDAITAVPQQRRTVKGIVKDANGEPIIGANVIVKGNKTIGVITNLNGEFSLEVPSNATLQISYIGYLNKEVKVSGNQVSFNIQLEEDSKTLDEVVVVGYGTQKKANLTGAVSSVDFEEQTKSRPITTVSSALAGLSPGLQASSGSAMPGEDNTTLRVRGNGTMNNASPLIIIDGMEGSLNAINPQDIENISILKDAASCAIYGARAANGVILVTTKSGDRDKIQVNYSGRISFNSPTRMIETMSNYADYMELMNESCENVGSGTLFDQKYIDLWREKSKDPNGVNENGVPNYIAYPNTNWLKELYSGGMIHEHNLSVSGGSNKIRFLLSARYQDNEGIVDNTANKTYSVRANIEANPTQWLTLGTRTYASQMDREVGDFSNANTFLRQSTAGTYPEWNGSFGYPECPDERATANNPLYKLARNDGFKRYNRFNTTLFSKVKFFKDLSWDFNFNYNRYIYETRQWGVPAYQTRFSDGVIVDGITPPSQLSTSFGYESNYSYTLENLLNYHHTFAQKHDVSALLGYQEFYKNYYTVDAAKKGLIDESLNQFDEATEMTSTKGATQDYATRSVFGRVNYAYNSRYLFEANFRYDGSSRFHKDHRWGFFPSLSGAWRISEESFMENTRIWLDNLKVRASWGKLGNSEIGNYEYMSVYSTTNAVFGNALNSALYMGAIANSLLKWESTTSVNFGIDVNLLKNRLSISADLYQKKTDGILYRPTIPYVFGTMTAPRQNLAKVSNKGVELSLGWRDNIGGVSYSINGNFSYNKSNIDAYNGTYERTWVEDPNNKLTGGKWEDNIGKVSSGGTTPIVEGRMMNEYYLRNVYHGNGSYYNADGSVNPQGGPKTGMIRTEKDMAWVKDMIAAGYEFQPGKTVAKNKIWYGDYIYADSNNNGVYGDDNDYTFQKTSNKPKYNFGFQASAAWKGFDLSMVWAGAAGFSIYWGATTGYNAASTEWGSTIAQRVAENHYFYNPENPDDPRTNINAKYPRMAYIDGYVQNRHGNTTLWLYKGDYIKLKNLSLGYTLPKNWVSKIAMQNARVYVSAENLLTITGFEGQDPESATGMGYSPFRTIAIGANITF

SEQ ID NO: 19219 - protein, 439 aa, Bacteroides fragilis
MNKQLITIFSIFSITCLGMVSAQESKSFLPEVKKESLTFSSEDNKFKLTFNGRIQADGAMFFGEDYQPIGNGVGFRRVRLGATAAFGKRLSGKIEMDLTDGGFSLKDCFIKYAFPNGLYFRAGNFKESFGMAAMTSSGDLWFMEKANVVSAFAPEYHIGVQGTWEHDQFLGVAGVHFKKIEGNKEKDYSESNNKAGEDEGISVTARAVWQPVSADKVKGLHLGIAASYRTPKTTVGSLMPNTVRYSTRSLSYINKIKFLDTSPIASVSHDWLAGAELAGFYRGFRFQGEYIMNNTVRMEGLATEKFNGFYVQAAYLLFGGQQRYSKSRGAFSQPSFGRSWGDIELAARFDRIDLNGTEVMGGSSNGWTFGVNYYATRNLKFQLNYSYVDNDKYANAFGQAAVGYKSNGEIAYKPEEVDESLGKGGNAYGILGLRIQLNF

SEQ ID NO: 19220 - protein, 1067 aa, Bacteroides fragilis
MRKKEQMFWLASRSRMWRIPLCMAAFSLLPSAYSFASAENPATETVLAVNSVQQQRTVKGIVIDANGEAVIGANVKEPGSTTGTITDMNGEFSLSVGPKATLEISFIGYTTQKVNVGASNTVKVILKEDTKVLDEVVITGFGMSQKKATLTGAVAAIASTDIERSNATTASGALVGKIAGINTRQNDGRPGASTQLQIRNMGAPLYVIDGVVSDDGQFNNMDFNDIESISILKDASAAIYGVRAANGVVVVTSKKGQRNSKNSVSINAYYGWQHNSRYVQPAKTKDYVNAYVSAETWAKKADNDRRYNKEEYAKWMAGTEKNYQGFDWSDYIWITAPQSYISANLSGGTDKANYYVAVSHIDQEATVRGYGGFRRTNAQMNIDMNISDRFKIGATMNGRIEDRHHPGVPGADDTWLPRFATMKNQPTKRPYANDNPLYPQLVSDQKETNFALLNYDTSGKVSDVWRVLQMQTTAEYEILKGLKAKGMLGYYYAYNELDNQEYTFKLYGYNEKTGEYYETAAMDNPYRERNREKVEDQFANFQLNFDRRFGNHSINAVASFEATQRKRPKSWVHSVPVANGMDLIRFKEIVEYNDTGNNTEARMGWLGRINYSFADRYLIELIGRWDGSWKFKPENRWGFFPSASLGWRISEENFWKESKIANVFSNLKIRGSYGVVGDDNVSDYAAFDYLPGYKYNNGGAVLDGDWVVGTETRGLPNKTLSWMESKILDIGVDMGFFNNRLNAQVDFFQRIRDGIPESRYDVLIPNEAGFSLPKENLRSDKHVGFDAMVNWTDHVSDFNYSVGANMTYSRFWDWEQYDTRHSNSWDVYRNSIWHRVGYVNWGYEAVGRFTSWEQIATYPIDNDRKGNKTVVPGDIMYKDVNGDGVINYMDERPIGYRSDSTPTLNFGINLSASWKGFDLAMDWTGSGMTSWQQQYETARPFQNDGNSPEEVFKDAWHLADIWDADSQLIPGKYPLIRLNNEETSAYDKSTFWLHNVKYIKLRNLEFGYTLPKRIVAKAGISNLRLYVSGTNLFSISNIPFMDPECIDSNGLDYPTMRVVNLGINLKF

SEQ ID NO: 19221 - protein, 719 aa, Bacteroides fragilis
MRIGFFSGMLGGLCLISTLHAQEPDSLKAVSLSEVVVTESYQHLKNKNSTWHMEVVGKEFLREHFTGNLIQTLGTLPGVHSMDIGSGFSKPMIRGMGFNRISVVENGIKQEGQQWGADHGLELDAFNAGQVSIRKGPASLLYGSDAMGGAIELVPLPLPAGNRLFGEASLLGKSVNGTLGGSLMLGIKKDAWYTWARYSEQHFGDYRIPTDTIVYLTQRMPVYHRRLKNTAGFERDVSWAAGFRKERYVSSYWVSNVFQKTGFFPGAHGIPDVSRLQDDGDSRNIELPYSQVNHLKVSTRQSLLYDKWALTWDIGFQKNHREEWSRFHTHYDAQPVPDKDPDKELAFTLNTYSSAVKLKLFASAVWQHTAGWDVQYQRNTIAGYSFLLPAYRRFTTGAFWMTTYRPGPTLSFSGGLRYDYGKIDASAYTDPYLAIYLREQGYGDEFIRKYEWRSYPVRRHFGDYSGSLGLVWSPSGGHLLQVNVGHSFRLPGANELASNGVHHGTFRHEQGDAALASERGWQFDVSYTYENGPLSVSLSPFVSWFSNYIFLRPTGEWSILPHAGQIYRYTGAEALFAGGEAAVGIDFLRHFNYRVSGEYVYTYNCDEHIPLSFSPPASLRNTLTWRYKEFSIYGEVQHIAAQHRVARNEDPTPGAQLLNAGVSANLRIGDIWVEVTLSARNLSGAKYFNHLSFYRKVEIPEPGRNFQILIKVPFKSLLK

SEQ ID NO: 19222 - protein, 1132 aa, Bacteroides fragilis
MKKKAIPCHKAGRITSFFLLISIFLLIPSITTPVYAVETYTQQTVFTLHATNKTVKEVFEYIEKNSEFVVLYSKDLLPVLQKKVSVSIDKQNVESILNILSKEAGLKYNINDRQITITKATAEAPQQEKKIKITGQVLDENGEGIPGANIVIKGNSTLGTVTNVEGNFTLMAPENSTLVASFIGYTPVEILLKGKKIVVFKLVPDAQSLEEVVVVGFGTQKKASVVGAVQSIKPAELRVPSSNLSTSFAGRIAGVISMQRTGEPGADGANFWIRGAATFSGTTDPLIFIDGVEVSAGDMNAIPSEAIENFSILKDASATALYGARGANGVILITTRTGKDLEKARINVRIDNTFTAPTRTLKLADAVTAMKLRNEAILTRNPDGTPAFSDDKIQGTLEGRNQYVYPNVDWFDYMFKDYSMNQSANLNVMGGTKKVDYFISASINNDNGMLKKDPNNTFDNNIQNLRYSFQSNVGAWLTSSTKVNVRINSQIVNYNGPSTSMDDLYKYVMEAPSMYFAPVYPNINREDHTIFGNKSGGPIGSGGFSIYRNPYASMVQGSSKQSAYTINTAFELEQKLDFLTKGLNFKALVSFKNWSKTTVNRSFSPYFYELQNPQEQEDGSYLYDYNSISKGRTALETSTSTTGDRLMNLQATLNYQRMFGDKHDVGAMLVYLQREYNLNNPDNNYYNTLPERNQGLAGRVTYAYDGRYLAEFNFGYNGSENFEKGSRYGFFPSLAVGYLISNEKFFEPLTKVISNLKIRASYGLVGNADIGSNRFPYLTKVDLGGAGFVFGDQWQTSSNGATITTYGAEKVTWEIGKKYNVGFDLGLFNKLSLNVDFFREDRKDIFLRRNTIPAESGITGDLRPYGNLGKVRNQGVDMSLDYNHAVSKDFMISAKGTFTYAKNQYMEIDEPDYEYAYMSQVGRPLNQYKGYIALGLFKDQEEIDNSPKQILTGVVQPGDIKYADLNNDGKIDGNDQTYIGNPELPQISYGLGVSIQYKKWDASIFFQGVGKRSIMLSDIHPFGGESYGVMQFVADNHWTEANPNPEAMYPRLTNGKNNNNNPNSTYWLRDGSYIRLKNVELGYSYKFLRAYISGQNLLTFSKFKLWDPELYTSNGLKYPTQIMGSIGLQFTF

SEQ ID NO: 19223 - protein, 1088 aa, Bacteroides fragilis
MKQIYLKCIVGLLFSLITFSAFAQKTVTGTVTDKSGQPVPGVSVKEKGTSKGTTTGSNGKYSISVAEGAVLTFSMVGYTPKNVTVGAASSYNVSIEESAESLNEVVVTSLGIKREAKSLGYSVATVTAKEITQAGTTNFGSALYGKAAGVKVTTAPGGASSAVNIQIRGINSLGFNRQPLYVVDGVVIRNDQQNGPSGVNNNGGLGNAGGQAIWANDRIAGNGMLDINPADIETFTILKGASASALYGSDAASGVIVITTKKGTKDRGLGIDFNYSGSIERAAFLPKMQNIYGPGYDAATSTGNGGDAESWLPLASAPGGVRPWWSAYAQFGPKFDGRDVLWWDGQIRPYTAQENNFADVFDHGYNSNANLSISNQTEKMNYRFSATRMDYKGITPGSKQQRNTFNINSTVKLADNLTADIVVNYMNTRTHNRSGLMGNVLASNSGFFNRAEDMDMLKSVYQNSQGYKFSRFGTGRPEAFAFNTNAAGIMDYFWSQYKNSYDETENRLLSSATVNYTIIPKLKLRGRIGNDFTALGIEDKRYNEYSLAYNTPGSSTGSYSTRKGNYAITYGDALLTYNDKITSDIDFSLTGGFQSRSERYDDQYASTANGLISENWFSLRNSVGVLDNSLGDRTKRQELLKYAYVGIANISFKNYLFLEATGRSEYSSSLPPSNNNYQYMSLNSGFVFSDAFKLPKAISYGKVRASYGIVGNDAPVYRANIAYEQTPIQTVNGSVPSLTLPGQYGNLLLKPERKYEVEFGAEMRFLNNRLGFDASYYSNYIDDQILSLTTAPTTGAGSQLVNVGRISNKGLEISLNGTPIQTADFSWRTRLNFSKNTARLDYLNGTVPELIFFEADQSSAKISARPGESLGNIYVLPRATDDNGNFLIDDDGYYTIDKNPANFKKVGNIMPKAIGGLTNTFTYKNFSLDFTVDYRFGGQLVSPPLKYGTAAGLYESTLEYRDNGITLPGVNVNTGLPNTVQLDGEAYYFNTFQWGNNGVNEIGMVYDNSFIKMREAVIGYTVDNKFSKKIGMNNLRISLIGRNLFYFWKTIENLDPESPTGNQWFSQGVDFGSTAATRSFGFSLNANF

SEQ ID NO: 19224 - protein, 718 aa, Pasteurella piscicida
MNIKLSFIASSVLLAVSTPSLANSNNEASIFDEVVVSGTRSEQSVKNIPSTVSKVTAEQMEKNLATDVKQALKYEPGVTVNGRGRFGMQDFTIRGMSGNRVKMLIDGVEQPISYNPGADVMRKNSNTIEVDTLTAIEINKGPSSSLYGSDALGGTVFLRTKNPEDMLDAGDDSHVGVTSGYSSADEQYKLGFEVANRTGDLESMLIYTYRNGHETDTYYKDSNEIGNARKAANPFDIASHNALAKIFYQINGANRVGFTAEYYTRSADGRILSSDGKTVPMRPPMPPIMYSNNRADDHDHRLRLGLEHEWLAEIAAFDSLEWKLNWTESESKHNSYDKTNYYGNRNRYRDGTDDTIQLDIQMKKELELANNRHEITYGVSGTNNTFDITYTDYNLDKGTSKPGPEEVPKSKSEKRAVFVQDQMFMLDEKLVVTAGLRYDDYQAKPDSDTLKDHKSDAFTGRLGAVYHFTDNFSTYGQFTQGFRAPTIHELYYDKENLAHGYKVISNPNLKPEECDAVELGLRLNGHLGSVATSVFYNNYKNFIKDVTTYDSNNIQITTNENVDKAKIYGAELKTSIWLDEALNAPMGTYANFSVAYTRGEDKKTGRELDTVAPLTAVLGLGYDSPDEMWGGVVDVTMVATKDKWQEEDHFNTPGYTVVDMTTYYRPSKDLTVRAGLFNAFDKKYWQYQNIDGITVGKENINRKTEPGRNWGVNVKYDF

SEQ ID NO: 19225 - protein, 670 aa, Mannheimia succiniciproducens
MKKTLLAGVSATFALSLAATAAHAQSIDYGAMEQIFNEPVTTSATGSPQRATEVPVDMTIISAADIHRSGAIDIPTILSRVAGVDILPYAAGYSDVGVRGYDQARSPRLLVLINGRQVYFDHQGYTDWTSLPVELSEIRQIEVVRGPNSALFGFNAVSGVVNIITYNPKLDNVGAVTAYAGTHGAAGVSAVQTMHIGDRFFMRLSAGGRKQDQWKSTTPAVPASLIQDPQSTRANVDAIVQLAPKTELRLEGSYSNLAGTQVNSIYSFGHQRNQTHSVKATLSSDTGFGLLQAQVYQNHMDALTPGRRYVNRITVGSVQDLFKVGTNQTFRVGLEYRSNEMDTSPFAGGVVSYTVLAPSAMWNWAINDKVSLTAAARYDQLKLKRTGLLPPGYAFTNADWDRTISEPSVNLGAVYKVTPADSLRLTYARGVQAPTLFELGGLVFAPTGALGSGTINSGNPNISPSIVANYELAYDHDFAPLRARAGVKAFSQTTKDVKGSSYPTIIDVRPTPTTYGANLYQNVGDSKMVGFEASASGKFGKGFNWSADTTYTDVKNQPSVTDAALLLRRSTFAQFTPKYRSNLALGWTGGKWTTDGYLHHISKAMTLNGAALEPVAAYTTLASRVAYMAPMGIELAVSGQNLLHDRQAQAKGATGLMAERQVMFTVSKAW

SEQ ID NO: 19226 - protein, 359 aa, Mannheimia succiniciproducens
MKKTLVALAVAAFAASASAVTVYENEGTKVDFDGQLRLLLEEQATKEKGQSSTGGHTNLKNNGSRFGISIKHNINENLYGFGRYETRLDSNSKNAAGWGDVKTKYAYVGLGGYGHEISFGKQAVIGDSIGQAGFDKVYGVGTGGIKYSANNTNKKGFDILTSDSDSAINYTYTGIEGLTLGANYNVANERDKKTGEVNVGSTKSGFGLGAKYTAKIAESQSVTVAAGYTHDDYKSGSVNKKDKDGVYFGLKYVNAPFTVAVDGGHGVEKTGNVKEKIDFVRTGARFDVTPKSGVYGNYSYGTYKDKAYKATAHQFMLGADYKLHKQVVTFVEGRLIKNKDSNNKKVTDQALGVGLRVLW

SEQ ID NO: 19227 - protein, 1080 aa, Mannheimia succiniciproducens
MNFKDLLNKGANRCFAVVFLLCLLMSSRAMAQTVTLEGTVKDAAGLSLPGVNVLEKGTKNGTSTDFDGRYKIKLSNPKAILSFSFIGFKTKDVSAEGKTKVDIVLIEDSNNLNEVVVIGYGTAKKGDLTGAVSTISGNDLKKVPVANVAEALTGRIAGVQVTSAEGSPDADIRIRVRGGGSLTQDASPLIIVDGFPINSMNDISSSDIETMTVLKDAASTAIYGSRGANGVILITTKSGKDGKISVNFNMFYGMKTMANEIDVLSPEDYTKWQYEYAMLSQTGTKVPSDPTSYTKYFGNWQDHDMYNGLKGNDWQKQIFGRRGEVQSRDLGIRGGTDKLNYNFNYAHYDEKAIMLGSNYKRNNLALALKSKVSNKVDVGFTVRYSDTEIDGGGVNEQNEKSATDSRMRTIVGYAPIPVSGLTSDDVSGDGTDILVNPLRSIYDNNRQQFRKNFNMLGSFGWEIVDNLKFKVDLGLDNYNSLDYRFYGRSTYYVANTPASTLQGKPAMVITDGKERRFRNANTLNYDFKKIMGENHHLTALIGEESINYEVNTVTSTIHGYPSFFDFSQAKSLTSQGTPQAVDNYYNPDDRLLSFFGRANYDYKNRYILSATFRADGSSKFLPQNRWGYFPAFAAGWKISEESFLKGKSWIDLLKIRASYGEAGNNNIPVGQQTQIFQSIPTAWINGVTSVWAIPKTMPNPDLKWETTVTQNVGLDFGFFKNRLSGNFDVYKNVTSDLLINFPVPGSGYDYQYRNMGETQNTGFEATLNVVAIEKAKYGLNFSFNMGVNKNRINSLGVMSNFGAATNWASSQIGDDYLISVGSSLGTMYGYKNDGRYEVSDFDYVGGKYVLKSGVVATATTLVGDGSSLKPGDMKLKDVNGDGKVDLTDKTVIGNINPKSTGGFVINGNAYGFDLMAAFNWSIGNEVYNADKIEFSTANASGQYKNLNSTMADGKRWTNLDPVSGQLVTDPDALAALNANTTMWSPYMRTAIFTDWAVEDASFLRLNTLTLGYTAPEMFTSKLGVSKLRFYMTASNVFVWTKYSGSDPEVSTKRKNPLTPGVDSSPYPRSRQMVFGMNLNF

SEQ ID NO: 19228 - protein, 356 aa, Mannheimia succiniciproducens
MKKTAIALAIAGLAAASVAQAAPQENTFYAGARVGWSAMHHGVDRIADQFVTDGGLNRNSVTYGVFGGYQILNQNNFGLAAELGYDFFGKTKADAAGYHAAHGASLALKPSYEIYPDLDVYGKVGVALVRNMYKAETLSASGDAEKFNKTKASLILGAGVEYAILPELAARLEYQWLSKAGNLDSALEDAGYNGTNARYSPDIHSVTAGLSYRFGQGAAPVAAPEVVNKTFTLNSDVTFGFNKSTLKPEAASTLDGIYSEIAQVSSPAVAVNGYADRIGKDAANLKLSQRRAETVANYLVSKGVDSNAITATGYGSANPVTGNTCDAVKGRKALIACLAPDRRVEVQVQGNKQATM

SEQ ID NO: 19229 - protein, 726 aa, Mannheimia succiniciproducens
MTKHLPFQLARPCHLVTLLAAAFPCLAMAEPSLMLDSVVVTGSRVEHNSFDLPAAVDVVDASRIGADQARVNASEALASVPGITVQNRQNYAQDLQISSRGFGARSAFGVRGIRLVSDGIPASMPDGQGQAATFNLDRAERIEVMRGPMSAIYGNHAGGVIQMFTPDGKGAPSVEGAFSAGSYGTWKSDVSAQGEVGGVGYVIDASRFATDGYRDHSAAERDQTMAKLTFRPSQDGKLTLIANTFRQDAQDPQGLQWKEFQANPRGVAWDPGTNKNIYPALAYDTRKSIDHTQGGLTYEHRFGDQTVQVSAYAGQRSTTQYQSIPVSTQSVAYKASNVKQSGGIIDFDRDFAGLSGRWTGRFGLAGGRLTTTVGFDYEQATDDRQGYENYVGSGLVPNCISNICGVAGRLRRNEEDSVATFDQYAQAEWQGERWTFSGGLRHSHIAFKVDDRYIVAGNGDDSGRVSYDKTTPTVAALYRLTDSVNLYASAARGFEAPTFNEMFYSDAGGSFNFSLKPATSTHYETGLKAMLGNASRLDVALFEIKTQDELVVSSSSGGRTAYQNAGKTERRGLELALDSRWAEQLSSRLAYTYLDAHYAERFTASTGAVSAGSRLPGVAAQNLFGEVAWKHQSTGLHAAVEGIIRSKVYVEDSNLQKAAPGYAIANIRFGIDRKYGPLSLRGFLRFDNIFDRQYVGSVIVGDSNNRFYESAPGRAWLAGVSARYTF

SEQ ID NO: 19230 - protein, 384 aa, Mannheimia succiniciproducens
MKKTFIVAGILGAFAASAHAQSSVTLYGTLDAGLVYTNNQAGHSNWQQGSGTVSDTYFGLRGSEDLGNGLHAIFTLENGFNLNNGSLKESNTLFNRQAYVGLQSNQFGTLTLGRQYDSMVDYLAPLSAAGSGYGNNLAGHPFDNDNLDNSFSIKNAVKYTSANYAGLQFGGLYGFSNEANGFADNRAWSAGASYKNGPLNVAAAYLQLNNAGSNNTGGAISSGANGAAQLAAQTQRTYGVGANYTYGPATVGLLWTHTQLDNLQSANVGGTFINGLSGTNLHMDNYEINGRYALTPALALAAAYTFTDGKVSGSNGDGSPKWHTVSLQGDYSLSKRTDVYLEGVYQHASGELGNFGANVASINTLTPSSTQNQTAVAVGLRHRF

SEQ ID NO: 19231 - protein, 725 aa, Mannheimia succiniciproducens
MRFVKTSVPPGRFRRRGLRIPLSMLMYMATAPAAMAAAASPDVASAPPAASTAAPTELPAVAVQAAALADPTAGYRPRTSETASGIATKISDIPQSVAVVSSSVMQDQQARTLDDVLGNVSGITQTNTLGGTRDAFIKRGFGSNDDGSILVDGMRSPTLHNYLATIDRVEVLKGPASLLYGIQEPGGVINLITRKPEDTFHGSVSANYTSHRGSGTSFDLTGPIGEAGQVAGGTLAFRLTGEYNTARYWRSFGRQRDALIAPSLSWHDANTSIDVSYQYVDYTTPFDRGTVLVNGHPDDALRYTRYEEAWAQNSGEQETLRAKIEHRFSDEWRVRATYGWSRDRYDQYITRATAFNSKTGIMSRSSDANLQRNDSDEIATVGVLGNLKLGGMRHELYVGGEYERQRSFRGDTIRGKAVSGFDLFDPVYGQLSPGGTPSATQSDSLSKVHTYSVVTQDTVHLTDRLIAVGGLRWENWQQLSGVGRPFVIAGHSHGQVWLPQFGLVYRLTPALSAYANFSKSFVPNVATQVSEPLAPERGRVYETGLKFDAHGITGTLAVYQIDKNNVAVTVGDTTETVGSARSCGIELDVAGRVTQHVSVIGSYAYTNATDRDNGTRLVNAARHTGSVFAVYDTMLPYLPGQWRFGGGARLVSKRPGDTANSFTLPGYVVADLFAAYDTKIGKIPTHVQLNVKNVFDKTYYPSSNSNLIIAVGEARLVMLNTTFSF

SEQ ID NO: 19232 - protein, 686 aa, Mannheimia succiniciproducens
MCAVSIIAITPGIALAQAGGHGQGDIVVTAAPLGQKADETTTPVVTLTGEELIHRRAATLGETLAGQPGINFENFGGGASRPIIRGQSSPRVQVLSDSANVQDASAISPDHNVTGEPLLLRRIEVLRGPATLLYGSGAIGGAVNLLDEKVPTYVPEGGITGAAEGRLGTGDDERSLVGGATVGVGPLALRVEGVHRRSDDYRVPRAFGEDRVHGSYNDTSTFSVGGSWIGPDGYLGVAYTRQRNEYGVPGHNHDYESCHPHGIGLHCGSHGEEEEHDHDHDHEHDHEEEVPFVKLRSNRFDIRSDYNNPVPALEKVRFRLSFTDYAHDEIEDGEAENTFLNKAHDLRVELTHAPLGGLRGTFGIQQSGSRFQAISGGVTHTLNTDSSNTAIFLLETYSLGNVRLEAAARQEWQTVKSLITRYPSIKHKPFSASAAAIWSMGSDYSLALSLAHTERAPSVQELYAYGLHLATNTYEIGIVSGNSRLAEKVSQGVEKANSVNLTLRKTAGPTTFTIGAYHQDFDNYIYAQTLDQFEDFRLIRYAGAEATFTGIDGEVRHAFNDQFALSVFGDYVRAKLKNGGGDLPRIPAGRLGARGDAHVGPFTADAEYYHVFEQDRIAAFETRTPGYDMVNATLAYRLELGDKRSAELFVRGTNLTNELAYNHSSFIKAFSPLRGRNFVFGLRGAF

SEQ ID NO: 19233 - protein, 903 aa, Mannheimia succiniciproducens
MKKLALTFILVFAALASHAQATLTGTVTDGEMGGPLPGASVVVKGTTNGTTTDFDGNFTLEASTDSGVLVVTYIGFMPQEVSFSGSASLGTIQLMPNVEVLEGVIVTGVQDIARDRETPVAVSTVRAEEIQLKLGSQEFPEILNTTPSIYATKSGGGFGDARVNIRGFDTNNSAVMINGIPVNDMENGQVYWSNWAGLSDVTSAIQVQRGLGSSKLAISSVGGTINVITKSSKQTEGGSFGATVGNNEYFKSIASYSSGILENGFSASLLLSRTAGSMYADGTQFEGYNFFLGLGYTSGDHNLEFMVTGAPQWHHQRSFAPSIADYIQYSDNGVDPDRRYNSDWGYLNGKEFSFRRNFYHKPVISLNWTWDINEVSTLETSTYASFGRGGGTGEIGRSAGARQFDGRWKTANGLVDVDRIFAYNSGAPVMFDGSIVQREQTNGLYVNQGSGDRSDANGISRRASINSHNWYGVLANLTNQFSDQLTVDFGIDLRRYTGYHYRRVNNLLGGDAYLQTDNQNNDPNPLFFETYNANQPWWVFGDIDEEEKIDYYNTGLVNWMGVFGQAEYRFTEDIVGFVQGSLSNQGFAREEFFNEVPPEQTDYENILGGNVKGGVNWNIDANHNIFANAGYYSKQPLFDAVYINFSNTLNPNLTNEKITGFELGYGYRSSMFRANVNLYRTSWKDRFESVSATFNAGEPDEIRGSANLLGITQVHTGVEVDAQLRVADALTLTGMLSVGNWQYQDDVSATYFDAENNPIVIDGVEQQEILPLDGVKVGDAAQFTAFIGADYNILDNLSVDAGYRYADNLYAQFDATDVGEEGALKLPSFGLMDAGLTFSMPFLEKTMSFRLNVNNVFDKVYIAEADTNIFAEPGDDTFQGINTANRVFFGFGRTWNASLRFNF

SEQ ID NO: 19234 - protein, 311 aa, Mannheimia succiniciproducens
MKKAILPAMIAALLATSAQAATVYDADGTTADVYGRMQFDIKDDGTDSDGVGSARMGFKAVSFINSHVDAMARGEWQIAAENSKGSQFTARHLYAGFQGEEMGSLVFGQTDTAFYQVVGVTDMFNTYGYNVIDGIYRGRQEGQIIYSGEFSGFSVGASYQFQDKSKALDNSLALALGYQIQDVALKAGYSVEQYVTAEDKKNYGLSATYTMNDLYLAAVYAESKQDGVADFQGYDLFASYNVVAATTVYGGYGFKENTVTNTDTVDEVTLGAQYDFNAQLKTWIEYQADMVSATTADKHDDAVTVALQYNF

SEQ ID NO: 19235 - protein, 1089 aa, Mannheimia succiniciproducens
MKKTIFLILCILCSLGAMAQKKSITGVVTDASGESVIGASVVEVGTTNGVITDIDGKFTLSVDPNGKIRVSYIGYQPQVLDVKGKNSFNIKLKEDSEMLEEVVVTGYGGKQLRTKVTNSIAKVKDEALKVGLFSNPAQALSGAVAGLKVTQASGSPGAAPKVTLRGGTNFDGSGDPLVIVDGQLRDGMQDINPEDIESMEVLKDAGATAIYGARASNGVILITTKTGKEGRREINFKAKMGLSYVNNPYDFLGAKDYINVLRTGYSKSGFTTSDGEYVSIAPLGNLTSASPFGTGNTLNDKTIWNIMNKTADNAYLLQKGWQEMPDPLDPSKTILYKDTNPADYNLNNPAISQDYNINMSGGNDKGTYYAGLGYNRQEGLPIKTFYERYSFVLNASYKITDWLTSSSNFNYNRANWKNMPGSQTSEGNYFGRIMSTPPTVRFQDEDGNPTLGPVAGDGNQNYQPDKWWNFNQSDKFTMVQAFQIDILKNLSVKGTANWYYSESLAESFTRDYENTPGQFVRTRSSSASFSRNFSQTYNVVLNYNQTFAKDHNVAVMLGMEYFDRYSRSFSASGSGAPTDDFADLSLTDNGEGKRSIDSGHSDYRILSYFGRLNYDYKGRYLLSAVFRQDGYSSLLGDNRWGFFPGVSAGWIFGQENFVKNALPFLSFGKLRASYGVNGNATGIGAYDLQGSYNSQKYNGNVGFLIGALPNPGLKWEKTRTAEVGIDMSFFENRLNANFTYYNRLTSDKYANLSLPSTTGFSSIKNNNGKFRNSGVEIELSGKILKTKDWSWDLGGNISFNKNKIVSLPDNGLIRNQQDAAQIYSGRQLSDGTYEKIWVGGNQEGYEPGVLIAYKADGLYRSWDEIPGDLVVTSGNYFGKKMYGPEAWKKLSSAEQKNALPIQPGDVKWRDINGDGMIDNYDQVVVGNTNPHWIGGFNTTLRWKNFQLYGRFDFAFDYWIYDNTTPWFLGCMQGTYNTTKDVFNTWSEENPNAKYPRFVYADQLMNANYYRTSTLFAYKGNYLAIREISLSYSLPKAWANKAYCQKVDVSITGQNLGYITSANVASPEVSSAGSGYALPRTLLFGLNVTF

SEQ ID NO: 19236 - protein, 1071 aa, Mannheimia succiniciproducens
MKKLIYVTQITLFFLATVLFAQDRSLQGTVTDTNGMPLPGASVVVKNTTVGVVTDFDGNFTIAIPENENLLEVTFMGFKSQEVDITGKSEITIVLEEDAQSLDEVVVTALGIKRSTKKLAYAVQKVEGDDLAEAKETNVVNSLSGKMAGVRVTGGNSGVGSSSQIIIRGENSLNPSPNANSPLFVVDGIPINNNVNNAGGDGNMEVDFGNGAMDINPDDVEEMTVLKGPNATALYGSRGANGVVLITTKSGKGTKGIGVSFNHNSTFETLLTLPEYQNEYGQGSNGQFAFNDGGQNRSITGGVNDHVDESWGPALNGQLIPQHDSPTTSGFRAGDVNLRPRNADGTFADEIIATPFVAHPDNIRDFFETGFTMSNNIALTGANKDGNFRVSFTDLDSESIVPNSNFKRRTYAINGSYNLTDWLKVTASMNYINSNSDNRPNNSYGTENVMYLWIWFGRHINMNGLRDYWQPGLENVQQFNYNYNYHDNPFFTVYENTNAFNRDRVITNMRADLKLADGLDLMFRTGLDYSNELDMRKRAYSTQRFPNGQYREDYIFAQEQNTDFLLSYNKVLTEDLDFGISVGANHRVAKNRYQRISANSLSIPAIYNFGNAAEPLTTNDYDSEFRVNSAYAFGNLAYKNYLFLDLTARNDWSSTLPEDNNSYFYPSAGVSAILSDMFEMPEAISFAKIRGGYAVVGNDTSPYNLAATYGFGDTFNGFSRVYSPSELRNSDLKPEKTNSIELGADVRFFKNRLGLDVAVYQSTTKNQIISLPVSNTSGYSSRVINAGEVQNRGLEITLNATPVRTDNFRWNSSINFTTNRGEVKELTDGLDFYTIKSNYLTVGARVGERIGDLYGTGFRKVEDPNSQYFGQWIINPDSGLPIVDNELRKLGNYSPDFMVGFQNSFQYKNFNFSFLFDWRQGGEFHSRTVAIGGTTGMLDFTVPGRETGIVAAGVVENGDGSYSPNTQNVSASNYYSHVYNRSNEESSMFDATYVKLREVKLGYNLPKKWFNTVPFTSATISLVGRNLALWTENDHVDPESISFSGGTIVPGVEDMALPSTRSYGVNLNLEF

SEQ ID NO: 19237 - protein, 947 aa, Yersinia pseudotuberculosis
MKQNMYKMITTGLLCIAAVALKAQDAPIDSVDHTKSNTLGASSTVYTNDLIKYQSATILTGLQGRLKGLNVSPFRGMQLLRTDANTKSDIVGAIPNVGGGIYGDNSEFLISARGQSPVAIVDGVERDLYSIDPEAIESVTIQKDALSNMFLGMRSSRGALIITTKNPDAKGGFHLSLTGKFGISSALKSGPNPLSAYQYAYLLNEALLNDGKSPLYTYDDFEAYRNGTSPYLHPDVNWKDAIMNNSTTSQAYNLNVTGGGRVAQYFVSLGYYSENGLFKTSDANSYNTNFKYNRYLITSKVNINVTDEFKVSMSLMGRIEEGNQPGGISGTGYSDLLSNVWQTPNNAYPVLNPNGTYGGNASYTQNLYAQTTGSGYISSNTRDVVGTINLKYDFDKLVRGLSVGATGNISSQVRNAIVRTKQAQVFQYSITQQGNEAYDKYGDVSSQTNSYRSVSTYQYMYGKMYVDWERQFGMHGVKASLWGDTRTILNNYDLPMIPSNIGQKVEYNYDNKYFAQAAVTESYYNRYDNGRRWGTFWAVGLGWDISKEKFMEASKIDQLKLRATYGHTGNGIDNAGYFSYLKRYNEDGGFWYSNGTSMSNGGSVSEISPLANTLLTWEKGRKVNVGLDLTLLKNRLTLSADYYNDYYYDILQSRGKSIELLGIAYPAENIGKTRYYGLETQLSWQDHIGKVNYYVSANWSMEQNKRLFMDEQYVPYDYLKMTGQPTGTIYGLVATGFLTAKDIADGYPVMNGFNNIQAGDVKYKDMNGDGEINEFDRTVIGGDKPTCYFGIDLGFEWKGLEVTALIQGAYNRDLYNSDRTLLEGFQVIGQSYGQAYTNLLNRWTPETAETATYPRLTAGGNMYNYGNNWNSSLFVQNGNYIRLKNATVSYKLPENFCRNYLGGLRVKIFVQGQNLLTWSRTRLQDPEVTFTSYPLQRTITTGINLNF

SEQ ID NO: 19238 - protein, 765 aa, Yersinia pseudotuberculosis
MISGKILSTEKEVVDFATVYLKGTGYGGITNQEGIYHVSAPAGDYTLVVSAVGYKTVEKPVTLVRGQRVRQNVTITPETQQLDEVTVVSTGVSRVKRSAFNAVAVDTKELQNTTRNLSDALTKAPGMKLRESGGVGSDMQLMLDGFSGKHVKVFIDGVPQEGVGSSFALNNIPVNFADRIEVYKGVVPVGFGTDAIGGVINIVTNKKRRRWFLDASYSYGSFNTHKSNVHFGQTFKNGFTYEINAFQNYSDNDYRIDSPVEDFETGRIDRDKKVRVRRFNDTYHNEAVIGKVGVIDKKWADRLMFGFTYSNMYQDVQTGVRQDIVYGQKHRKGHSLMPSLEYNKRNLFAKGLDVVLTVNYNKNLTTNVDTASYKYNWYGERKPLNSPGEQSYQHSRADNNNWNGTFTANYRLGRVHTLTFNHVLNAFSRSNTSLLAKEEQSDAIAKETRKNISGLSYRLMPSEDWNLSVFGKYYNQFVAGPVATDANQNDYVRTTRSVHSVGYGAAGTYFILPGLQAKLSYEKAYRLPTIEEMFGNEDLEMGDIGIRPENSDNINLNLSYNKTFGKHSVYVEGGFVYRNTKDYIQRNITDLSGGKSAATYVNYGKVLTKGYNISARYGFGRWLSVGGNFTQMNVCDNMKTSISGSAENIAYKERMPNLPYIFADSDVTFYWRDLWKKGNALTVSYDNQYLHSFTYYSSKIGSNKGDYVVPSQFSHNLSLSYSLRSGRYNLSFECRNFTDEQLYDNFSLQKAGRAFYGKVRVYFGN

SEQ ID NO: 19239 - protein, 994 aa, Yersinia pseudotuberculosis
MKNSNRSPKNISRNFKHHKETSLSSKNKSPIATCVAAALFIFGSSSVIANPDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMLGDSNIHHLDILDSGRHDLNNPGKTGNQLIINGDYFSDNGTLIFHSQLAGDDSVTDHILIKGNTGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETSPPSNTPELTVPDPKRANAAAFSAKLADYALQTVGGVVDSFTQPETSPPSNTPELTVPDPKRANAEAFSAKLADYALQAVGGVVDTFTSPEQTEQTTATPDSTPKSTDSAVKPASTPKPTDLAVKPANTVISNAKTAAPKRQTLVHTPENGSYIANIAMARNLFTTRLEDRTSHYLYKDIVTGQWQPTSMWMHTQGGRSQFGHTVEQLNIKGNYYSVQLGGDIAQWATNEQGSGRIGMLAGLGKATNHSHSKVTSYHSRGAVDGYNLGIYATWFADQQHNTGVYIDTLAQYSWFNNAVNGQDKAEEKYKSSGFTTSIESGYTFNLANSDQLSYFIQPNAQITWAGINAQTHKTADGAVVSYRNNGHFITRIGAKAYLQTHDTLNTKFTPFVAVNWIHQNQNTGTTISGQGIDNKIQNSTEFNVGVESQIDQQLHIWANINHQIGRYNYTDTNALVGVKYHF

SEQ ID NO: 19240 - protein, 761 aa, Yersinia pseudotuberculosis
MNNHKIWRLSAVAVALLISGNGYADQTFHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEAYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGSASAYGIHVLNGSATINSSGRILATATGGSQQQAYEVMADGSVVNIERYTLALGDETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYIVSSNNSNYDLIDTRYSSYSNHAVALHAGVRLDGRYPLTNETLLKPFFNVGLQQMLYGDEITIDQSIPNSPVVGVSTKDKTTQGTFDLGMALVSDNGVSASLQLSGMVNSDRQDFTGWANLGWAF

SEQ ID NO: 19241 - protein, 4312 aa, Yersinia pseudotuberculosis
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASDIYIRSAGGITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLSASNLIINVANTLGTALQITDGIDNTTTIGNEIQLNAENATAINFLGSSSKTLNNNGTIKGSVIFAGVADHIINNNGTLDGTLTTGAGNDTLVLDSSSQSNDVINLGDGNNSVTIQNGATVSSIITGNGNDTFTINGMSVGSTYLGSLDAGTGLNTLNFNASTDELAAATSLQGFTNINLVDSHITLVSDDNIGSGMVNIDSSSELLFGSTFDGILHATLGAGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDVDALDLLVNGTAITSGTQGVQSAIQQGGSTVANAIHNYGLTSSNSNGDSGLYVNYTLSALELLADGADALLLATESGLTANRVLNAELFGVGGLVVDAQNGALTLANGNNSYEGTTTVNFGELILGANGAFGQTSLLDIASGASANINGYRQTVGAVTNTGTVTLGSGGVLTSGLLTNGGVLDLTGGALNLTAGGTSTVAGGLTGAGTLNINGGNLAVSAANSGLSGQTHIADVASVTMTGTGTLGTSAVEVLGTLNLNGANAAMTNVLSGDGTINTNAAVTLSGNNSFSGAHQIGASGALTVGQASNLGASSATVNLGTLTSHLILNGVSESIANVLSGVAGSTVDIIGGADTALTANNSGFLGQYALAGNSKLTVGSTNNLGASSSVTLAGADDTLSLSGFNGTFGNSVTGSGVLQVTDDAEVTLTSSNGVGNTVKVDIADATLNLDDIALFDHVLTGNGTLNVAKSLATTAFDFGSTVGGAFSGIVNLTNTTFALSADNAAALASATLKLSDDSVTTVGTTDRTLHGLDLTGGTLIFDGSPPQSQANGVVTVTDLALNSGTVSITGVGNWENESPVTSPNVSILEQDRAGTTLELINATNVTGDVDALGLMINGTAITADSQGVESAIQQGGSTVANAIHNYGLTSSNSNGDSGLYVNYTLSALELLADGADALLLATESGLTANRVLNAELFGVGGLVVDAQNGALTLANGNNSYEGTTTVNFGELILGANGAFGQTSLLDIASGASANINGYRQTVGAVSNTGTVTLGSGGVLTSGLLTNGGVLDLTGGALNLTAGGTSTVAGGLTGAGTLNINGGNLAVSAANSGLSGQTHIADVASVTMTGTGTLGTSAVEVLGTLNLNGANAAMTNVLSGDGTINTNAAVTLSGNNSFSGAHQIGASGALTVGQASNLGASSATVNLGTLTSHLILNGVSESIANVLSGVAGSTVDIIGGADTALTANNSNFLGQYALAGNSKLTVGSTNNLGASSSVTLAGAGDTLSLSGFNGTFGNSVTGSGVLQVTDDAEVTLTSSNGVGNTVKVDIADATLNLDDIALFDHVLTGNGTLNVAKSLASTAFDFGSTVGGAFSGIVNLTNTTFALSADNAAALASATLKLSDDSVTTVGTTDRTLHGLDLNGGTLIFDGSPPQSQANGVVTVTDLALNSGTVSITGAGNWENEHPVTPPNVSLLEQDRGDILLELINAANVTGDANDLDLMVDGTAITADSSGVQSAVQQGGSTVANAIHNYGLTSSNGNGGSGLYVNYTLSALELLADGANALLLATESGLTANRVLNAELFGVGGLVVDAQNGALTLANGNNSYEGTTTVNFGELILGANGAFGQTSLLDIASGASANINGYRQTVGAVTNTGTVTLGSGGVLTSGLLTNGGVLDLTGGALNLTAGGASTVAGGLTGAGTLNINGGNLAVSAANSGLSGQTHIADVASVTMTGTGTLGTSAVEVLGALNLNGANAAMTNVLSGDGTINTNAAVTLSGNNSFSGAHQIGASGALTVGQASNLGASSATVNLGTLTSHLILNGVSESIANVLSGVAGSTVDIIGGADTALTANNSNFLGQYALAGNSKLTVGSTNNLGASSSVTLAGAGDTLSLSGFNGTFGNSVTGNGVLQVTDDAEVTLTSSNGVGSAVTIDIADATLNLDDIALFNHALTGNGLLNVAKNDASTAFDFGSTVGGAFSGIVNLTNTTFALSADNAAALASATLKLSDDSVTTVGTTDRTLHGLDLNGGTLIFDGSPPQSQANGVVTVTDLALNSGTVSITGADNWENEHPVTPPNVSLLEQDRGDILLQLIDADNVTGNANDLELMINGTTITPGQGVQSTVQQGGSTVANATHNYGLTSNGGSGLYVNYTLSALELLADGANALLLATESGLTANRELNAELSGVGGLVVDAQNGALTLANGNNSYEGTTTVTAGELILGANGAFGQTSLLNIASGASANINGYRQTVGAVTNTGTVTLGNGGELTSTDTLINTGIINVTDGILNLENGGTSSISGGLTGNGILNIKGGDFTISIDNNGLAGQTNIADGASVTLGNGGTMLGTGNLGSSVIDVLGDLNLVADNSLANVISGDGTINTTATVTLSGNSSFSGAHQIGTNGELTVGQASNLGASSATVNLGTITSHLILNGVSESIANVLSGVAGSTVDIIGGADTALTANNSGFLGQYALAGNSKLTVGSTNNLGASSSVTLAGAGDTLSLSGFNGTFGNSVTGNGVLQVTDDAEVTLTSSNGVGSAVTIDIADATLNLDDIALFNHALTGNGLLNVAKNDATTAFDFGSTVGGAFTGTVNLNNSTFDLSGNNTTALAQVTLKLSSGNLTSVGNGVQNIGTLAMNGGTLLFDNIVDNSGIITSDGTIAANSIDTTGGGEVRVNLPNNLAPSLDGLSVMELDEGEIIVTLATGTATGTGHELTLTDENGDPISAVTYQGVHNAGSTSAAATGSFNYGMTTGEDYDGLYVNYGLTALELLSTGSEALVLTATLANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNTGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILNTGSVWELTNTISGTGTLVKRGSGTVKIEGDTVSAGLTTIEEGLLQLGSSAVTQTLSLEESLQEDALLVSFASNMANLTSNVLITANGSLGGYGQVTGNVENHGNLIMPNALTGGDFGTFTIDGNYTGDEGMITFNTILAGDTSVTDRLVITGGTAGQSYVTVNNIGGVGARTFEGIKIIDVGGDSAGQFTLNGRAVGGAYEYFLYQGGASTPDDGDWYLRTQADDRRPEPASYTANLAAANNMFVTSLSDRMGETLYTDVFTGEQKTTSLWLRNEGSHNRSRDDSGELHTQDNRYVMQLGGDVAQWSRNAQDLWRVGVMAGYANSSSSTVAKVAGYRSTGSVDGYSVGIYGSWLADNADDTGAYVDSWVQYSWFDNNVSGQDLAAEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQINNQLNLWGNIGQQVGNKGYSETSVVLGVKYNF

SEQ ID NO: 19242 - protein, 1259 aa, Yersinia pseudotuberculosis
MYIQFREPISTSPAQPDAGHRHLFSCAPAAAINPITLAIIVAFSALVLPQTARASCNSSGVGTYVCEGENHAGIILSGTDIAVETQPGFSITEPGGADPALSLIGSGVISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSTTYLTVVGQINASNGEGITLISQATDGSTLVNIDVNNIASEYDAIYLHNSVTGADNGTSTIDLITRGALVSQQGYGINIETNTADTYVTVGGLVHGGNGTAIGIHRLENVQKSATLELQSGYALEGVTQALVFTGSYAEINDAALDLANSHLVLGGAGDAAFDLTRIDNREEAILDGDPNRITGFGTLTKTNNSIWTLTGSNMADGDANAFLSANIAGGILVLDNATLGLTPDAGALTGPTVNRLSAADIAADPTLVATETGALTLGEGGALSSLGDSVLSGNLISAGGILLSNHYTGGNGTATDDRLTVTGTYLGENNGSGEGAWLTLDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQDGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHFDLHNEFLNGSKVQVSGVEFATRDERQSVGLGAGGTYEWQNGRYAVYGNVNLLGATRNVSDNYAVGGTIGARVSW

SEQ ID NO: 19243 - protein, 802 aa, Yersinia pseudotuberculosis
MFMLYKFVVLSCFLSDAVRKYLLILKNTTQHITLKIRFLNSNVIFNFYKSFIRILLFIITLTLDGQESTLPTLKEEDKKTSEKENGIMVQGKKDKRDIEIFKTPSSISRFNEQDILDKGISRTNDIDKQVPNFAIIDSGARNFTYYNIRGMRSTLFSDPSVGLIVDGVPLVDNVALNTELFALDSIEVHRGSQATVFAKNFQGGVIEINTKKPNNMPQGRFMVDWGNYKKKEYSFFYNTPLIKNKLYISISGKSTQRNGYLNNVSGFNYPNNLVSDIPIEVHKTHPDGRRGKSGRLRLFWTPLENLEVDLQTNAESFDDGSLNIVNYLASKTERRKSLVKGCVVSPEVCDKNIRTYINRTKAVRKVFWDYEGVSNTTGKTYSSNITYKLPKAIFKTVYSIRKMEIDPLIVDGDFTRSPVIKSEYIEHSTTRTHETSIESKNKKEPLQFKIGTLFYHKISDKEFIQERLMQAYTYNVLKGLNAPAKEIHHSRVVDKSFSFFTHNSYTFWEKFTLTLGARIETQKIGIGHSRDARGVLFDNPYGDVRILSPHYVRNDSYRYNVSRIIFDYKPIESLMIFIGLSRGYKNGGFSTVVNQPSLAAFKPEINDTLEVGIKSKYFNETLGMNLAYFYTETADFHVIRAISIAEAINLNAEKVTIRGAEMEAYLKPHKSLQLGFLAGYTEGIFNKFYDRILNTNFDGKHVHFIPQYDVVSYLQYRSSPGLFFRYEFQVVGKMYFAADNTIYSSPYAITNLKIGYEEERLSAYLYCNNINNEYYFTSYIDGTFQAVPGAPRTYGFIVNYKI

SEQ ID NO: 19244 - protein, 706 aa, Yersinia pseudotuberculosis
MNKINISLAASVLLLTQIYAADVKLEGVEVTESADDGYRAKTSEVGKTTTPILEIPQTVNVVTQQQLKDKKPETLAESLQNVSGISYGNTTGGIFDAIIKRGFGGGRDGSIMRNGVPATVMHSFNKSVESVEVLKGPASLLYGAQEPGGIINMVTKKPKYEFANEIWAGVGNRNYWNAGFDTTGPIGESGFAYRFIFDAMQKDYWREFGDYKNYLFAPSLSYKGDDYRINFAYTHTRSTDPIDRGMYLIPATGQLLPIGKKVRLDEPFNKLKTTLDTVDVNFEKNIGEDWLLRGAYAFSRTKHEYGHIRLMNVNLTTGIATRRNEYYDGFIHRTHAGSLNLNGYVKTGEIEHNLLFGLDAKEYYRYRPGGLQATGRQFDINIFHPIYGRVGLPTARQSSIQYQKLKTIGAYAQDSINLTENLIYSIGLRYEYYDQLARGTTTGKPTTDQKDGKFTWQTGLLYLLTPEWSIYTNYAQSFQPQMAISGDDIGDIKPEEGKSIEFGTKFQNDNITASAAIYNIDKKNIMRTVNSVSTPVGKARSKGFEFDFNGRVTQGLTLGASYAYTKTEVRQDSGAFAVLVGKPLEATPKHQASLFANYDFSHLGVKGLRVGGGARYFGSWYTYYMRTNLANVPAGTAFKMPDAVVYDAFISYDTKIAGLETNFAFNVKNLTDKLYYTSSSTGTTANIIPIQPGYARQFMLTATVKF

SEQ ID NO: 19245 - protein, 998 aa, Yersinia pseudotuberculosis
MKSRHHLNTRLLPLSILISALIPAAVLAAPSVAIPPPVQDLINQVQSYANAHVISPEQAETLIKRLTVTPEKLKEEEARVKQELAAVEKKQKEANTEIITTSIEKDQFNKALNNKQKAKLAAETVFINANSKQNEAIKAVNKNWSLADENISTKLSVIVNGESKTQAILAEKIKLTETANINQQEQVIKAQQLDTEIQKNQSELDDAINNKTTGTIVLQEKLTQAETKLETAKNNPKSKLSLAEAKHKRTSKNLKNPKKQAKSEALRNQKDYERELKNLQTPITTATEELKVSQEKVEVLTQEKALISTKKIASDAITDNLQGEINRAQQAQLQAEQDAQQAKDATLAQQAMAKAAAAEKSLQEAEQKLAAIAVIAQEAEAKLTAAQRAKADAELQLADKMEQLANINLDLTALNNLDPKVISQQTLAKGEAQPVADGELAVATKVAGGEQNITTGGVVLASVVTEDGVVNLSDSALAHDSQLINGTLNNTRAHDVNTQVGAQGKLLINGTQEAAATSEGATVAAGGSVTAGTNTLVTKMVSAGTVTGNDGALFTETTLNDGQFSLNNGAIAQNTKVNGGQFNVNEGATAEGVTVKGGEFNLRARAQAMKLTIEFGEAQIAGTLTDVTLRGGNTTLASTADVAGTIHSISGSALKVYQGAHTAQADLNLAGRVVLFADDVAPAAALPSRAVRAADNRLSAPFTFRRVNMSGGTLDLRNVKKAQLVMDSLAGNGTFKLGSMLQQDASAPVNVTGNADGDFILQIDGSGIDPTNLNVVSTGGGDARFTLTDGPIGLGNRVYNLVKDASGKVTLVANESTVTPGTASILAVANTTPVIFNAELSSVQQRLDKQSTEANESGIWGTYLHNNFAVKGRAANFDQTLNGITLGGDKATALADGVLSVGGFASASTSSIKTDYQSKGNVDSHSFGAYAQYLANNGGYVNGVVKANKFNQDIHVTSADNSASGNTNFSGMGVAVKAGKHINHNHLYVSPYVAIERL

SEQ ID NO: 19246 - protein, 629 aa, Yersinia pseudotuberculosis
MKSRSLRRCAGVLACVAPLAGHAQAGAAAGQPIPELDPVVVTAARSPQLLKNVLADASVIERDTLARAGQSSLAEVLAQQHGIEFADSGGPQSVTSLFMRGANSNQTLVLLNGQRINNANGGGIALNALPPEAIERIEIMRGAASSLYGADAIGGVINIITREPGDKALSAYANAGYGTYGTSRYDAGVSGAADGFSYSLSTGYGQSHGFNATNRRSFSYNPDKDSYYQNYATGTLGYEWRPEQKVVAQVYRSRINGGYDASASYDYNDRYIQDLQAYSLASENRLTRYWKSTLRAGYVEDKNDSRAEGMFEDNNTRFRTRQMQYLWQNDFTLAAGQTLTLAYEHLDQRADGQMSTATGIGNYTETRRHVNSYTGVYLGDFGRHHVQASLRNDNNSQFGSHTTGGLAYGFDLTPNLRATVAANTGFRAPSFNDLYTPTSAFGYRGNPDLKPEESRNAEIGLKYQDEDSELGVVYYQTRIKNLIQVTEDFSTVENVGRARLQGFTISGAHRFGNTRLRASLDLSNPRNEDTGKQLLRRARTVLRAGIDHRFDRLLVGAEWYASDERYDYGFPEEKRLGGYGLVNLTAAYDLSRNMQVQVRWNNVLGQRYTLADGYNTAGSNAFVNPSWRM

SEQ ID NO: 19247 - protein, 963 aa, Yersinia pseudotuberculosis
MKNSNRSPKNISRNFKHHKETSLSSKNKSPIATYVAAALFIFGSSSVIANPDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMQGDSNIHHLDILDSGRHDLNNPGKTGNQLIINGDYFSDNGTLIFHSQLAGDDSVTDHILIKGNTGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETNTPSNTPELTVPDPKRANAEAFSAKLADYALQAVGGVVDTFTSPEQTEQTEQTEQTEQTEQTEQTTATPDSTPKSTDSAVKPASTPKPTDLAVKPANTVISNAKTAAPKRQTLVHTPENGSYIANIAMARNLFTTRLEDRTSHYLYKDIVTGQWQPTSMWMHTQGGRSQFGHTVEQLNIKGNYYSVQLGGDIAQWATNEQGSGRIGMLAGLGKATNHSHSKVTSYHSRGSVDGYNLGIYATWFADQQHNTGVYIDTLAQYSWFNNAVNGQDKAEEKYKSSGFTTSIESGYTFNLANSDQLSYFIQPNAQITWAGINAQTHKTADGAVVSYRNNGHFITRIGAKAYLQTHDTLNTKFTPFVAVNWIHQNQNTGTTISGQGIDNKIQNSTEFNVGVESQIDQQLHIWANINHQIGRYNYTDTNALVGVKYHF

SEQ ID NO: 19248 - protein, 736 aa, Yersinia pseudotuberculosis
MNANADSCIDYTVTDICEQSKYAAGEFHNIKLGDGVTAGSEDHHFVFNGEGYELYNSNANFSAQIASGTIRYTEVNNSYFTVNAHHFPDDTIYAGRAENTTLNDSLMWVATSADQTLAKGNSMVVVSTQMAMVDQIFVTTLNDGSLPFDPVITNSRYEDTSYEMLWGMKNEAKGWDTKATSHDSVFVDASKQSIEANGHSIGATFYGRATQVVKAGGESQDTHLFDHSYSWVYAEAKLTGLTEVNDAATVYLNAAATQGAYAENVVLNGEDTTLMVRASLDNNAYATVDNLILNGGEVVFQQSSGDQYASLNIGTLSGSGSFLFNTSIAEGKGNFVTIANASGEHKVIVNDSGHEITSPDMTTLDLIHDLSGDATFTLASISGANIIEVDGGTYVYSLNTWDNSARAGGNLWYLGSGLNTGTELEPEPEEKTTPSTDAVLSMASSNQFIFDGEMQNLRFRKGDLNNNKGDGASVWGRYLTNNTRVNAAHDAAYRLQQDGFEIGADKVLEMSSGQLVLGGFTSYSNNRVKHARGGNSTVDSYSLGAYGTYFDNSGYYVDAVVKANRFKNSLNAHMTNGGSVQSDYNQNAIGGSLEAGYHYSLSNNWFVEPYVRTSYYTAQDKDIALNNGMTANIDNNRSAKGEIGTHLGTKIDLNNGAIIRPYAKVAIEREFIKSNTVTINQVNDFNNDLSGHTAKYGLGMDINLMKQTSVYAEANYRNGTHVESPIMANIGFRINF

SEQ ID NO: 19249 - protein, 360 aa, Yersinia pseudotuberculosis
MMKRNILAVVIPALLAAGAANAAEIYNKDGNKLDLYGKVDARHSFSDAAGQDGDKSYVRFGFKGETQITDQLTGYGQWEYNIQANNAEDSGAQDGNATRLGFAGLKFAEFGSFDYGRNYGVIYDVNAWTDMLPVFGGDSISNSDNFMTGRSTGLATYRNNNFFGMVDGLNFALQYQGKNDRSDIKEANGDGFGIGSTYDLGNGINFGAGFSSSNRTLDQKYGSTAEGDKAQAWNVGAKYDANNVYLAVMYAETQNLTPYGFYDFTIAKKTRDIEITAQYQFDFGLRPSLGYVQSKGKDLNNVDANHDLVKYVSVGTYYYFNKNMSTYVDYKINLLDKDLFTEVNRIMTDDVVAVGLVYQF

SEQ ID NO: 19250 - protein, 304 aa, Yersinia pseudotuberculosis
MNKDWQSKLQVEINDEKQNAQFKDLYVKYKGLKWAELMIGKAKEPFGLEMIASTKFLAPIERATISDAFAPSRSYGITLLTQIHQATFAGGIYAEDPDEGHQETFALTGRITYAPIMTQNATLHLGIAGSYRDLGGNAHQIKKTAEVHLAHQLITSQEITTNNVNLLGVEAAAIFGPFSFQTEYMSVHIDTESNSDYQPANYDGYYAQASYFLTGETYSYKKGYLDKFIPSSAQNVWQLFTRFSHIDTIGNEAGVEADNMTFGVNYYPNLQIRISANYIMTDITNADATEDDGKAFSLRFQYLF

SEQ ID NO: 19251 - protein, 374 aa, Yersinia pseudotuberculosis
MITMKLRVLSFIIPALLVAGSASAAEIYNKDGNKLDLYGKIDGLHYFSDNKNLDGDQSYMRFGLKGETQITDQLTGYGQWEYQVNLNKAENEDGNHDSFTRVGFAGLKFADYGSLDYGRNYGVLYDVTSWTDVLPEFGGDTYGADNFLSQRGNGMLTYRNTNFFGLVDGLNFALQYQGKNGSSSETNNGRGVADQNGDGYGMSLSYDLGWGVSASAAMASSLRTTAQNDLQYGQGKRANAYTGGLKYDANNVYLAANYTQTYNLTRFGDFSNRSSDAAFGFADKAHNIEVVAQYQFDFGLRPSVAYLQSKGKDIGIYGDQDLLKYVDIGATYFFNKNMSTYVDYKINLLDKNDFTKNARINTDDIVAVGMVYQF

SEQ ID NO: 19252 - protein, 1272 aa, Yersinia pseudotuberculosis
MHIQFREPISTSPAQPDAGRQHLFSRVPAAVMNPITLAIIVAFSTLVLPQTAWAACNSSGVGTYVCEGENNTAISLFGTDIAVETRPGFGITEHEIMDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNYNYNYNYNDNYATGVDDGTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGTGDAAFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 19253 - protein, 294 aa, Neisseria meningitidis
GVETSRSVEHKGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVATAGG

SEQ ID NO: 19254 - protein, 283 aa, Neisseria meningitidis
GVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDNVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 19255 - protein, 295 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHRVQEDINIEKYQIHRLVSGYDNDALHASVAVQQQDAKLVEENYSHNSQTEVAATLAYRFGNVTPRVSYAHGFRGLVDSADYTNDYDQVVVGAEYDFSKRTSALVSAGWLQEGKGKNKFVSTAGG

SEQ ID NO: 19256 - protein, 295 aa, Neisseria meningitidis
GVETSRSVEHNRGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVKDNYSHNSQTEVAATLAYRFGNVTPRVSYAHGFKGSFDYADLSNDYDQVVVGAEYDFSKRTSALVSAGWLQEGKGENKFVSTAGG

SEQ ID NO: 19257 - protein, 293 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNVGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKSENKFVATAGG

SEQ ID NO: 19258 - protein, 293 aa, Neisseria meningitidis
GVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGG

SEQ ID NO: 19259 - protein, 300 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRH

SEQ ID NO: 19260 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGLFDDADLSNDYDQVVVGAEYDFSKRTSALVSAGWLQEGKGENKFVSTAGG

SEQ ID NO: 19261 - protein, 295 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSLQYALNDNAGRHNSESYHAGFNYKNGGFFVQYGGAYKRHHRVQEDINIEKYQIHRLVSGYDNDALHASVAVQQQDAKLVEDNYSHNSQTEVAATLAYRFGNVTPRVSYAHGFKGLVDSADLSNDYDQVVVGAEYDFSKRTSALVSAGWLQEGKGESKFVSTAGG

SEQ ID NO: 19262 - protein, 295 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIDNEYDQVVVGAEYDFSKRTSALVSAGWLQEGKGENKFVATAGG

SEQ ID NO: 19263 - protein, 297 aa, Neisseria meningitidis
GVETSRSVKHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 19264 - protein, 299 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALVSAGWLQEGKGENKFVSTAGGVGLR

SEQ ID NO: 19265 - protein, 294 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 19266 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNNNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 19267 - protein, 317 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTNPATNGKKLEQTQVAATAAYRFGNVTPRVSYAHGFKAKVNGKKAARYQYDQVIVGADYDFSKRTSALVSVGWLKEGKGVNKTEKTASM

SEQ ID NO: 19268 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRVGNLNTVLKDSGDNVNAWESGSNTEDVLGLGTIGRVETREISVRYDSPVFAGFSGSVQYVPRDNANDVDKYKHMKSSRESYHAGLKYENAGFFGQYAGSFAKYADLKDNAERVAVNTANAHPVKDYQVHRVVAGYDANDLYVSVAGQYEAAKNNTGTVGKQGKKHEQTQVAATAAYRLGNVTPRVSYAHGFKAKVNGVKDANYQYDQVIVGADYDFSKRTSALVSAGWLKQGKGAGKVEQTASM

SEQ ID NO: 19269 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRLGNVTPRVSYAHGFKAKVNGVKDANYQYDQVIVGADYDFSKRTSALVSAGWLKQGKGAGKVEQTASM

SEQ ID NO: 19270 - protein, 316 aa, Neisseria meningitidis
EVSRVKNQGVKTKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENADFFGQYAGSFAKYADLKDNAERVAVGTTGAHPVKDYQVHRVVAGYDANDLYVSVAGQYEAAKNNDGTANQGKKHEQTQVAATAAYRFGNVTPRVSYAHGFKAKVNGVKNASYQYDQVIVGADYDFSKRTSALVSAGWLQEGKGKNKTEKTASM

SEQ ID NO: 19271 - protein, 680 aa, Escherichia coli
MNKIFNSFLLISISISLTLAKESSYELNAISVVGSIEKGNQSIDYLSPKSVSIINSKQIQEEGAEQLDEITRYESGFISQIYGADLDTTDWLKLRGFDASLVLDGTAIYKGGYFGWSPDLYGLESIEIIKGSNSLSYGSSQSGGVINLVSKRPQKTPVAEIGGKIGNLSQNGLFLDIGDKAFNTNSNFRIVGNYFRQNGQLNGTWQEHYYFAPSLAIDMNNNTFLTLLSSFQYDQGVPTTGFFPVYGTIINTPQGTIKPNVNLGSPFSDYLKRKQYSLGYEFIHYFDDELSFMQNYRYNMENKNQFATSFSALNQNNPNTATRNSIILDGIARSHTLDNRFILKNIYKKLENTLIGGVDYQYIYVNGKYGYGSASNINIFNPDHTPQIKSKVPTYLVKQSQLGLYIQNKSKLYDRWILDLGMRFDKAKSNAKSFGSESNYNINHATFQTGLMYIFKDLGLMPFISYSEAFRPIAGNDGKGKDYKPYESRQHEIGFKYLPYFIDGELNFSYFDIQEKNALVNANPSASIPVSIQAGKQSAKGIELSSNIALNENINYALSYTHYFQTHTSLNALKIIRTPMIPKDVFGTKISHTLGIDQKQNFKSGFGIRYVGSSTDEAGNAGIKVPSYILYDLAFGYNYNKWNAQLNINNIFNKKYVSGCYYSCYYGEGIKGILSISYKY

SEQ ID NO: 19272 - protein, 724 aa, Shigella dysenteriae
MRINKILCPLTALLVGLNSQVSVAKSSDDNDETLVVEATAEQLLKQQPGVSIITSEDIIKNPPVNDLSDIIRKMPGVNLTGNSASGTRGNNRQIDMRGMGPENTLILIDGVPVTSRNSVRYSWRGERDTRGDTNWVPPEQVERIEVIRGPAAARYGSGAAGGVVNIITKRPSNDWHGSLSLYTNQPESSDEGATRRANFSLSGPLAGDALTMRLYGNLNKTDADSWDINSSAGTKNAAGHEGVRNKDINGVVSWKLNPQQILDFEAGYSRQGNIYAGDTQNSSSSAVTESLAKSGEETNRLYRQNYGITHNGIWDWGQSRFGVYYEKTNNTRMNEGLSGGGEGRILADEKFTTNRLSTLRTSGELNIPLNTLVDQTLTVGAEWSRDELDDPSSTSLTVDDSDIGGISGSAADRSSKNHSQISALYIEDNIEQVPGTNIIPGLRFDYLNESGGNFSPSLNLSQELGDYFKVKAGIARTFKAPNLYQSSEGYLLYSKGNGCPKDITSGGCYLIGNKNLDPEISINKEIGLEFAWEDYHASVTYFRNDYQNKILAGDNVIGQTASGTYILQWQNGGKALVDGIEASMAFPLVKDRLNWNTNATWMITSEQKDTGNPLSVIPKYTINNSLDWTITQAFSASVNWTLYGRQKPRTHAETRSEDTGGLSGKELGAYSLVGTNFNYDINKNLRLNVGVSNIFDKQIYRSSEGANTYNEPGRAYYAGVTASF

SEQ ID NO: 19273 - protein, 1355 aa, Rickettsia sp. 48
  misc_feature (1341)..(1341): Xaa can be any naturally occurring amino acid
NVNLEQAGVPGIVTGDSLTYVVQAGGPFTATATGGNDDAANPTVLFGSISVLQNGVFAVDGADIAIGSVSGTAGQLLTITLASGNTLTLNGAPGVAAFPVNTYTNVGPVNFADAAAVFKVSLAANGADGTKTAIFGNTATFNGAAPGQGTINIDANNIAIFNGTIGNTNGIQAIMLGANAQATLNANTKLDGAVGAGGITLGNAAILNVADGVNITGITANANISIDGAGVNNGTVNFLGDSTVSTDIGANKSVAAVDVASELTFQGGNGGTFTAQAINLTGADSLIKFTTRAHSTVTGNILITTDKQGIIDASAVTNNQTLTISGKIGVVDIVNNPATNNKSLGQLNVGSSKTILNAGDAAIAELVIGNNGSVQLGHDHYLIAKTTNAAGQGKIIVAANTGAGDTTLMAGTNLGSVAAPLSEVNFAAPVVNKGIQLIFGKNVNLYANNITTTNPNTGSFVFGAGGTNIVSGTVGGQQGKKLNAVTLGNGTTAQFLGNAIFNGATTIEAASTLQIGGNYTAGKVESADNTGIVQFVNADDITVTLNKQAGAVDALKQITVSGPGNVVINEIGNAGNDHGVETDTIAFTEASLGAAIFLPSGIAFDGLTITSTVKNGPAGDFDAPFVVVSGVDSTIANGQAIGDQNNIVGLGLASDNSITVNATTLYAIATTEDNQGTVTLSGGVPNTPGAIYGLGLENGTPKLKQVTFTTDYNNLGSIIATNAIINDGLTVTTGGIAGKDFDGTITLGSANGNSNVRFVDGTNSTSTSTVATVKANNGTVTYLGSASVGNIGAANTPVASVQFTGPAGSLEKLLGNIYSTATNFGNVNLNVAGSNVILGGGTTAINGNINLVTNTLTFASGTSTWGGNTSLTTDLTVSNGNIGHIVIAEGAQVNATATGTTTINVQDSANANFSGTQTYTLIQGGARFNGTLGDPKFNVTGSNIFVKYGLIRAANQDYVLTRTNDATNVVTTAIGNSPFAGAAGIGQNVATFLGATNTAAYNNMLLAKNTKDAATFVRAITTNTSAAVTNAQLDVAKDIQAHLGNRVNAVRYLGTAEMAGPEAGAVAPVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGNYNNMTFGGNLTVGYDYNAMEGLLVTPMAGLSYLKSSDENYKETGTTVANKQVNSKFSDRTDLIVGARVMGGTMNFSDLAVYPEAHAFVVHKVNGRLSKTQSQLDGQVTPFISQPDRTAKTSYNLGLSASIRPDAKMEYGXGYDAQIASKYTAHQ

SEQ ID NO: 19274 - protein, 1585 aa, Rickettsia sp. mmx79
  misc_feature (689)..(689): Xaa can be any naturally occurring amino acid
  misc_feature (1577)..(1577): Xaa can be any naturally occurring amino acid
NVRLEQAGVGTGIVTGDSLTYVVQAGGPFTATATGGNDADDHPTVLFGSISVLQNGVFAVNTKADIDIAIGSVSGTAGQLLTITLASGDTLTLNGAPGVAAFPVNTYTNVGPVDFANNAAVFKVSLAANGADGTKTAIFGNTATFNGFAPGHGTINIDANNIAIFNGTIGNTSGIQAITLGANAQATLNANTKLDGAVGAGGITLGNAAILNVADGVNITGITANHNISIDGAGVNNGTVNFLGDSTVSTDIGANESVAAVNVASELTFQGGNDDNGSTFTAQAINLTGADSLIKFTTQDHTVTGNILNTSGTNNQGGFSVNGADVTVTGNIGANGNSLATINFETDYVLTVHKAAANAMNALFVQNVNTAAPNTGTLKLHGTAFAINGNIGGNNALKLVALENDDNDGATNFTLKQGNSIKAQNIRLADVQDNTLTLEEGTTITGDIVNIKGAGNGTIALTGNATINGGIGVDVAAGGNRGTVIKNINLGGKNLSYGGKSIQIVNVPANGITFAANETLTLTNATDPIAINSNILITTDKQGIIDASAVTNNQTLTISGTIGVVDIVNNPAPNNKSLGQLNVGSSKTILNAGDAAIAELVIGNNGSVQLGDDNYLIAKTTNAAGQGKIIVAGETILMAGTNLGSVAAPLSEVNFAEPAVNGGMPSMCARNINLYANNITTTHPNTGSXVFDAGGTNIVSGTVGGQQGKKLNTVTLSHGTTAQFLGNAIFNGATMIENASTLQIGGNYTADKVESADHTGIVQFVNADDITVTLNKQAGAVHYLKQITVSGPGNVVINEIGNAGNDYGVSTNTIAFTEASLGAAIFLPSSLAFDGLTITSTVKNGPAGDFDAPFVVVSGVDSTIANGQAIGDQNNIVGLDLASDNSITVNATTLYAGIATTEDNQGTVTLSGGVPNTPGAIYGLGLENGTPKLKQVTFTTDYNNLGSIIATNAIINDGLTVTTGGIAGKDFDGTITLGSANGNSNVRFVDGTNSTSTSTVATVKANNGTVTYLGSASVGNIGAANTPVASVQFTGPAGSLEKLLGNIYSTATNFGNVNLNVAGSNVILGGGTTAINGNINLVTNTLTFASGTSTWGGNTSLTTDLTVSNGNIGHIVIAEGAQVNATTTGTTTINVQDSANANFSGTQTYTLIQGGARFNGTLGDPKFNVTGSNIFVKYGLIRAANQDYVLTRTNDATNVVTTAIGNSPFAGAAGIGQNVATFLGATNTAAYNNMLLAKNTKDAATFVRAITTNTSAAVTNAQLDVAKDIQAHLGNRVNAVRYLGTAEMAGPEAGAVAPVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQCYFFDANGNMSKQIAAGNYNNMTFGGNLTVGYDYNAMEGLLVTPMAGLSYLKSSDENYKETGTTVANKQVNSKFSDRTDLIVGARVMGGTMNFSDLAVYPEAHAFVVHKVNGRLSKTQSQLDGQVTPFISQPDRTAKTSYNLGLSASIRPDAKMEYGIGYDAQXASKYTAHQ

SEQ ID NO: 19275 - protein, 1578 aa, Rickettsia sp. 110
  misc_feature (684)..(684): Xaa can be any naturally occurring amino acid
  misc_feature (1570)..(1570): Xaa can be any naturally occurring amino acid
NVNLEQAVVPGIVTGDSLTYVVQAGGPFTATATGGNDNAANPTVLFGSISVLQNGVFAVDGADIAIGSVSGTAGQLLTITLASGNTLTLNGAPGVAAFPVNTYTNVGPVNFENDVAVFKVSLAANGADGTKTAIFGNTATFNGVEPWRGTINIDANNIAIFNGTIGNTNGIQAITLGANAQATLNANTKLCGDVADGITLGNAAILNVADGVNITGITVSIDGAGVNNGTVNFLGDSTVSTDIGANKSVAAVNVASELTFQGGNNVNGSTFSAQAINLTGADSLIKFIRQDHKVTGNILNTSGTNNQGGFSVNGADLTVTGNIGANGNSLATINFETDNVLVVHKAAANATNALFVQNVNTAAPNTGILKLHGTAFAINGNIGGNNALKSVFLENDYNDGATNFTLKQGNSIKAQNIYLASVQDNTLTLEEGTTITGDIVNTKRAGNGTIALTGNATINGGIGDVAAGVNIGKVIKNINLGGKNLSYGGKSIQIVNDPANGITFADNETLTLTNATDPIAINSNILITTDKQGIIDASAVTNNQTLTISGKIGVVDIVNNPATNNKSLGQLNVGSSKTILNAGDAAIAELVIGNNGSVQLGHDHYLIAKTTNAAGQGKIIVAANTGAGNTTLMAGTNLGSVAAPLSEVNFAAPVVNVDIQLIFGKNVNLYANNITTTNPNTGSXVFDAGGTNIVSGTVGGQQGKKLNAVTLDNGTTAQFLGNAIFNGATTIKAASTLQIGGNYTADKVESADNTGIVQFVNADDITVTLNKQAGAVDDLKQITVSGPGNVVINEIGNAGNDYGVKTDTIAFTEASLGADIFLPSSIAFDVLTITSTVKNGPAGDFDAPFVVVSGVDSTIANGQAIGDQNNIVGLGLASDNSITVNATTLYACIATTEDNQGTVTLSVGVPNTPGAIYGLGFGTPKLKQVTFTTDYNNLGSIIATNAIINDGLTVTTGGIAGKNFDGTITLGSANGNSNVRFVDGTNSTSTSTVATVKANNGTVTYLGSASVGNIGAANTPVASVQFTGPAGSLEKLLGNIYSTATNFGNVNLNVAGSNVILGGGTTAINGNINLVTNTLTFASGTSTWGGNTSLTTDLTVSNGNIGHIVIAEGAQVNATTTGTTTINVQDSANANFSGTQTYTLIQGGARFNGTLGDPKFNVTGSNIFVKYGLIRAANQDYVLTRTNDATNVVTTAIGNSPFAGAAGIGQNVATFLGATNTAAYNNMLLAKNTKDAATFVRAITTNTSAAVTNAQLDVAKDIQAHLGNRVNAVRYLGTAEMDGPEAGAVAPVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQCYFFDANGNMSKQIAAGNYNNMTFGGNLTVGYDYNAMEGLLVTPMAGLSYLKSSDENYKETGTTVANKQVNSKFSDRTDLIVGARVMGGTMNFSDLAVYPEAHAFVVHKVNGRLSKTQSQLDGQVTPFISQPDRTAKTSYNLGLSASIRPDAKMEYGIGYDAQXASKYTAHQ

SEQ ID NO: 19276 - protein, 93 aa, Enterobacteria phage CP-1639
  misc_feature (84)..(84): Xaa can be any naturally occurring amino acid
MRKLYAAILSAAICLAVSGAPAWASEHQSTLSAGYLHVSTNVPGSDELNGINVKYRYEFTDTLGMVTSFSYAGDKNRQLTRYSXTRWHENSVS

SEQ ID NO: 19277 - protein, 350 aa, Neisseria meningitidis
IKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYT

SEQ ID NO: 19278 - protein, 278 aa, Rickettsia typhi
MKKSIVALSVLALTSASAFAADYSDGDIHKNDYKWMQFNYMYSIDELPHGKDAENNAHDYLEMEFGGRSGVFDLYGYVDVFNLATKDDTDKDSDASKMFMKFAPRISLDALTGQDLSLGPIQEVYIATLFNWGGGSRNALGGSGDVNNSFWGLGSDVMVPWLGKIGLNVYGLYDLNKKDWNGYQVSTNWFKPFYFFENGSFISYQGYIDYQFGMKDEYSSVSEGGVMFNGIYWHSDQFAVGYGLKAYTNVYGIEDGKDWGGSAESTGLSHYVSVTYKF

SEQ ID NO: 19279 - protein, 835 aa, Rickettsia typhi
MTITFKKSAVYCATLAALAIGSSAMAEEVKKEAGKPAVADLERIVVTGNTGRGQTILESSISVTSLGPEQLAREMPLGTADLLESVPGFWVEDSGGETNNNVAPRGLRGGEGFRYIGVEEDGLPVVYDGVWVDFYQRQDITIERMEAVRGGTSGLLTTNGPAALVNFITRKPSDEAEGTVKLSYADYGMTRLEGFYGAPISEDWKMSVGGFYRQSDGVRDTEFTADQGGQIRANLVREFDNGQLTISAKHLDDHTTFYVPIPLQNQADPQGIPGVDPQSGTLIGKDQQNLGYLKQDGSYLNRDLEDGQHTKVTTLGFEFDYDLSDNWYMNAKARYSKLENDMYILLNFDNSTLVDGNARLQADDVQNMLTHFADDGAVSAAYQFVNSGEIFNDASSLNGNGLVTTSYPLYSRYEADQLVTKLSFTYENDAHSLTFGWLYAGVDADDLPVDKWESQFLTEVRDNARRLDIVALDSQGGVIGQLTDKGSTGYAPGWGQATAYGTTSSHSLFVNEEFQVTDDLRLDGGIRVERLSLNSTGSGTSFAQEVDGAFDANGNDTDNIMANNYTDMPSNVFFNKKMDVTETAWTLGFNYTFNENIAMFGRYADAFEMPRLLSHGQGIHSGEDAQFNETVNLTFGEIGVRYSGDTIGTSVTLFNTNFQDLTERNFTGSNGEVSNQTVDAITTGIEFEAVWRPVESISIELTGVVQDPKMEGFEGDFSHWEGNQVKRTPKIQMRVTPTYHFDEGNVYLTIHHLGERFSDGQNEFALPAYTTVDAGVMYHFNQGLSIHLKATNLSDEIGLTEGNPRAINDQQAGFEYYYARPILGRTFTASLTYDF

SEQ ID NO: 19280 - protein, 1703 aa, Rickettsia typhi
MNKLTEQNLLKKSRFLKYSLLASISVGAIIAIPFEGMASSKQKALFQNALEKKLSLRLSQSNGNRDTTNTPQQIGTVIVPEPERNTYTSSEIREMEISKQSKASNPLKDIPIEDHYKKVARSKSDVGKARKVRPPTRSKTFVDTEKVEQNQNNYTHEPTEQTPQKPEIIITASSPTVSPASNGFVTAPNTPNTTLTSPEHYTTAPGTPSTPVTPYQPTPDSKPNDNLEAKTPPNTNSKAVRRLSFSSEPQQTVVQPSTQAKPPVPPKPLLLSSAGVVAKKVVSNILRVNEMLGIKLAEVESTIKNTQGKENKKPLQQLKKQIASSQKTTEKLKSEAAKIGIKIKELDEENKSLKTGRVKNKRELDKDNAKLKENNKKIDKLQQKLTNKNNEANRLSEEIDISVKKVVLIKPQVKAPVTEMPPAGSFLNQQQQLEVLTQQQKVNAARQAVVDKKRAEANGVKRNSAEYKDLISEREEIQLEQNQRHIAVEKTKKQQQAEDKEQRQEAQKQLSKIKKQEKAIKAASDEAQKILNDAKKEASRTKLKKLQEQMDNHVAMVTNDKIEENIKKLEGLALTPSTTSSAATISKQSLTAKSTMQLSHELQRTLPEDEDGYLEPIKVQQQPYTVMLSNQEVADPKSMDSGLGSLPSGIETDEDTEFNLGWGNGHHKELILSVDSKLIEKAAQLISGLDVKRSEILQTTSPSQQKSLNLALQGIENDYQEAIEVYQGLQQALIHKSEDIKAYNAEAEKRLDAIKSRADKYFNNIETDADVGFNQDWSNVHTQTAQSDSVLKMQQALLEKRSKEGSNPNFTTYLDPQPGEEGLKSIDSGLGSLPIDASVIPQYVEELNNLASFSSLNQIQQKKPLIITNMLLSETSALSDDEFRAVANEVHPKIRPILTYNRQKEKEAKLVEAEAAHSQVVQNAIKTPNSTQAKEAVENAAKLFGQYNNSFKLTQALRDEHRKKYYETPKKVTDSINSLDLAVPAESQQLKEPRSKSLEALDLAGSVSSQLKQAEYKSVLSPSSSVNSLLSNEDEQNHEFEIPKSLSFSFGSLNSDAESQQLKEPRSKSLEALDLAGSVSSQLKQAEYKSVLSPSSSVNSLFSNEDEQNHEFEILKSLSFSFGSLNSDAESNLSWDNTGDIGVGHRYGAEDSCPTPDQSSSKIANSSDKNSSETKLALLRTYQMAVIVKRQELEQLPSTSSGADQNTQKIKELKEVEVTMHDAINACIADSSKLNDVSFEEINEALKKLGSEIPESAISDFESKAQKDPEAILDGSILQEMLSSKDSLPSGDEEQEDTEVTESGIQKAGDKGLLALPVSSNECALALSDGREKECLALGDGSEEKEETIEQLSDSVEGNLKIEQEEKKEMQTQISKNAPTLNQAKVVNTIVNNMIRNRLDASMNMSNNMVAVGAGDEEESRIKRGLWMRGMYGTNNHGRVENMTGYRGTNKGATIGFDVEIDNNILGIAYSNVHSVFKFKNSKNNDKELIDSHVVSIYGQKELPRNFALQALVSASKNFIKDKTTYSYGDTKIRSNVKHSNHSYNAEALLNYNYLLQNKLVITPNIGLRYGKSRDGVYNETGINVQEIALTMKENNILSGIVGTKVKVPLKDVLKFNNLGLTFQGAVEHNFKEKTQRINRVVKIFDTEFKQNYAIPKQPKTSYNLGTGIIGSIKNTTISLDYNYYLNKHYRSHQGSVKLKVNL

SEQ ID NO: 19281 - protein, 245 aa, Rickettsia typhi
MKKLLLIAAASTALLTSGLSFADCDMNSSVDSSTNSSMSSSVENQWYLKLNAGGVIFNKTKPKGADFKLNNIKSNTGFTGEIGAGYYIMDNLRTDLTIGAVASSHLKKSKTYPDGNSFSVKNKPTIVSVLLNGYVDFVDLSMFKVFAGAGVGAAFVKEKINSKDIKGGVTDTFNGTTKNKTNFAYQLSLGTSFEVAQGVKAELVYSWRDYGKTKNTTKTINGDKVKFGGTHYKGHNLMAGLRFDM

SEQ ID NO: 19282 - protein, 679 aa, Campylobacter jejuni
MKFKISALTACILMTSYSLHAQEDKVERLVVSASGFAQQQTDAPASITVINKEQLEKKPIHDLADAVKGVEGVSVNGNANKQEITIRGLPGEYTLILVDGRRQNSRESRPNGSGGYEGGFIPPADAIERIEVIRGPMSSLYGSDAMGGVINIITKPVTKEWHGAVSMGGTLQHNRDAGDSINGDFYLSGPLIEDKLGLQLYGSSYLRAEDKITYGQGRNDNKNITAKLAFTPTDNQTILLEAGRNSLQRTTTPGKSMSEFTNRGGRLDKNKMLETNNDRNHWALTYKNQFDILHSELSVYQEQTKRVQKTEGVDKATGNSYKYYEDRRPEITNTVFDAKFTAFLPDNVMTFGGQYQYARLKDESSVGGKEVKQSTITADQKALFLEDEFSVTDNLALTGGIRLDDHEYYGKHWNPRAYAVYHLTDEFTIKGGIAKAFKAPSLREISPQYGTSTEKGRAIMYGNRDLKPETSVSQEIGVGYDNGDGFTANVTFFNTEFKDKLTNYDTGEIDPITGLKLYQYDNVGKANIKGIETAVAFPVADNWRVSANYTYINSKRKSDDEKLGSGESLKGYPLDMTPKHSANARVDWQYDEATSFYANTAYTGKQIWAAQRNGYTGARYRSGYTTFDLGMTYNFNKNTMLNLAVLNITDETGPAVNDKGGNWVVDEGRRYWANIKYSF

SEQ ID NO: 19283 - protein, 287 aa, Xanthomonas perforans
TSIGALAQGQGAVEIEGFAKKEYFDSTRNFKNDGNLFGGSVGYFLTDDVELRLAYDEVHNVRSDSGQNIKGANTALDALYHFNNPGDMLRPYVSAGFSDQSIDQNGSNGRDRSTFANVGGGAKLYFTDNFYARAGVEAQYNIDQGNTEWAPSVGIGVNFGGGSKPAPAPVPAPEVCSDSDNDGVCDNVDKCPDTPANVTVDADGCPAVTEVVRVELDVKFDFDKSVVKPNSYGDIKNLADFMKQYPSTSTTVEGHTDSVGPDAYNQKLSERRANAVKQVLTNQYGVE

SEQ ID NO: 19284 - protein, 806 aa, Ehrlichia canis
MHNFKYSLLTLACLNAQLAFANDIKVEDNIERISVYEKQNRVVMSSGLATKSNMSLMETPAPVVIIDRELIESQGVNSLQDLVRNVSGLTQAGNNYGIGDNLVIRGLDANYTYDGMYGGAGLGNTFNPTRSLTNVESVEVLKGPATGLYGIGSAGGVINLIEKKPEFNEKHKVGVELGQWDSYALSIDSTNAITDNLAYRVMAKTASSAGFRDLKEDRDEIYTSLKYVFDNKQNIMLSAAYIKDAIAVDSIGHPIRIYDANSVNGLTSDQVTGADLVNDPSGNGLQLSEAQRIELANSLSSSDGLTPYSFGTNGIISPMAKDNEGEELRFKLTHNYFITDDLFLNQQLQYRNYTSSFARQTGAYNYVYSTRSGVINQDPRAPLVEDGVLYPFAARRQEYRQVEADEKSWQYFADLRYDFSVADIDNELLVNANYEDRDIGFKQYSIYDADKVINDSDGNLLYQGTLPYIYDIREPNWPTGNFADYDPLKTSDYNKKVQAWGLGIQHVSYINEALTTRIGVAYNRIKQSYEHLGVDERYSSSRANPTPEANTSDSGLTYNLGATYQPTEDFSIFVNHSKGRTAYSVLGSVSGNEADREDSESLSNDLGFRFKAFDDQLLASIVVFESARTNLEYANPLYEAGVSAEGVVESFYNGKEETKGVELDLNAYLNDKWKINVNGVYQDARDQSNPNSSSYDTRQKGVPYVTASTWVTYYANMFNLPEAVNISGGITFVDNRSTNSSSFSIPDGYVPSYTIYDTAISYTTDKWHMQLNLNNLFNKRYYSKAMFLGGMPGQERNAKLSFSYTL

SEQ ID NO: 19285 - protein, 916 aa, Desulfotalea psychrophila
MRIHNKKRPLKRSLLTLLITATVAAPYSYAATLSVSLPEQSLADSLNTIAKQGQVQILFDANAIKNLRAPALSGQYETHTALQKVLIGSGMEIISQGNGFVIRPLATSSTIVIPEVKVTGIGSSYHPATDVVSAPQYITAEEIKQRNTGDGNVTDLLKSNPAVQFANNDSNSMNQGEIKPSRISIHGSSSYQNAYKLDGVSFNNDFDPANSGNGETNTRITSDEQGMYLDSRLIDSVTVYDNNIPVEFGGFTGGTVEVQSRRWSGETHANAYYRTTRSSWNNIFTDPKLKFDTANNDFSNPARFQKKYDKQNYGGWFETGLTENTGLIFSASRRESTIPMMISAEGGIVHTPEGELEHVLQSPHYRDQTRTSDNYFIKYSWNISDKQSFDLSSNIARYKSYLFSSSVYNSGYDNEHNGLSFTALYKHQLALGTLELTAGYQNLEDKRTNDQDYFIKVEDYTDWQHPNQVSSGGQGDLRSKQETYSAKSIMRFDPIVWGTVTHRPTTGFEISRTKGAYIRDKTYYNYTYRGMTVNDEWMGSLSQTTRFLAGTHNASYTNYSFFIDDNIQYKRLTLRPGVRLDRDDFVQKNNLSPRLSATYDIWGTGNTLIIGGVNRYYGRSMLTYALYGAQNAGLQHCYFDCQTSEEKWTNRTDFDGVDSLKTPYNDEFTLGLQQEIASTTWRLQYVHRNGRDEVRSDTKYPDSTIDEKRAIRHFNNNGRSTHDTLTLSVRNSQPWELAKADHVFNASISWQKSKTNTPKDSGYANFDPSVQGMNYDKVWYGGKIINAKDLPSDNFNSPLKVTAELTSVWDDVGVTWFNRLQWNGARSQAEKANNGAPKPSEYGPLFEYKKRHYSSRFTWDTKLSWQPEFAYGVGISVEVNNVLNTKNVNDYITYQDKEYKSYEPGRQFWLQVSYDY

SEQ ID NO: 19286 - protein, 385 aa, Desulfotalea psychrophila
MKRSLWMALAMSVTGSVASFAALGDAHAQSSVTLYGVLDTGVEYVSHANAAGDRLIRMPGTTGELPSRWGLRGNEDLGGGMQATFVLESGFNVRGGDLGQGGRLFGRQAYVGIASAYGKLTFGRQYTMTFWAQTDADILGPDIYGLGALDAYVPNARSDNTVSYLGTFSGLTLGATWSFGRDSAGTSNSPGQGTCAGSVAGHATECRQWSALVKYDSPWFGLAAAYDEQRGGTSAAANFFDGVPPLTLTNPADKDARLQFNGYAKLGPVKLGGGWMGRRVVTDSPALPDVRTNLFFVGAAWQVTPSYIVDGEVYRITNAQHDTRATLGTLRSTYLLSKRTAVYLQAAYLANSAKARYSVSAGGGGTTPAAGMNQTGVMAGIRQLF

SEQ ID NO: 19287 - protein, 907 aa, Desulfotalea psychrophila
MCNVIAIMPKYTKSLLFLFFIISTVSYSQTRAKIVGVVTDNYGVLPGALVSIEGYNKSTQTDIDGAFSFEVDEGEYVLSASFVMYNVQYNTVVLKAGDIKEINFKLETGFSADEPISLGTRSDPVSSFQNTASVDIISPQQISNSPQIELSQILHYLAPSFYSTHQTIADGTDHIDPATLRGLGTDQVLVLINGKRRHNSSLLNVNGTIGRGAVGTDFNAIPVSAIERIEILRDGATSQYGSDAIAGVINIVLKKQTNAITLDNLVKINQEGDGLTQFAGANFGMKIGKEGFLNLTGEYRKREATNRAGNYTGSVYVDNAEEDASLIEENDFYTQTGYSDRRVMQIGNAETQNLAIHFNGEIKVSDSAKVYLNGGRNYREGKSAGFYRFPKDQDRVITDLFPNGFSPQILTDIQDDAVTLGIKGVKREWTIDFSHSIGTNSLDYTVNNSNNASMGVASPTTFYAGGFLYSQNTSNLDLSKSFEWRSGLNFSFGGELRVENYQIGAGEEASYIDGGSVFINENGEEVPRIAGAQVFPGIQPDNELNKFRTNSSFYVDVEANVTDQWLVQGAARNENYNNFGNQIIWKLASRYKIYENTSIRGGIATGFRAPSLHQVFFQNISTQFIDGDIVQVGTFNNESALTAQAFNVDKLRPELSNHYSAGLSSKINDYLSVSLDYYYISIQDRIVLSGRIADGYESILDPFGVGAAQFFTNAIDTKTSGFDASVVFKKSLGTGNIESYLGFNINKTKVGSDIRVPEAFEGAEEVIFNREEIGRLEKGQPGYKLSFRNFYDVQKLRVQLNNTLFGPVTYFHPEDGNSNNWVLNEFTGNIESRDQKFSPKIITDLSIDYQFSSRVRAAIGGNNILNVYPDKHTHSSNTSNGNFIYSRRVGQFGVQGANYFIKVAVKL

SEQ ID NO: 19288 - protein, 646 aa, Desulfotalea psychrophila
MCRATKRRFIIGSILFACLSNSPAWAENEISTPYLTSASNFRDIAGISKNYGGTGFVNDTSHEGIMRTGVFYRSPKLFNLSSVDFNTISGLGLSLIIDLRTPKEIQDAPDMSFGINEVYHNIFGTQDTPHLSYITPEDVRVSFHNAYREYITEEGQRKVLKNIFLDLAKTPKAALYHCTGGKDRTGWVSAVLQSIAGVSDATIMNDYLATNLYMETAVNKFLKDYPESMWPILKLRLGVEASYLQAALEQVVTSYGSMQAYLLQGLDLTPADIYVLRAKMVYYQSLPGQAQFSGNAARGATFLNSLQNSPLSGQYSNYNYYLQAAIDAGTLSGVETRVGGQVHADAAAYLLRQPQLIDNALTTLASGQNLKFGEGKAWLSGLTENQEVSSRSGIASSDSRSSGLIVGGTHRFNENASAYAGASYISNKVESASADADIDNYLVVFGGRYALSKLETGPYMGVRFSAGALDYKSTRPLDYGLGTATGKTDGKTYSGRIDLGNIFERGTFTITPQLGLLVAHIDLDRFDEQGSELALKVNGISETIPSLLAELRVDLNGRQLGNWVFQPSAVIGYERALDTSNVTSTGSLYGISVSQESAYDSRDLAKLGLGISARNGNFSLQVGANLMAGENINSILGANINFLYTF

SEQ ID NO: 19289 - protein, 669 aa, Desulfotalea psychrophila
MGKFRLNQHLLGTVSILGLMLGTGALAQDIPVDELIETTEDGFLGTVELGQGKREVQIATSTPVTVINQEEIDDRQASTVAELIDSVPGVSLVNGSRPEGSGINIRGFGANGTYGTDQKVAIVIDGATTGSEEIYRIGTQLFTDPSLYKSVSVIRGTVGSFEFGSGIVGGVVQFETKDASDFTGGEVGLRFRQTLGYSSNAQGYHSSSIIAWQPMENLEVLLNYTKRDTDAYEDGNGTLVSNSATEPYSGLAKIRYTFGEDGEHAVTVSYQKTATDEFDAPYDAFNVVNFGNVNRRTESEVATLKYEYNPVGNDLINLSVQYSYSDIFIESEAANPGGFADYLLNGDHDYTIDKLTVKNAMFFQTGAASHDLRFGVEWSKRDRLESQVSPFSGSVAVPGGTDERIALFAVDEISLGNWTFSPAFRWEDQTVEGRKTYAGDRYDNSAAMGGISARYEFNSGFALFASAAYTESLPIIDDLSNAAFMTQPEKSRTYEIGASYAGSDVFTSEDSLQAKVNFFRSDLWDVTSYSSIASVQSEGVEVEVTYAMASGLYVDVNAAYGDYESLSSAGVRGDWRNAPANSARLTVGKRIGEAWDLSWEQVVAEEGNNNYGGYGVSNLRATYRPQSGVLAGTEVRFGIENAFDRQYKPNLATEFAPGRNFKLTLAKTF

SEQ ID NO: 19290 - protein, 867 aa, Desulfotalea psychrophila
MPGASSKNQQGETNMRFASISIAALATAIAAPAFAQDQAQADDTRSGGIAEIVVTAQKRAENVQDVPIAITAFTAGALQERAVGDVSALSGITPNVTLDASTPFSGSSAVLGATIRGIGSSDFAFNIDPAVGVYLDGVYLGRSIGANQDLLDVERIEVLKGPQGTLFGRNTIGGAISIVTHNPGDEFHAKGDVTVGRFNRIQARGLVDIPLAPGLSSSVAFGLHKRDGFQKRVAYSDPGANDSFTLFPASGYETRSRQGGDNSWNLRGKLRWDDGGKFRATFSADYTNIDQDSTANTVLAVTPIPGPFAGVAENNIPGTALDVVTGSSGFLFAGLYNFCIGATAQQIADRNATNLCGPRSSVNGYLTLPGLASRNVDGDPYNDLLPYDGRWVNTDKDVSYANGNNFSKLKQWGLGLNLEYDLTDNIALKSITSYREVDFKAGVDLDNSPLPILQTSFIVDQYQFSQEVQLTGSAMDGALNFVLGGYGFKENGDLRDFVTFSAGLLQVDGPGKVDTEAYAGFGQVDWRVNDLIGISVGARYTKENKRYDGAQSDINGFNYKLFNCMALDPATGNPSAECAAGVGFPIPSEPFRYYPTSPNKQTFDDFSYKLGLQLHPTEDVMAYGSFSRGYKTGGWTTRLSNPLPVAPTFGEEVAETFEAGVKSTLLDRRLQLNAAVFTTKYKGIQLNFQQGVSPTIQNAGDARIKGFEIEAVAAPADGFTITASAGYLDAYYTNVLAPAQVAPNPFQLGVQKGSALPKAPEWKFNVSPRYEVAVGNGKIVALADWTHTTGMRNDTEGTILLLRPTTDIVNASLQYQAPDNQWNLTVGGTNITNERYLVTGQAQIAGGQIYGTYSRPAEWYVRLGFEF

SEQ ID NO: 19291 - protein, 461 aa, Desulfotalea psychrophila
MIPPAPSRRYPRRSARNSGSGGAGRARRARSRTVVRCMRRVRARRAFPLPSIRITSFHRNRRSTMKTAVCTAAVACALAAPLTAHAQSSVTLYGIIDTGIAWTNTVASSIKAQGASRWSMATGWGSGDRLGFLGREDLGGGLSAVFQLEAGFSGLNGTSSQGGRLFGRQAYVGLSSKQYGKLTLGRQYDYTFDYVAPLMAWLQFGSIYGAHIGDVDDSFQTFRLNNSVKYEVSPLAGLKLGALYAFSNQAGGGAGQGFANNRAYGFGLDYLRGPLHVVASYLQLNNPSTGIASSGNNPNGAIGDEYSGSTSLFYNAGFVERQRISALGAGYSFGAAAVNLVVTDTRLAYRGGHSLRVDNYEINGRYNFTPVLIAGVGYIFTDGHGYTGSGATSFATGDRPRWHQVDAGITYLLSKRTDLHMSMVYQRRAGDAGTVAINFFGPAGAGRSSQIAVLAGLRHRF

SEQ ID NO: 19292 - protein, 529 aa, Desulfotalea psychrophila
MKDTRSKNRSKKTGAATFFYCAFTLPALTLAANAYADDGVTEPTSEASKTQTVAQTLSSPAQLAQTAQPTTTQQNNSSSKRRAEQGGQVRNDQPDTTNAIVNAEASQTVTPPAPPSSQAASKGFIADSHLNLQFRNYSDYFQAPNTIYRHAWVQGAQANFESGYTQGLIGFGIDASLFGALKLDGGNGAGNMVHVGKDGGGSQQLAWAYPGMYDIKGRISETVVKYGLQDVTNPFLEPHDNRALPPTFLGVSMVSNDLAHTELQAGSFTKVDARGHTNLTNLTTSYGGTRIDRLTYVGGTWHYAKNGEMALYVDQADDVWRQYYGSVAQSFGDPTTIKWSGLANIYSTHDTGASRQGHINSNAYSVSVSAQHGPHALLLGYQQVLGDQFFDYVNETNGIYLTNSMDVDYNAPHEQSLQLRYTFDGKYAGVPGLKAMFWGQYGWGADASAGAAENASPSAPLHDLYWKNGEPVHGHHHEFGFIPSYTLQSGRFKDTKVTFIAMWHNSQYHYSDGNNMEYRLVVNVPVKVF

SEQ ID NO: 19293 - protein, 762 aa, Desulfotalea psychrophila
MLHQEAIENKNYIMKLNYKNIFSLLFVVLGVVSIQAQEEEKLATQDSVAIQQDVVKDGNAKESGNRNVMLNAESNTGPREVNIGLPPSIGGITILENNLPVVYWFWPEMSTGTWRQSVGLERTGLLKMDGLANTMGDLGFAVNSYTQKGTKEFKGKAKLSGSHFGWFQGDINVSGPISESGWSYSAGAFVNFDPSTYDLGFNNYADQTQIYRIGLTKHFKENKGDITFAYKYSNSYSLTNYAVFEYGPNGEARELDDFTIGRDSYLPRDGRLKFLDMVSGDNYWADMDGQSATSEAHNFDIFGNYLMDNGWNFKYSTRLHIAEASLMYSAPISIFNAGAGSNFTFADTGEAYTGQVGTQLAMNSPRIPTTTLMGRFSVEKQLGNHDLTFGMLEQYYTVDDYHSNRSFFFQSVEPQPRRLIGTNTDVDGFYNYNVGGEYNNGFENKLSIYGSDSWKVSDRLKLDYGLHLRYHKMKGDHYTTPRAAGLVLDEANKQQFDHDWFHVAGKFNATYNVLNNFGILGSFLYTEENGLLGDYSGAPYPNLTKSKSPLGGLGVFWNTDYIQLVSQATYLNKNNYLQRLNLVNPNDDTESVTNTIYYDIQTIGWTTDFVLKPFKGFNLHYLITLQDPVYKKFNFTAFDNEYDYNDNSVQQISKVLMEIDPSYTYKDWRFWASFRYFSKQYANLTNALYFAERWETFGGINYKYNEHISLGATVVNFLNQRGAKGTINGAELITEPDPYYGRLLTGSYIRPFTVQASVTINF

SEQ ID NO: 19294 - protein, 2332 aa, Desulfotalea psychrophila
MRMTHIFSMVSIFMLPTLSIGSCLNDNGTYTCSGSDIPVLDVGSSTATHFLYENVTGNFGPSLSSDDNYAFKFTDQAGPGNDATKEKHEDGQDGGDAYSSYDMSLMMHFDKGFGIDSATGGISIEGNGGNGGLANENSAFGTARGGIGGAGGNGSAVTITANADNGGVTPFPITTSGGPGLIVLSQGGQGGEGGKGTNQSGLHQGFGGNGGAGGNGGAITVTLDDQHSVDITTSTSAGIALVSVGGNGSTAGEGLSDNKATGGTGGAGGNGGIITLTAASSSNTISTSGDTIHGIVAISEAGDGGTGGEGHGPTKGVGGNGGPGGTAGEIDVTFAGDITTSGVQAQGVFIQSIGGASGNGGNADSWVDGNAGFASVPGPGGEATVSYANGTIRTKGDEAGGILVESVGGFAGNAGGATGFVGYGANGGSAGDGRTVTATLNAVSVDTTGNYSNGLSALSVGGGGGVGSKDDGFIAIGAKAGAGGVGGNVTVTLTDTNTITTKGDDASGIFVLSAGGGGGTSGGNDGVVALGGDGGKGGNGGKAAFSADGNTTITTEGEYAVGVMISSIGDGGGKSTSPKGPWALGAKGGDGGSGSDVTFDLKSGTLGVTTQDKIADGVLISSIGGGGGHGGSSLAALDIIKPILGSQGGDGGSGGDITVTSEGGSVDIETFAFKSNGFVAQSIGGGGGTGGNVVNVDIGLTFNQQTAASNTITAHHGGTVNVGAKDTVGLTGSVTTHGATSSALLVQSVGGGGGSAGNNIEAGSTLEFNHDMGADGQYGGTGGNVTVNSKTDATTDGDHADGILVQSIGGGGGQSSNVIDANVGGEFSQFVGNQGSSAGTAGSAGAVWVQTDSTVETKGDNALGVVAQSIGGGGGKAGYTFGGDVSISSGSIALGSSGGTGGSSGTVDLTTAGSVTTHGHLSTGVMAQSVAGGGGTSGTTVNGDAGISLGYTHGGNGGLGGMASDITLTNNASVTTAGSGATGILAQSMGGGGGSGGVTASGSFSIMGDLSIAHGGNGGDGGTAGKVTLTNTKNINTSGDSSHGVFAQSLGGSGGVGGFLGTGAGSAGLISTSVNVSVGGSGGAGSTADTVDITNSGQITTGGYQSTGITAQSIGGNGGDGGAIIAAAIDLSSEGGGSVNVSVGGDGGDSGTAKAVTVTNNSGGDITTNGHLSYGIFAQSIGGNGGKGGGSYAYTVSGSSGPTFQTTVSIGGSGGNGSVGSSVTVENQATLKTSGGNAHGIYAQSVGGNGGVGAYGSASALNFYLAPKNKNPSFSVDVALGGSGGNGEDAGSVTVQNNGDISTRTETSYGIYAQSVGGGGGDGGQAGSHTFGYTNKQKKTDEGKSYSLKYAMGGNSGASGDGNDVSVTHSEGTISTAGNASYAIYAQSVGGGGGNSGNGSPGLKGWVADIKKTFDFLHDIYETYKGVKGFPKDELSFEIDIGGQAGASGTGGNVTVENDATLSTTGDSGTAIFAQSVGGGGGSGGDGSQGLLTSITVARSGSGGGNGGNVAVTNSGNISTEGSGAMGIYAQSVGGGGGSAGDIESSIVTGVANFYETLGAQIFGKDNGGQGGDGGDVNITSTGQIHTANKNAHGIWVQSVGGSGGAGGNLGSDTDSASIGSAGDAGNSGYVDIAIDGLINVKGTGSHGIFAQSASGTDGYSGGVKMRIAGTVKAEGENARAILAQSSETGTDDPQGDKGGGSAQCKDDECRGTSHIYVNKGGLVETTHSSAYETIVISGGRSSYNSDGSLSYSNMIQNEGTIQSADANSVVIANDFQGALRIHNLSGGILAGSLQLDDSNRTEFENLQGAYFHAGKTVYLGKLGNYTGYDGSTMSPYGQNIVGTSTVSLGETYAEAGTLWIDVQQNSTGTVLNDQIVFDGLAQGAQINLTGVIQPVWVGSTTLSSGNTGVLHIVSLTNDANLKTMTATLVNTPTVTYTLSNKTSDIFVNYTIDYTGSAAGIELGNNALSYARYLSSAMAAIEATASGDTKEALSMHATTILNTTSADELAAIYGSHTPEESLIGATRAVSASHRLNQLMQSCPTLDPTTGTDFLRQNDCAWVQAIGSHLNQNATGESPEFSETTWGIALGSQREIAADTFIEIVGQFETLSIDGDNFSQDGKRYSLGLALKKEIGRFTLSTALTGGIYSLNYDRAYKSSQIWQQADSDIDGGFLGAEVRASAVFLGQSGYYTKPSAALAYTQVWQNSFTESGNGLLNWDVGSVSDGWLAMTPMIELGRAFSVNDHSMLAFIRAGLTVVLNEPSMDASSTLVDADASLGELNFTMGTDRCQGDLTVGFDAQLQDNLSLSIRAQTALSTNSYDYGGSAKLEFRF

SEQ ID NO: 19295 - protein, 422 aa, Desulfotalea psychrophila
MRMSTVRRAKPCRIALPFALATALPSGALHAAFFEDAKGTLNLRNYYLNRDYDHGATRGKAEEWTQSFILNVQSGFTEGPVGFGIDLLGLWSVKLDGGRGTYGTQLLPTHDGNKPADDFGRFGVAFKARYSNTEIKIGEWNPVLPILSSDDGRGLTQTFQGGMLTSREIKNVTIHAGQMRQTSPRNDASMQDMTLDGISSRDSSDRFNFGGIEYSFNDGRTMLSAWFAQLEDLYKQRYFEIRHTQPLGGDASFNAKLGLFDGEEDGQAFAGDLDNKTFFGRFALRTGSNTFTFAYQKLTGKDRWLQVNGTSADPLPNDVYAGPYNNPKEESWQIRHDYNFAGLGIPGMTFMSRYIDGRNVHRDGATNGETWSRENELAYVFQSGSLKNLTVRLRNSTKRANWGTNTSWNENRVVINYPISLF

SEQ ID NO: 19296 - protein, 676 aa, Desulfotalea psychrophila
MRKTIRYAGIAIIPTLWVGMIAKAETETSLNEENHAFEPMTVIVTRTARSLAELPASVSVLDSEQIMRRQAQSMDDLLQVLPNVDFTSGPRPIGETLTIRGLSSERILTTIDGARQDSSIGHLGRFFIEPDLLKRVDVLRGPASAIYGSGALGGVVTMTTREASDFLAPGQRFGARLKGGYQSVNNESSTSAALFGRASDWDFLGNFSYRDSDDITLASGQELDSSAAENFSGLARVSYKPGAHRLRIGGDYFSTEGIFPANPQTVSDGANENAATKIERRTYTFQYSYDDPAHPWFKPKFNAYRNELRDSRNRLESGRQTTSEFVTTGFNLQNSMDFGDPQDFLMQTITLGVNYFKDEEEGREDGNPRPSFPKANSDVWGFYIQDEISLGQYLSLIPAVRYDRYTLEIEERAGGSTTDEAISPRIGGMIHLASWLNLWGSYGKAFRAPTLPERFTEGLHFRGVPGRLPDNFFIPNPDLKPETVYTWEAGFKSAWEELLTATDRLNLEFTYFDTKADNFIDLKVNTLGGTTQNANLDKARLHGFETGVRYDSEYFFAGASFGRTYGENINTGLPLTNVQPAKGVVNLGGRFSPWGLVFGGRGRFVAKQDRVPPGVLEAAGYSVYDLYATWLPSSAGVKGLRMDFGIDNLTNKAYRRYLSVIEEAGRNFKVALTYQF

SEQ ID NO: 19297 - protein, 95 aa, Desulfotalea psychrophila
MKASLSTPFSYDSSSTTKVGWTVGGGLEYAVTNNWSIRAEYRYSNFGNATLYPASLAGVDAGPFVNRKFNINQVQVGFSYKFDTFAPPAPVVAKY

SEQ ID NO: 19298 - protein, 919 aa, Desulfotalea psychrophila
MKKKIRKVFAFCFLALLNGVVSGTVTAAEPKTGVVSRHVVTGRVFDHSDGMSLPGVSVSVKGSRQGAITDQSGYFKIDNIAGNSVVVAVSCLGYASAEYPVSFLSGKASSLAIGLKPELLMGREVVVIGEQLKGQAKALNQQKNSDNITNIIAADQIGKFPDSNMGDALKRIPGISVFGDQGEARFAHIRGTEPRFNSVMINGERIPSAEAEGRSVQLDLVPADMIQTIEVNKTFAPDMDADAIGGSVNLITKVPSGKRVSVTAAGGANLIEGTGGGRYQFAGTYGDRFFDGRLGVVVSASYYDNSFGSDDIEAAWERDEDGKAVLDEFEIRTYEIQRIRRSLSAGLDYRFNENHLLKFTGIYNWREDWENRYRASYKDLLEDKAKIVYQDKAGVDKNARLEDQKMMSFALGGEHDFGRLSIDWQASFAKASEERPNERYIDIIAEEIDDFAVDVSNPRKPLVSVSDAFSGGISDNGKWKRDELTEEYQYSEDIDTNFALNLKYRVSDAVKLKFGGRFRDKSKKRNNEFYEYDPVDGDAFMDSVYGNLTDLDKERFLAGEKYRPGNFVSSDFLGSLDLDSDDFDKEEALEELAENFTAKEQIKAAYAMATWDATEKLRIIGGVRLEHTRNEYDAFFYDDDADTLTPVSGAPKEYYNVLPYIHLLYKLDDRTNIRFAYTHSLARPDYFDLAPYRQLDDDAIYIGNPSLEPTISKNIDVIIERYLGNVGVLSAGLFYKDISDFIVTRKTTDSAYALYQPVNGGDGSVSGIELSAQFQMPFLKGLGLYLNYTYTDSQISNFNIEGRETDDLPLPGSPEHTFNASLSYENGLFTVRFSGNYHSDFIDSEEGSIGVNSWEDRYYDSSFTLDLNGAYRFSKELQLFFEISNLSNQPMRFYQGEKQYVAQEEWYDRKFLVGLKADL

SEQ ID NO: 19299 - protein, 301 aa, Neisseria meningitidis
QFSLNAFGKYITMSNSVGKTTEKLGYGMALSYYIIPDLQLRTSYEMTNRVPEANEVYGDLENQVGNSSLKAENSDNVNLGVVYGFKLNDINRFSITANAIYRYSADFIYTRLVGGTSANQYLITADNREGVRTTGVDGEIRYSYKNWLSAGATVTYQMLKNLQKHDPIPGQPGMFYDAESDVYLDRMPNIPYFFGNADVSASFSNVGKKGNNLTVGYNMLFVNSFWLRWPSLGSATAETKYVVPTQLSHDLNFVYSMNNGRYNVSFEARNIFDKAVFDNYSLQKPGRAFYLNLRYFFKQSQ

SEQ ID NO: 19300 - protein, 695 aa, Haemophilus parasuis
MKKTFFYSTVASAVALAISPAIAQETAVLDEVSVVSSGSMYKMGEVPVHQAKSAVAISREDLDKQDVKKADEIGRYQAGFANQVFGNDTNTNWFRVRGEEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHTDGEWKDTDNKTVYIAPSLEWDISDRTRLSILTSYQKDSGTPSSNFYPQEGTLRALPDGSYYSRNVNFGDPVNNHEENKQYSIGYELSHDFGNGLRANSSYRYSHVENNHRGGYIYPSAYAADWSAVAPSANGYNVSGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLSFGIRHDRARQNEYTSDQTVKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQTDVNLTENWNATLAYTYTKAESEAATGEKTRQSLIPTNTLAARTAYSFTDSVLNGLTVGAGVRYLGHSVTSKGSLYSHVRLPSATVVDLMARYNINQNWLAQLNVDNVGNRKYVAACDYYCYYGAERKVNATVSYKF

SEQ ID NO: 19301 - protein, 953 aa, Rickettsia mongolotimonae
KANDDAKVQTAVAVGGSGGAAGSGGAVSVTKDTSGNIETQGVAAFGIYAQSVGGGGGNGALAGAISGSLKSLSIAVGGNGGGAGDGGTVSVNTSDTSNATGIQTTGKHSIGILAQSVGGGGGVVTTMSSDETFDPSKIINNPQGRLGDIYGMQLSFGGQNGSSGKGGNVDVAVNGNIQTQGLDAHGMVAQSIGGGGGFVVGGQVNLPAAGTGGAGGAGGDGGAVAVNVKDGFIGTSSDGAYGVIAQSIGGGGGFAGDPSQVQSYQPGTGLGIKANSGNGGTVSVAVDNALITTSGKFAPAVFAQSVGGGGGLEAYSVDGGAPQVLARGTAGGKGTGNAVDVELKNGAIVRAFGSGSAGILAQSDGTSSGPIRISIDSSSSVMGGAPSYADLQHIDSAAIHLLGGTGNQIINAGTISTNSRSQGQFAIVADGPTSTQLTNTGKITGDIVLGPSSTNVVNNLAGGVIDTPTKLNIGGGTVNNAGTLKVGGAKTVGNTVLTGNLVQSPTGTLNVQIDPASKRSDLLNITGTAALAGKVHVDPVTYLKSTSTVLAAAGGIQPDATLAGTSTPVYRFTPLMQGNTVAIKTDADFVGASKGASATQQSVAANLDRLWNSADPTFAPIFGAFGNVGSTSGYAQTLTAVSGQELLGVAAARYQSSQAFARSVFSCPVFADDDTTVRKQGSCVWFRATGMWENRSADASFPGFGWQGTTMKVGGQVQLQPGWFLGGAIGYETDRFTGNDNLTSASGNALLGVVALKHEVGPWTFTGAVDASYGWLNSSRVIPTANAVATASPDSFNVGLHMRAAYQIPFGRFYLEPALDGDLNYINLPGYTESGAGALNLKVNSANSVIATGTPNLRIGTRAQIGSATVDAYIGAGVSFIAGNTYTTNASFAAAPGFGSFTNTLTNAHVAGKFSAGVEVYTTKRLDVRLEYDGVVAAQEVENGGQIRFKYRF

SEQ ID NO: 19302 - protein, 498 aa, Sphingomonas sp. A4
NSTVGGYAYQWPYNATISTSTFTPILDQSYDVFVNARLFPTHTAAFSYAQTMYPTSPFLWDILANAWSTYTKYDVYTDDLISRKNALVGINYVNLLSDKLSLDTRLYYTYNASRIEYNRTDADQTYATGRIRTIGEFNETDDSRYGAGIKLDWRASDNHRLLFGVDGNIVDTRTTQVAVEYPVKNEFNNIQEKNFAVFLQDEWKITDKLTSLMSLRYDWSGVNKDEVEITPGVWIPINKKSVDALSPRVALNYRATDDMALRASWGRSFRAPSLYERFVHDAGFLTVVPNPDLDKETMTAWEAGIFKQFSDKVSLDIAGFINNYDNLIESRPTAAPLTYMYGNITKARIWGIETNLNYRPNTDWNLSVGYTYMNAKNRSFDASTATATELNNPDPEWLPYRPEHTASASVTWKATKKLTLNVNGRYVGKYKAVTLYTNPDGKWYPGDFVVFNAGLKYQFNKNVTATLACNNINNTQYSEAEWFRAPNRSFIAGIDLTY

SEQ ID NO: 19303 - protein, 725 aa, Erwinia carotovora
MYFISYKIKSMYKNSYPAYLSYCALSLTSLSGIALADDDIKIEQNNSSHTEVIVITGSRQASDLLSFAGNVDRISTEDIDIVSAVHPSDILNRATGVHIQTNNGMESLPSMRSPVLTGPGAAGAFLFLEDGIATRSAGFANNNGLSELNLAQASEIEVIRGPASAVYGSNAVHGVINVLTKAPSDEGDVSLLFGPNERVQLQGTLGREMDQQGVSGNFQVIDEEGYRDDSGFTSFKVNGRHDYEEGVDKISTLISGFVLDQDTAGFISSGDNGSDCYSSDYADGNLYQDRNAMEKNCDDDAYRKWSSLRIATNWQRLLSAKTHFSITPYFRVNQMEFRQHYLPSKAIEENSHYSVGVTSNYYWQLEANLALVMGIDAEWTEGELTQTQQKPDTFSFGKARQQGTHYDYEVEASTIAPYIQADWQVNDILKFTGSIRFDATEYRYNNLIADGTTKADGSSCVNNSGEATPCLYLRPSDSDDHFNNTSTKLGFNYQFADDTALFGAWSQGFRAPQTTDLYRLQNQQVVGEIDSEEISSTEIGVRGVTDKFHYEAVIYTMTKNNVFFRDASGLNVTDGKTSHQGLELGVNYDFTENINLAINYSYGEHEYEFDRPSSGVVKGNEIDTAPKNLANTRLRWLPTTNTTLELEWLHMGDYFLDPANEHKYKGHNLWQLRGAVQINRHVNLFARIENLTDEKYASRADYAFGSYRFFGGQPRAIHFGVSANF

SEQ ID NO: 19304 - protein, 392 aa, Erwinia carotovora
MNARILIPALAAAVAVAVPAAAQQQAPEQPAASSAPAAEAPRPSAEAPKPAAKPASGPTFWGFLNIQYSRTDAPSPAKDTSSFELRRARIGARGDLLPQVGYAVLWDGADSSLKDAYGALKKLAWLPGLELRFGQWKTPFGYEQPESDTKLLWVNSSYAVASLARGPDSRDLGVGINGKWAVGGGVGVEVAASLVNGAGPNKKDDLDEKNVWARGGASAKLGPAALRVGGSYGYGHQVSSTGTNARFDGAGATNGGAVSATNDDTYFWFQTYGADVTLDSPWLFVAAELIQSERDLQVHAGTQAFTRRDVTARGWYAGLYGKSPWNVGPIFRAERYDRDRGTGDNLNERYTVGAYADIVPVNARLILNYEIDRSDRPVRTGNRAIAFAQLIF

SEQ ID NO: 19305 - protein, 759 aa, Erwinia carotovora
MFRKTLLAMAMAATAVPACAETVELTNAGFKSERQTHTGNLEINGAYSGSAVKDAIQLSGSTIEKGLILNANISGSGNFASGEAAKGISLEGGKINGSVINRSLVDVTGQGATALDVATSLKAFENHGSLSASGTGSQGLRIDGVTLIGNSADLINTGTIRGEGAAIVMGTTRFAMIGAQPWYIERGDFNIYNDGSIISADRAIDASKSNRPVELILRKGSVVVGNLIDLSNIELEGDTSFTGTDSRTDGYNIRLKSGGSVYVGGSSDSPTTMTFESAHSSINGDLYVDGNSALGLNLSKATDTKTAVLKVTGITQFEPGAQVKLAAKGDDFSANSTAYKLIEAGKIELLTKDGNAVDPAGKLDVVSTSALLKIDSYTVDGKNVVAVVTAKGREEVAQVVADNGGSVNEQTTLVNLTGDSIISKLNDSDAFKQLLLNADGGQLAKLASQLSPEINGGARSAATTSQGLISNVTGSRTSSIRGASSGEGFKDAGVWVQSLYSDATQGQRDGIAGYNAYSSGVAVGADGKLNDNLTLGLAYSFINTDVNGKSGNKTEVDSHAFTLYGGFEQGNYFVDTSLTYGFNDNQGKRSIAGTRAKADYDSDLLGLNLVGGYTYHVSPQVLVEPRVAARYSQVNIDGYREKGSSAALKVEDQRYETVELGAGMRVAGSFLLGAGTLEPQAKLMAYHDFAADEAQSTSTFLLGSTPFVTSGAKAVRDSYEAGVGADYKLGAVTLGVNYDYIGKSDFDADVFSAKVRYDF

SEQ ID NO: 19306 - protein, 765 aa, Erwinia carotovora
MVLMAAFVQQAQAHPERPPAELPTVDVDAPKRTAKPKPQVRHEAQRPKPGAPRSPAPATPADTAAAPAAPSGAPAVGSGPARPQGMASEVVITGEEINARPATRPGEVLEAVPGLIVTQHSGEGKANQYFLRGYNLDHGTDLALSVDDVPVNMRTHAHGQGYADLNWLMPETIGRVDVRKGPYFADEGDFASAGSVHIGLVDSVPKAIAQMTAGSFGYRRFFGMDSVHVGDGHLLIAGEAGRYDGPWTTPDDAKKLNGLMRYSQGTATDGFSITGMAYANRWTSTDQVPERAITSGDLGRFDAFDPTDGGKTNRFALSGRVAGTDDAGSWKANAYVVKSQLDLYNNFTYALRDPVNGDQFHQHDDRLMLGANASRTFNGSFAGRPMETTIGLQTRYDDIALALSYTNQRSFLRAVRNDKVGEGSVGLYVENSVSWTDWLRTTVGYRGDYYQTHVYSLYNGNNTGDAAASLGSPKFRMVIGPFNKTEFFLGAGYGMHSNDARGATTTEDPADPTNKLASSPLLVRTKGAEVGMRTRIIPGLDSSLSVFMLNQDSEILFSGDAGDTAASRPSRRYGFELTNHYRPASWIDIDADLAMTHARFVGTDSDQAATYAQLVGLGAPAEVLRGNAPGNYIPNAPSMIASAGITLGEKTGWFGGLRWRYLGSTPLTEDNYFRSTATSMFNGRIGFRDANGWRIQLDVLNLLNTKANQISYGYGSLLPTDQLYQDCYGRTPKGVPAQVCQAGVMDRVLHPVEPLTFRVTVAGTF

SEQ ID NO: 19307 - protein, 681 aa, Erwinia carotovora
MTSFHSGRGVKPLTLAISLALAASNVYAEESAVNESKVIESIAVVGQTTNTEITPDELEKYQANDLADIFRFVPSVSVGGSLGVAQKVYIRGLEDTLFNVTVDGAPQTGTLFHHIGRVAIDPELLKEVEVQAGAGEATSGAGAIGGAIRFKTKGVDDLLSSDEQFGGTIKAGYFSNDGYKTSGTFYGRLSDSWGVLGSYIYIDRDNMEDGDGNELYGTSAEQSLGYVKVNGELTDKQTLSLSYEKRNEEGEFGARPNWPTLEGDTLFPMEGERETFVLNHLFSANDLINLETSLFHTQSSVEQNRFDRWGLYGAEMKTYGFDICNISLLGDHTLTYGIEYRKDKVSSEYLADASVWQKWAWDPNIGKFQEEGEVKGMYLQDHWQINNELLLSFGVRYDQYDVEQVTYDNQTDSDGVSPNIGLNYDFHPNWRLTLGYAQAMRGKEVGDAFTLAQAPDWISIDPDLDAEKVDNTEIGLNYHDEHWQVTASVYQSDIDDVIYDQLGRDVYFENIGQLETKGFELKAVYWYEDWRVQASYSNNDAELNGNTVEGYEHIGLANARGDTLGLNVNYALSDNLEMGWNFSYVSDLNDIEVLQRGVEIGWIEQTQTIDKPGYQVHDIYVQWVPLSSESLTVNLAVQNLFNEQYRDHSSVGDYNKIKGWEGVAGLYEAGRDIRVSMTYQF

SEQ ID NO: 19308 - protein, 377 aa, Erwinia carotovora
MKARILVGAAALMLGNAASAQSSVTLYGVIDAGITFVSNANKFGEKLWQTQSGIAQGSRFGMKGAEDLGGGLSALFQLENGFDVFSGRLAQGGLLFGRQAYVGLSDTKLGKLTLGRQYDSIVDYLQVTTFNGNYGAYFSHAGDIDNSDNGFRVNNAIKYTSPSIAGLTFGGMYALGGVAGQFGRNSTIAAGLSYQHGPFYAAAAYMYAKNPATQFPDGNFVPNGANGAPTANGPFGYVGIPSNEQVFGLGVTLQASNWLLGANFTDARFDGANGTTSRVRFDTAEGWASYCVNAAMTLAAGYQYTWAKADYNDSRPHYHQINAMADYYLSKRTDVYVMGVFEKAGGGAKASIYNGLLGSEASGTTQVAARVGIRHRF

SEQ ID NO: 19309 - protein, 405 aa, Erwinia carotovora
MVMRTRFTRFLVCFGLTLLFFGTAAHAQEFQKDSISKWDINYGGKGIYFTAPDNAFSLHIQSRLQFRFATPSDNDPVTFNDFNDGENSVFKINRARLKVGGHAYKPWLKYYWEYELGRGNLLDFRVMIERWKWLNIKIGQWKIEYTRERRISSGAQQLVDRSILNRSFTVDRQQGVELYGRLEGRGAADVSYWAAVLTGAGRAATDNDDKNLMYFGRLQWNLLGDVLGFGGTSDLVIHQKPEALIAFSAVTNRSPFTRFSSSGGGFLTDFEQQEPGQYRINQGNIETAFVYKGFSWQSEVHHKEILDKLNGGRTQLRGYYAQAGYFAHQAISWWPKQLEVAARYANFNPDIDQPITLDEVSLAFNWFFNGHRNKLTAEVSSFDYENADNTLENELRFRLQWDISF

SEQ ID NO: 19310 - protein, 696 aa, Erwinia carotovora
MKKICLSVCAIGLLSSYAISQNVELDSSIVSASGFTQDIKEAPATINVISKKELQSKPYRDVAEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVQGDQAQSPTKANNFNIGTRISYLANDYNTFIFDIDFSRNHYDNKQGQLGTITSPGSAPDSLTGGYADIMEVDKFVTYLSHEGVYENFSITSGLQYNRVSNNGREVVGQANQPFLGQNRDIVAEDIILDTKSVIPLGQSHILSAGGEYRLEKMQDKIANPTNFDQYLLAIFAEDEYSIKDNLRLTFGARYNHHEIFGNNISPRAYLVYNPTDELTLKGGVSTGFRTPYANRLINGAYNYSGQGRFPIYGNPDLKEETSLNYEIAAIYNNDLFYVSATGFLTNFKDKISTQRYDKGNMIPGIGTCDADRCFKAINHGKVEYKGIELGAGISPLDNLNVNFAYTYLDSEVKEAQDKSVIGKPEQDSLKHNIMLKTEYSFYNKITPWIKGEWQIDRYMGDTNINREYYKDIFFASMGVRYDINKQWSINAAIYNLFNKSFTDGWESYQNSGAPTWVNTYNRIEEGRRMYISINGSF

SEQ ID NO: 19311 - protein, 248 aa, Erwinia carotovora
MNQLTAYTLRLGDNCLVLSQRLGEWCGHAPELEIDLALANIGLDLLGQARNFLSYAAELAGEGDEDTLAFTRDERQFSNLLLVEQPNGNFADTIARQYFIDAWHVALFTRLMESRDPQLAAISAKAIKEARYHLRFSRGWLERLGNGTDVSGQKMQQAINKLWRFTAELFDADEIDIALSEEGIAVDPRTLRAAWEAEVFAGINEATLNVPQEQAYRTGGKKGLHTEHLGPMLAEMQYLQRVLPGQQW

SEQ ID NO: 19312 - protein, 172 aa, Erwinia carotovora
MKKIACLSALAAVLAVSAGTAVAATSTVTGGYAQSDMQGVVNKANGFNLKYRYEQDNNPLGVIGSFTYTEKDRFEDGAYNKAQYYGVTAGPAFRLNDWASIYGVVGVGYGKFQQTENESLNRSASTSDYGFSYGAGMQFNPIENVALDFSYEQSRIRNVDVGTWIAGVGYRF

SEQ ID NO: 19313 - protein, 1093 aa, Erwinia carotovora
MAILTGAVPVSAYAVCSATAPGSGTTVTCTGANAPSVVATAGSTGVTINLDSTVTGSYVLTSAPTPFSVDTSSTITNNGSLSMSGNGTGVANRGAVLLGVNNGNTLTNAATGVISTSGTYNDGMAANGNNNTLVNNGTITTTGNNAYGMTAAWGQSNPGASGNQIVNTGTVTTSGNNARAASLLGGNGTITNSGTLTSNGRDAPAVYMQGNNDTLVNSGTIQTTGTATSGGSVDAVVSNTLGSSFTATITNQAGGRIVSNNGIGVRSTNGATTITNAGLIQGGGGTAIQGGNGNVTLILQTGSQIVGTANGGAGTNTVTLQGTGTASNAFTNFQRLTMAGTDWTWGGTGTFSTALVQSGTLNLTGTLGTTTASVVATVNAGATLQANASNLPLSVTDNGLVRFQQDSAGTYTGTIAGAGAVEKTGAGTLTLTPSAAGGNTYSGGTTITQGTLSVAADNALGASSGRLTFNGGTLQFGSAFNLASSRAISTTSNNSAIDTQGFNTTIMQDITGSGGLTKLGDGTLTLNGVHSTYSGGTNVAAGTLIVGDLDAAAGLRGGGPLTIAPGATLGGYGSVTGNVTNNGTISVANALPSLASSLPGDFRIFGTLTNAGVVELRGRVVGNGLAVSGNYVGQNGAVNMNTTLAGDGAPSDTLLIGGVPAVATASGKTTLNVTNVGGAGALTKSDGIRLVYAVNFANTGNAFTLAGGTVSAGAYSYYLVKGGVTALTGEDWYLRSTVPPRPDQPTQQPPFSVADGTPESIVEAVKNAAPDAKPEPVYRPEVPLYSEVPAVARQLGLLQIDTFHDRQGEQGLLAENGSVPVSWSRVWGGYSNIKQNGDVTPSYDGTVWGMQVGQDLYADNRPSGHRNHYGFFLGFSRAIGDVNGFALAQPDLGVGSLQVNAYNLGGYWTHIGPGGWYTDAVVMGSVLTVRTHSNNNVSGSTDGNAVTGSVEAGVPISLGYGLTLEPQAQLLWQWLSLARFNDGVSDVTWNNGNTFLGRIGARLQYAFDANGVSWKPYLRVNVLRSFGSDDRTTFGGSTTIGTQVGQTAGQIGAGLVAQLTKRGSVYATVSYLTNLGGEHQRTITGNAGVRWAW

SEQ ID NO: 19314 - protein, 362 aa, Erwinia carotovora
MMKRNILAVVIPALLAAGAANAAEVYNKDSNKLDIYGKAVGLHYFSKDNGKNSYEGDGDKTYARLGFKGETQINDQLTGYGQWEYQFQGNNSEGSDAQSGNKTRLAFAGLKFGDAGSLDYGRNYGIVYDALGYTDMLPEFGGDTAYSDNFFVGRVGGVATYRNSNFFGLVDGLNFGVQYLGKNERDSANRSNGDGWGASLSYEFEGFGIVGAYGAADRTNAQEAAFYGNGEKAEQWATGLKYDANNIYLAANYGETRNATRFTNGLTNNSGFANKTQDILLVAQYQFDFGLRPSIAYTKSKAKNVEGVGSEDLVNYVEVGATYYFNKNMSTYVDYIINQIDSDNKLGVGSDDTVAVGIVYQF

SEQ ID NO: 19315 - protein, 379 aa, Erwinia carotovora
MKFKLLAIAATSAAASLAASSAYAQSSVTLYGVADAGVEYLNKAAASNGGVQPGTKGQSLFALQSGNQSGSRWGLRGIEDLGGGLKGIFTLESGFNVDDGKMGQSGRLFGRAAYVGLQNQWGRLTLGRHTTPGFDFGLAFDPMSISSRYSITSQDPWFASRADNSAKYMGTFGGLTVSALYSLNNNNQEVPGNFTNGREYSFSAIYAAGPFSVGAVYDQTNRSQATALSTNKLTRHAAIAGTYAFGQAKVFAGYRYAHAYNGDVLVGTPSHANGSSNLAWAGLGYQVTPALSLAGAAYYQNLRNANAGNPWQFVALADYSLSKRTDLYASMSYALNNGKSTLGVNGFNDQLGSATSSNSEGVQPGANQFGAVVGVRHKF

SEQ ID NO: 19316 - protein, 357 aa, Erwinia carotovora
MKKAQRVMARASMRKVAGTLGVAAMLSAGLALTSVGARADSGSQVQLYGIVGTYVGSVKRSDTPQSTVLIGSGGLTTSFWGIRGKEDLGGGVSAIFALESFFQPQNGAQGRNATDPFFSRNAYVGFQGDFGQLTFGRQRNPTYTAESLINPFSSSTVFSPLVLQTFVTNYGGTIIGDTVWNNTAKYTTPDFKGFGATVIYGLGGVAGSPGVGNLGAHLNYQGHGLTAVVSGQRVRYTAAGPVGAQYAYLAGAAYDFKLVTLYGAWAMTSDVSTPTGSHTYEAGFSIPFTPADFLLAEWARTQRSGPTHTTNSLRNTAALGYDHLLSKRTDIYAIYSIDKLSDHPIGNTFAVGIRHTF

SEQ ID NO: 19317 - protein, 1059 aa, Erwinia carotovora
MKAKFSSILTLLLAFVVQITFAQQQTITGTVTDEDGLPLPGVNVLIKGTNTGTQTDFDGNYSIGAEQGDILSFSFVGLQTSEVTVGSSNQINVTMQGDAAQLDEVVVTALGVRATPRSVTYAVEGVTAEEIENTGETNLVNSLSSKAAGVNVVSASGSVGASSNIRIRGNTSINRSNSPLFIVDGVPIDNSSSGNGVGDVDQSNRAIDINQNDIASIDILKGTAAQTLYGLRAANGVVIITTKKGQSGAPTVNVSSTIQFSEVNQLPDLQQEYAQGRPVEGQPTYRGPETGEGFSWGPRISSLEYDGDTSYPYSRFGRLVPEGEGNGMPAMAFDKSDFFVTGVLNEQNVSVRGGSEKVKYYISGGKLNQTGVAPKEEFDRRSFRGDISASLTDNFEVSASGNYINSGGRRVQRGSNVSGIMLGLLRATPSFDNGNGLDGRDAANTPSSYELPDGRQRSYRGGIYDNPYWTVAKNPSFDDVKRFIGRLSFEYKPFDWATVQGTYGYDQYSDVRKQGVDINSAGNPQGQVYDSNIFSEDINTQLLVLFNKNISENITFNSILGYDGFRTESLLRDVLGNGLTIPGFFNVSNTASQATSESLLNRRNLDAFLSEVKFGINETLFINGAFRNDWSSTLPEDDNSFVSYSAGVSFVFTELLNSGFMNYGKLRGSYGKTGNDAPAFGTLTYYNAATTGGDGFIDANQFPIFSTVAFERSAQQGNPNIRPEVTKEFEVGAEFRFWDSRIKLDVTYYDKETTDQIIPVDQPAVTGFTSRIVNAGVISNKGWEALLGIKPIQTENFTWDIDANFSTYENIVEELAENVESITLAGFTSTSSRVIAGEPYGAIFGSRFDRNENGEVLIGDNGFPLVNPEDGVIGDPTPDFNIGVRNTFSYKNFSLSALLDIREGGDVWCGTCGIIDYFGTSQKTAEQREITDFVFDGVNANTGETNTQEVALANPENGLGSYRWVRYGFGGVSEDYIYDSSWVRLREASLTYRLPSVLLDNSFLTGGSLTASARNLFVITDYPGIDPETNLTGASNGVGLDYFNQPNTKSYALTVKLNF

SEQ ID NO: 19318 - protein, 739 aa, Erwinia carotovora
MGCLPKFWKWKANRNLSLMGLCLLPSMPLYANEVLGEPKVEPIEILQVHGQQYRRAITVAKPGEAIISMEQIEEMQATTFAEVIDDMAGAHIDGGTRSGGERINIWGFGETEDFNVYVDNAPVGFEQYRYGSFFLDPDLIKRVEVIKGAHDVRSGNGGFGGAMYVVTKSADDFLKYDQAIGARVKTSYASNNDAVGYTGTVYGRVNSHLSGLLHLTRRDAGDVTLANGDEFEYSGYGQDNYLGKIDYEQGDHQLALSVTHYLDEGRKPWANRRGPMPAISDYNIKKYGSYEQALYATTAYNTYEDNTWSANYRYSPSNPLIDTQVVISHSANARHWVRPDIAWEKMTVSVGNFGHESWLDYKREYIDINNLSLIGDHEITTGLQYRSLDRTSLVFNKSYEKNPEKNFGWYTPYYQPEGRQDTYAVYVRDAIHLTNDLTVTPSLRYDFIYSIGRPNIAPDYNDISAGHDYSSTHHSGFSPRLGIDYQLTNYARLNFDYAYSLQAPVVDEIYAVQYVKASITGTSRDIDVERLHAFKLGLMTQHQHLLANDDALSTQLTLFANLGRDDIAQRRGAKSDKTQLIQSGYTNLDGYHIYGADFEAQYRYQDVFSDLAVSWLQGQHNGSLRDSQDDDEYLANMAPLDIRLRLGMYITDDISVAWQGAWYDAQTSVPHGDIFNAESPSENYFLQNLYLAYEPQAGLKGLSVRLMVKNLTNLQVVPFLSDGIPAAGRDVRLSLAYEF

SEQ ID NO: 19319 - protein, 412 aa, Erwinia carotovora
MKICHTLPFALLGAGVIAGLPGTSLAAGFVEDSKATLGLRNFYINRNFTNPSNPQSKAEEWTQSFILDARSGFTEGPIGFGVDVLGLWSVKLDGGGGTYGTALLPRHDDGKPADDYGRLAVAGKARISKTELKIGEWMPVLPILRSDDGRSLPQTFRGGQVTSNEIAGLTLYGGQFRGNSPRNDASMEDMSYGGGVSDRFNFVGGEYKFNKDRTLVGLWNAVLKDVYQQQYLQLSHSQPVGDWTLGANLGYFHGDEDGSERAGQLDNKTYSGMFSAKYGGSTFWVGLQKVDGDTWMRVNGTSGGTLANDSYNSSFDNANERSWQVRHDFNFVTVGVPGLTLMNRYISGRDVHSGGVTDGKEWVRETELAYVIQSGAFKDLSVKWRNSSIRRDYSNNEFDENRLIFNYPLSLL

SEQ ID NO: 19320 - protein, 149 aa, Erwinia carotovora
MVNYDAPTSEESGDMFLGEIYYRYMPTHNFGIEAGYKGAFDGIGSILISPISEVTNTSFSGPRLSGYASYPLGAGFEVYGKAGMTYYTLAYTYSVNDQSRDIEKSRLGGEAAAGLGWSYKHFGLNAEYVYSKNSDFDSGGVMFGAQLRF

SEQ ID NO: 19321 - protein, 359 aa, Erwinia carotovora
MKKTAIALVVAGLAAASVAQAAPQENTFYAGVKAGQGSFHDGINNNGAIKQNLSSANYGYRRNTFTYGVFGGYQILNQDNFGLAAELGYDNFGRVKLREAGKPKAKHTNHGAHLSLKGSYEVLDGLDVYGKAGVALVRSDYKFYEVANGTRDHKKGRHTARASGLFAVGAEYAVLPELAVRLEYQWLTRVGKYRPQDKPNTAINYNPWIGSINAGISYRFGQGEAPVVAAPEMVSKTFSLNSDVTFAFGKANLKPQAQATLDSVYGEISQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 19322 - protein, 363 aa, Erwinia carotovora
MFKKTLLGAAIALVASGVTAKEVGINSDFNVDVYGVAAISLVNYNVTDNNDNSKGFVVENESRIGFRAHKEMFENVLITMQIESGYVDSTDWPHGGVSGGVLGFRDTFIGASGDWGNVRVGRVLTPLYEIVDWPFSNPGLGSVFDWGGIAGHYDRQSNQVRYDSPKFGGFSFAASVGRDDDNNGGGNATRDASFVGANAKYSFEKITFMGGVESGTRVTPAKDAGFEFNPETGASDPVAATPEVQDDAFAYIVGFEASLPAGFGIAAAYKGEELDNSARKVTQDSYSIIGQYWNGPIGFKLGYAANLESETNGKTDKNSDSNTISGQLMAVHNGFVPYLRVAGRTEGDNDTDIVTRIGLEYGF

SEQ ID NO: 19323 - protein, 479 aa, Erwinia carotovora
MKKRNLATVLCALSATASGSTLAAELELYVDRKTKQIFAEPAPGRDKLGKFVQVDENGKLPASALPEAPAAPVTATAPSTGVAQAAPPAPAAAPVPTAASDAPKKWYDKLSLRGYTQIRYNQGIGGDAQDLRAPGDRFIGNDQSLGIRRARLVLSGDLNEHVSLYFQPDFASTPTGSTTSNFAQLRDAYADIFFDKKREYRVRVGQSKMPYGWENLQSSQNRLTLDRADALNSGLRDERDIGAVFYYSPTVAKGRFQDLVKSGLKGSGDYGVLGAGVYNGQGANRAERNDGMHAVVHATYPFKLANGQYLEVGADAYAGKFVPTAAAVNIGGRSFTPTITEPNGYTDQRVAAHIIYYPQPFGLQAEWTVGRGPELDVAQRRIRTRSLSGGYVQAMFKHDFNYGTLLPYLKWQTYRGGSKFDTNAPRMRLDEVEAGVEWQPMDALELVFAYSKMKRTDVTTAPYPVVEGDLLRLQLQVNY

SEQ ID NO: 19324 - protein, 686 aa, Erwinia carotovora
MTPLPTRRHLLFVSLFAAMPAAAQEASLLDAIVVSEKRALYRPEKAAGATRTQTPVERIPQAIQVVPRSVIDEQQLTRLVDVVANVSNVQPGGTQGNRSETFVIRGFEASSYAVDGILLNPTQNFTETVRDLANVAQVEVLKGPAAVLYGRGEPGGVINLVTLRPDAVFGGNASVQVAEHGLRRVQSSVTGPLSPTLSARLSAAVQQTGSFRDAQADGDRVFVSPSLAWRPNERLRADLDIEYTRQTSPGDRGLVAIDGVVRGPAQRSFGEPWSRNRGISRTARGRIEVDATDWLTLRQIVNHQDGDSGRGVADFTGFSADRAFLQRRAVRQDQQVRATTSQTEALARFDTGPLRHQVLAGAEYVDAHRHTDEARAPLARISVRTPVQGALPGTYVPAREIAVDARYAALYVQDQISLGERWDVLAGVRWDDVQQTTLDNGSRTREDGRRASPRLGVVWKAAPQLSLYANTSTSFRPRSASVFAGGSAPPETGRQYELGMKSALLDNRVLATVAAFQITKDNVATADPNNDGFVLVTGQQRVRGLELDVTGELTPNWRLILGAGYLDAQVTRDTVIASGNRLRGVPRVSASLWSTYHVASGPLYGLTLGAGAVHVGEREGDLANSYRIPGYTRFDASAAYRFGGRYQLALLLRNLGNRFYIEQPVTQTTNYPGAPRTLSATLSMEF

SEQ ID NO: 19325 - protein, 734 aa, Erwinia carotovora
MLSVPVVHTPSPLPRRRALPQALARGLLIAALGSSGIAAAQSSTDPAKDSQAPASQTLQTVQVTANLLGTITEGSGAYTPGTIATATRLVLTPRQTPQTISVITRAQMDDFGLHGIDDVMRVTPGISIVTYDSERTEYYARGFAIQNFQYDGIPMSRNSAYSAGNTLSDTAIYDRIEVLKGATGLLTGMGDPGATINLVRKKPGKDFAGSASLGVGRWDDYRAELDVGGPLTADGRVRGRAVGAWEDKRSNLDNYQRTSKVGYAVVEADLGDRTLLSVGGDVMDSDPKGSTWGGIPLLDSAGNFNRMPRSFNNGAQWAGWRQYVRTGFTTLEHTFANDWIAKLQLNHQVNGYDAALAGAAAGNPDPLTGEGVSLWLGKYVGKTVSNAADFYVSGRFGLFGREHELVVGGSASRKRWTNTGYGPQAGFPDTVPDYRTWNGDIAEPQWQRTYDNNEVTRENGLYVVGRFDLADPLKLIVGSRLASYRSPDTRETGVHVPYAGVVYDLGEHYSVYASYSTIFKPQGERDEQGKALDPLEGRSYEVGLKAEFFDGRLNASAALFQLDQDNFAQPTGGKTPDGQDAYRALMGVRTKGYELEMSGQLAEGWQVQGGFSHKIARQAGTKVTTLEPENQFSLHTRYRLRGAWQALTLGGGARWQDSTFGEITNPATRAKVVHRTQPYWLLDAMARYQFNDRLSATVNVNNLLDKRYYTIFNWYSTYTWGEPRNVRLSLNYRF

SEQ ID NO: 19326 - protein, 102 aa, Erwinia carotovora
MSFGGLLKGTAWGRPNDVVGAAFSLNMLGPDHRAYLAAGGSGAFLGDGALNYGHERVLELFYSFQPVKGLMLSPDFQLIQNPGYNRDRGPAKFYGMRVHAEF

SEQ ID NO: 19327 - protein, 383 aa, Erwinia carotovora
MKPFFSYSLTASAVLLSFNAFSSGLFLQEATVANAGTTGAGDGVYTESAAAMWTNPATMSYMGESKTTINAMAFDLEMKFNDNNGSEDGRAHSILPSAGAFHTQAITDKLHFGLALGAVGGSSLDYGSDWAGSKLLEDISLTAMQLNPALSYQVNERLSLGAGLQFSWASFEQSMSGITAEKDSDWAYGYNLGVMYQVSEQASMGLSYRSKLEHEFNNNISLGNFNPTLSSGMIMPDIVDLSTSYALSKDVNLLSSIQLHRWSHWDSTILDANLGNGGAEIKRDWDDVWKFAIGADYRLNSDWRLKAGFSYETSPQDDPSMQWVDLPVGEQYRYSVGASTSWDGITMDMFYEYADLGSVDMDRLNVDGSFDGRIHFVGVNFTF

SEQ ID NO: 19328 - protein, 413 aa, Erwinia carotovora
MMLKRSYLSLLVLSALAIPAVADTSIDQMFSQGTLKGELRLFDFTRDFDDTTNTKHDTSFGGLFYYNTAKVNGISFGTSFATANPIWTNDSDDVYGLVARDANGNHDSVNRLQEYFVQGDWWDTKFKLGAQELRTPMMNPHDIRAIPRTFRGFSAENKSIDNLTLSALYITDSMGWSDNSFVSVKEAVQSELARAGVIADVADNPVYALGAKYQLPFETVKTVVNLWHYRMEDVFNQTFAKVNLSTQLGATNVYLTPSYLTQQSMGEESGGSLDTYQYGFHLGAKFAGADLTYIYAKTGDDTVLTPWGDEKVVIQQVNQSARANEEVNALKVAYDFGKIGVNGLEAYAFYGQYDVPEGNAKDFAETNFSITYKFDGALSGLGLRARYALVDIDQGEDFDDLRLYVTYKFVLGK

SEQ ID NO: 19329 - protein, 681 aa, Erwinia carotovora
MNIKKTTLKTALLSFTLAATLLHAEDDGYFVSIGYQIGGSTQMVKNAGAIKNLNDQYELLNSYLAQIADLRSSILRANNTQAITSAISSLKSFAEGNQSNKDTSPIYNITQSIISSVTAMWQLVGGNKTNFISLSQANCPQLAIQRHVFCEATYKEVEAAVKVLQAAASNLCPLSGCPTNGATGTTTAVATEVSSGSSSSGSSSSPNSNGTTMDVALQKVQFIMDTFSKYDVWIDWNFGGKTTFGDGKTTDGIPNQAYIKTYAFFNNIYQMLPLLQQALTLSTQNQNATQNLQAEAIGSGQSEQFKSNVYDAALTQQGIISNAQQIFSLFNSIPSEQLTLLQSAYFKLKSGCSASSGSSSSGSGSGNTGCQVPSNAKVVSLDAQISNIGNNVSYYGSATDTVLQTSKDIYFLQQNTENIQNAYKNATNLSQEIQGLSYNKINVANIVTASVNKNAPAIDKYNYVINQAQQSEMNSALAAMAKNPFRNVGLINSQSSNGVMNGFGVQLGYKQFFGEKKRWGFRYYGFFDYNHTYIRSDIFSSASNVLTYGAASDFLYNFINDRQMNWFKKGGKFSFGAYGGIALAGTSWLNQDKVILFNTPQANASNTPYKADVSSSNFQFLFNFGVRANFAENSKGKHAIQHGIELGLKIPTINTNYYSFLGSKLSFRRTFSFYLNYVFAY

SEQ ID NO: 19330 - protein, 718 aa, Erwinia carotovora
MLPLPFSRQPARLTLLALACLSGHSAFAEEPMQLDSLQVTGEQVSEVEAAREELNRVPGATNVVDMAKVEQGRVAGVADVLAYQPGVYAQSPGNEGVKISMRGSGINRGPGSHASGTHILLDGLPLTGSGGTPYELLEPLWISRAEVLRGANGFERGALALGGAIDYISHTGYTAPKLQLRYEVGSHGYQKRNIASGQVLGDFDYYVALTDSETDGYQDQSSGKGKGIAANFGYRLNENLETRFYLRYRETEHETPGRLTKAQLKDDPRQAAANNLRIDAHRDQPGSTWLANKTTWQIDDDATLVAGLAYHHYPMDIVETRLPNGNTYRIRVDYSDISGTLNYTRRHTLFGLNSVTTIGWRSTTNLPSSTSRETAALPINVESGGTTITYPAGTLMRDYEHLGSDNVLHFSNDTELMPDLWLTSGLALIHTRREAEVTWPATDDRLSEQTWDYAPRLGLRYQLNPDVQLFGNISRSVEPPHAWSMLWSSPLRFPTSNQPWSNRQSAAISLDNQTATTVEVGGRGDSALGQWELTYYYSQVRHELLTVEIEPNVFAESNASPTVHQGIEAGLTSPLWQGGAAGALSLRQAYTFSDFHYRDDDTFGDNRLPGLPRHYYQAEVRYDHPSGFYAGVNTQYASKVAVDYANSYYADAYATFGATLGYASPRDDWQAWLDLRNLTDKRYAATVTPGYNDNGADAARSTPGEGFGVYTGVSWSWL

SEQ ID NO: 19331 - protein, 358 aa, Erwinia carotovora
MKAFARRASRTSVNLIAAAACVAAAAPAHAQSSVSLYGQVDEWVGATKFPGSDRAWNVSGGGMSTSYWGLHGAEDLGGGYKAIFTVESFFRAQNGQFGRFQGDTFFARNAYVGVSSPYGTVTAGRLTTHLFLSTILFNPFYDSYTFSPMVYHVFLGLGTFPTYPSDQGAVGDSGWNNALSYTSPSFGGLNFAAMYALGNTAGDNRSKKWSAQFNYANGPFAATAVYQYVNFNNGPQDLSSLVTGLKSQGIGLVGATYDLKYVKLFGQYMYTKNDQATGSWHVNTAQGGVSVPLGVGNAMASYAYSRDAGGLDQTRQTWAVGYDYPLSKRTDVYAAYMNDHISGLSNGNTFGAGIRAKF

SEQ ID NO: 19332 - protein, 424 aa, Erwinia carotovora
MQLKPASRTVLSASIAAIALGASNVASAAFIEDSKAAVELRNFYMNRDFRQSGATQSKAEEWAQGFILKMESGYTEGPVGFGLDAVGLLGVKLDSSPDRTGTGLLQRDRNAPNRAQDDYGSAGLTAKAKLSATTLHVGTLQPVVPVLMRNDSRLLPQTYRGAWLQSKEVSGLTLDLGKLDRVNQRDSSDNEEMTVFNGGLRNITFGSGGTTSDEFLFAGGRYDWSPQLVTSYYYGGLDGIYDQHNFNLVHVLPLGDKQSFKTDLRYVRSTDDGGSNVDNDAFGALFTYKHGGHAFTGGYQHMSGDTGFAYVAGGDNALINLLQINDFGNQDERSWQVRYDYDFAAMGIPGLSLMTRYVSGDNVDRGAGASEGKTWERNTDIAYVIQSGPLKNLGLKLRNATTRSNFQSDLDENRVIVSYSLPLW

SEQ ID NO: 19333 - protein, 317 aa, Erwinia carotovora
MYLKILATALSAPVAFAALASDTGLSFTPEKISTEIDFGTLSGKAKERVYLPEEKGRKASQLDWKYSNAPIVKGAFNWDLLPRVSVGASGWTTLAGRGGNMVDRDWLDTSNPGTWTDESKHPNTRLNFANEFDLNIKGWLLNQPDYQLGLMAGYQENRYSFTAKGGSYIYSSEGGFRDETGSFPDGERAIGYKQHFKMPYIGLTGNYRYDSFEFGGSFKYSGWVKASDNDEHYNPEKRITYRSDVNNQNYYSVSLHAGYYITPAAKVYVEGTWNRITNKKGDTSLYSRNLNISDHTKNGAGIESYNFMTTAGLKYYF

SEQ ID NO: 19334 - protein, 705 aa, Erwinia carotovora
MAINIRKSVALALVTMATTPVIAAQDDTMVVTASGYEQKITEAAASISVVGHDELTKRKYNDLGEALSDVEGVDVRSSTGKTGGLDISIRGMPSDYTLILVDGIRQNGSSDVTPNGFGTMNTGFIPPLAAIERIEVIRGPMSTLYGSDAMGGVVNIITKKASKEWVGNITLDHTFQEDRDYGDASKFSIYSSGALIEDKLGLALRGNIFRRDASEVSSSSTGQELSMRGPNPVKSDNYLLGGKLSWLLDSRNTLWLDGEVSNQKYDNKEEQLGALGAGTAARGGGYEDTLRYERRKITLGSDNQLDFGTWNSSLSFNQTENKGRLIPRSTVPAGSTASGQKRELKNTNYILDTKLVSPLGDSHLVTLGGQYWNAVMKDGIVLANTGEKFEQNSWSLFAEDEWRIVDSLALTTGARYEHHEAFGGHVSPRAYLVWNALDELTIKGGVSTGYKTPSLARLHNGISGVTGQGTINTIGNPNLKPEESVNTELGAYYEHFSGFSTNATLFHNRFRNKIDSYEIDTVTSSYRNIGKANTQGLELGSTIPLWSDNWTLNVNYTFTDSEQKGGENPGARLTNTPKHMANARLNWSVNEQLSTWLKAEYRGKTARFTENYDQLSDANKVVHDNLGSDFKSFTVVNLGGSYKISKDVTLNGSVNNLLDKDFTKTYVLPVGTGTTTAGDYFTSSQVTTGSVVPGRNYWVSVNVNF

SEQ ID NO: 19335 - protein, 510 aa, Erwinia carotovora
MKKTTLFVLGLLFNSFLNAVDGISKTDLSSLNLAEDSAPLNHPNAQKLSLKNAWTRVLSNHEGLHAQEYAIKRASKMKLAAKLSFLPQIDLSAFYVYLSNPIKMDFASQKQPGVQKATNQIHQGIQNIQQNIPSQVLTPQIQAGMQGVMQGFGALSSTLEAPLLFSKQNVVIGALSIIYPLYMGGARFTMVRIADLMQKDANEVYRLKKLSTFQELVSVYYGMVLNAEVAETLEEVEKGHYKHFQNALKMQKVGQIARVETLGAQVAYDKAHIASVKAKDVLEVSQLSFNSILSSKDDLVPSSKLEIRTEKNLPDLSFFVSSTLNSYPVLKTLENQIQISKENTKLQIAKFLPQVSFFGSYIMKQNNSVFEDMIPSWFVGVAGRMPILSPTGRIQKYQASKLAELQVSSEQIQAKKNMELLVNKTYKETLSYLKEYKSLLSSVELAKENLKLQEQAFLQGLSTNAQVIDARNTLSSIVVEQKSVAYKYIVSLANLMALSDHIDLFYEFVY

SEQ ID NO: 19336 - protein, 388 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQKQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHK

SEQ ID NO: 19337 - protein, 1060 aa, Candidatus Rickettsia andeanae
VTLKAGGSLAANNIDFGARSILEFNGPLDGGGNIIPYYFKGAIANGNNAILNVNTKSLTAYHSTIGTVAEINIGAGNLFTIDASAGDVTILNAQDINFRVPDSALVLSNFTGVGAKNILLAADLVAPGADEGNVVFDGGVNGLNIGSNVAGTARNIGDGGGNKFNTLLIYNAVTITDDVNLEGIQNVRIENNADFTSSTAFNAGIIQINDATYTIDANNGNLNIPAGNIQFAHADAQLILQNSSGNDRTITLGANIDPDNDNEGVVILNSVTAGKKLTIAGGKTFGGAHKLQTIVFKGAGDCSAAGTTFNTTNIELDITGKLELGAAKANVVLFNDAVQLTQTGHIGGFLDFNAKNGTVILNNNVSVAGAVQNTGGTNNGTLIVLGASNLNRVNGIAMLKVGAGNVTIAKGGNVKIGEIQGTGTNTLTLPANFNLTGSINKTGGQALKLNFTNGGSVKGVVGTAANSVGDITTAGATSFASSVNAKGTATLGGTTSFANTFTNTGAVTLAKGSITSFAKNVTATSFVANSATINFGNSLAFNSNITGSGTTITLGANHVTYTGTGSFTDTLTLNTTFDGAAKSGGNILIKSGSTLDLSGVSTLALVVTATNFDMNNISPDTKYTVISAETAGDLKPTPKENVKITINNDNRFVDFTFDASTLTLFAEDIAADVIDEDFAPGGPLVSIPNAANIKKSLELMEDAPNGSDARQAFNNFGLMTPLQEADATTHLIQDVVKPSDTIAAVNNQVVASNISSNITALNARMDKVQVGNKGPVSSGDEDMDAKFGAWISPFVGNAKQKMCNNISGYKSDTTGGTIGFDGFVSDDLALGLAYTRSDTDIKLKNNKTGDKNKVESNIYSLYGLYNVPYENLFVEAIASYSDNKIRSKSRRVIATALETVGYQTANGNYKSESYTGQLMAGYTYMMPENINLTPLAGLRYSTIKDKGYKETGTTYQNLTVKGKHYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 19338 - protein, 196 aa, Wolbachia endosymbiont
SYYVRLQYNGEFLPLFTKIDGIDYKKGTDIYSPLKASFIAGGGAFGYKMDDIRVDVEGVYSYLNKNDVKDVVFTPADTIANSLTAISGLVNVYYDIAIEDMPITPYVGVGVGAAYISTPLATAVNSQNGKFAFAGQARAGVSYDITPEIKLYAGARYFGSYGAHFDGEKADPKDAAQKVADKGAYKILYSTGGAEA

SEQ ID NO: 19339 - protein, 202 aa, Wolbachia endosymbiont
GPISDEETSYYIRLQYNGEVLPLFTKIEGIEYKKGTDSHNPLKASFIAGGGAFGYKMDDIRVDVEGVYSQLSKNNVDGAALTPADAIADSLTAISGLVNVYYDIAIEDMPITPYIGGGVGAAYISTPLKTAVNGQNSKFGFAGQVKAGVSYDVTPEVKLYAGARYFGSYGANFDKSGGEKDKGGHTVLYSTVGAEAGVAFNF

SEQ ID NO: 19340 - protein, 195 aa, Wolbachia pipientis
ISDEETSYYVRLQYNGEILPLYTKVDGIKYEKESEAQNPLKASFIAGGGALGYKMDDIRVDIEGLYSQLNKNDVTDAKFTPDTVADNVTAFSGLVNVYYDIAIEDMPITPYIGVGVGAAYLSNPSKADGVKDQRGLGFAGQVKAGVSYDVTPEIKLYAGARYFGSYGASFKKATASTNKDINVLYSTVGAEAGVA

SEQ ID NO: 19341 - protein, 108 aa, Wolbachia pipientis
  misc_feature (37)..(37): Xaa can be any naturally occurring amino acid
  misc_feature (78)..(78): Xaa can be any naturally occurring amino acid
VRNRWFSVMAGPSVRVNEWFSAYAMAGVAYSRVSTFXGDYLRVTDNKGKTHDVLTGSDDGRHSNTSLAWGAGVQFNPXESVAIDIAYEGSGSGDWRTDGFIVGVGYKF

SEQ ID NO: 19342 - protein, 149 aa, Wolbachia pipientis
WTVYTRLVVLVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSVV

SEQ ID NO: 19343 - protein, 471 aa, Campylobacter jejuni
MNGKVLCEVSVSFRSILLTALLSLSFTNTMQAAHHHYHRYDDKLRRQYHKKDLPTQENVRKEFCNPYSHSSDPIPLSQQRGVLSPICDLVSECSFLNGISVRSLKQTLKNSAGTQVALDWSILPQWFNPRSSWAPKLSIRDLGYGKPQSLIEADSPCCQTCFNPSAAITIYDSSCGKGVVQVSYTLVRYWRETAALAGQTMMLAGSINDYPARQNIFSQLTFSQTFPNERVNLTVGQYSLYSIDGTLYNNDQQLGFISYALSQNPTATYSSGSLGAYLQVAPTESTCLQVGFQDAYNISGSSIKWNNLTKNKYNFHGYASWAPHCCLGPGQYSVLLYVTRKVPEQMMQTMGWSVNASQYISSKLYVFGRYSGVTGQLSPINRTYSFGLVSPNLLNRNPQDLFGVACAFNNIHASAFQNAQRKYETVIEGFATIGCGPYISFAPDFQLYLYPALRPNKQSARVYSVRANLAI

SEQ ID NO: 19344 - protein, 182 aa, Wolbachia pipientis
SYYVRLQYNGEILPFYTKVDGITHTSGKSPLKASFLAGGGAFGYKMDDIRVDVEGLYSQLAKDTAVVNASETNVADSLTAFSGLVNVYYDIAIEDMPITPYVGVGVGAAYISNPSKASAVKDQKGFGFAYQAKAGVSYDVTLEIKLYAGARYFGSYGASFNKETVSATKEINVLYSAVGAEA

SEQ ID NO: 19345 - protein, 179 aa, Wolbachia endosymbiont
SYYVRLQYNGEILPLFTKVDGIAHKSGKDNNSPLKASFIAGGGAFGCKMDDIRVDVEGPYSWLNKDADVVVDTVAESLTAISGLVNVYYDVAIEDMPITPYVGVGVGAAYISTPLATAVSSQNGKFAFAGQARAGVSYDVTPEVILYAGARYFGSYGANFDKTDKDGKGELKVLYSTVG

SEQ ID NO: 19346 - protein, 184 aa, Wolbachia sp. wKue
SYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVG

SEQ ID NO: 19347 - protein, 188 aa, Wolbachia endosymbiont
SYYVRLQYNGEILPLFTKVDGITYKKDNGDYSPLKASFIASGGAFGYKMDDIRVDVEGVYSYLNKNDVTDAKFTPDTIADSLAAISGLVNVYYDIAIEDMPITPYIGVGVGAAYISTPLKDAVNDQKSKFGFAGQVKAGVSYDVTPEVKLYAGARYFGSFGAHFDRDAAAGKDKGELKVLYSTVGAEA

SEQ ID NO: 19348 - protein, 189 aa, Wolbachia endosymbiont
SYYVRLQYNGEILPLFTKVDGITYKKDNNDYNPLKASFIAGGGAFGYKMDDIRVDVEGVYSQLSKNNVTGAAFNPDTVADSLTAISGLVNVYYDIAIEDMPITPYIGIGVGAAYISTPLKKAVNDQKSKFGFAGQVKAGVSYDVTPEIKLYAGARYFGSFGAHFDKDDIAVSKDKGELKVLYSTVGAEA

SEQ ID NO: 19349 - protein, 182 aa, Wolbachia endosymbiont
SYYVRLQYNGEILPLFTKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYGANFDKTDKDGKGELKVLYSTVGAEA

SEQ ID NO: 19350 - protein, 191 aa, Wolbachia endosymbiont
SYYVRLQYNGEILPLFTKVDGVTGLKKSANDKTDTTDLYTASFMAGGGAFGYKMDDIRVDIEGVYSQLNKDTTVTGTAVPGAVAESLTAISGLVNVYYDVAIEDMPITPYIGVGVGAAYVSNPLATKVTNDKASGFGVAYQAKAGVSYDVTPEVKLYAGARYFGSYGANFGKTAKDDAGIKVLYSTVGAEA

SEQ ID NO: 19351 - protein, 192 aa, Wolbachia endosymbiont
SYYVRLQYNGEILPLFTKVDGVTGLKKKTTDTTDTTDLYTASFMAGGGAFGYKMDDIRVDVEGVYSQLNKDTTVTGTSVPAEGIANNLTAISGLVNVYYDIAIEDMPITPYIGVGVGAAYVSNPLAKKVTDDKASGFGVAYQAKAGVSYDVTPEIKLYAGARYFGSYGANFGKAAKGDAGIKVLYSTVGAEA

SEQ ID NO: 19352 - protein, 191 aa, Wolbachia endosymbiont
SYYVRLQYNGEILPLFTKVDGVTGLKKSANDKTDTTDLYTASFMAGGGAFGYKMDDIRVDIEGVYSQLNKDTTVTGTAVPGAVAESLTAISGLVNVYYDVAIEDMPITPYIGVGVGAAYVSNPLATKVTNDKASGFGVAYQAKAGVGYDVTPEVKLYAGARYFGSYGANFGKTAKDDAGIKVLYSTVGAEA

SEQ ID NO: 19353 - protein, 476 aa, Escherichia coli
MRITFSRTRPSLAWRIWIMAAVAVLSCHPARAQYRGPVAETAPSFSLDTPTSYANTPFTPPVEHMVSAWGNAVQNLNRKGIGLVIDYTSESALALDAGNAGDAGYAHQIGVQLDLDWDKLVGWRGFVTHAAIVNRAGHNMAADFGDRSLNGFQEIYGGGGNTAVHMVYVYGTQNLFHDRVQIAIGKLPVNIDFSASPLFCTFMNKSMCGNPKSLTRGAAGFGTYPGSTWGTRVRYWPMHGVYAQAGLYGVNPDLNTNRYDRTGFNFNTNLYTGVYVPVEVGLIPSFGRNQLVGHYKVGVAYDSSNYADNYYDVNGAPLALTRRAARMDTGKTQLWIEGDQMLIRNGHGPLNGFYVMAGLVRNTPESSPYLYQYYFGIVDRGFWRARPDDTFGIEVSRATASPDLVDTQWLDYAAGRKLPANATYPQSHISVLEATYNIHVCEGLSIQPDYQRIMRPNLQRNKPAIDAIGLKIHATL

SEQ ID NO: 19354 - protein, 931 aa, Actinobacillus suis
MKNKLNLISLALLSLFAVQSYAEQAVQLNDVYVTGTKKKAHKKENEVTGLGKVVKTPDTLSKEQVLGIRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 19355 - protein, 106 aa, Acinetobacter sp.
MSYGGGIDLLLDLITTHASSFGVLGGLRGLYNEYRTLNQVKANGNFNAVTRFNYRHNHSKYSIGISIPLIQRSVKIASNSGTYTNSIVLNEGASHFKAFFNYGWVF

SEQ ID NO: 19356 - protein, 805 aa, Acinetobacter sp.
MMRNADARCRRRRRFAVRHRRSRTADAVARRHPGQSKSDRPPFHFNCKRFSLPLPLRVPSPRPAAARHTSRRNRNLHRFMRSRRTPCRARTLRPWRASLPALITLCVASGAHAADDERAQHAARPAPASAPPAAHELAPISVSAAALADPTVGYQPRTSSIAGGDARPLKDIPQSVAVVSSAVMQDQQARSLDDVLGNISGITQTNTLGGTRDAFIKRGFGSNNDGSVLVDGVRTPVLHSYLATIDRVEVLKGPASLLYGMQDPGGVINLITRKPEDTFGGSISASRTSHGGSSALFDLTGPLGKPGQVAGGTLAFRLTGEYDTSRYWRSFGRERDALIAPALSWHDANTSIDVSYQYVDYTTPFDRGTVLVNGQLDESLRYRRYEEAWAQSSGIQETLRARIEHRLSDAWRVRATYGWGRDRYDQYITRATAFNGATGAMTRSSDANLGRNDSDQIATLGLFGNVTLAGIPHALYIGSEYERQRSFRGDTIRGKATKGFDLFDPVYGLLPAGGTPSAAQSDSRSVVHAYSMIVQDSVKITDRLTAVGGLRWEDWQQESGMGRPFAFSDRSHGNVWLPQFGLAYALTPSLTAYANVSRSFKPNVASNVAAPLAPEFGRVLEAGLKFSLKPGITGTLAAYQIDKRNVAVTVGDITSTIGTARSRGIELDVAGQITRHLSVIGSYAYTNANDRDSNTPLVNVARHTGSLFAVYDTAIANLPGRWRFGGGARLVGARPGDVANSFTLPGYMTVDAFAAYETTIGKFPTRFQLNVKNLLDKTYYPSSNSNLIVAVGEPRLVTFTTTVSF

SEQ ID NO: 19357 - protein, 698 aa, Acinetobacter sp.
MFMFATTRMALLIGGAIGGATFPLSAQETTKNDTVIVTSTVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 19358 - protein, 458 aa, Acinetobacter sp.
MKLGKLSLVAAVALGCLSYANAADTLAEAFTKGKLSGTIKATYADQTDERLPINNENIFGIGLELGYVTDPLYGFRIGATGQAYGSPFSPEKNAKTMYDKEWYANGAVLSELYLGYSIGKTDIKAGRQYYVSPLVAGNYTRAFKEAFEGVSIENKDIPDTSLRAAWFYKFQGRSKVAMDRADSKFDRDDVGRAPTFKDRVIFGGLGPYALKFDNIFTGAISNQSIPGLKLTAAYARATEVEYFANSKDDVNLYNLEANYKLPFDAFKLGFDVMYKGSRVNGAMDNAHLDGDMWNFRVGISELFGFSASYAYSTVSDDDAMILGIGNGPGSYTALPIRGPFVFTNYAGMDIHKITLGYDFGAIGVKGLKTSLQWLKGEQDTLSHNTHKGGSIGQQKGTHMDVKGWAAIASYDIPYVKGLSASATYVALERENHAANGAVTKPDNNELWLQLTYKFNLLN

SEQ ID NO: 19359 - protein, 189 aa, Acinetobacter sp.
MLEWMQYSPAAVAAGDEDRDAKFGAWISPFVGNATQKMRNNISGYKSDTTGGTIGFDGLVNDDLALGLAYTRADTDIKLKNNKTGDKNKVESNIYSVYGLYNVPYENLFVEAIASYSDNRIKSKSRRVIATALETVGYQTASGKYKSESYTGQLMAGYTYMMPENINLTPLAGLRYSAIKDKGYKETDY

SEQ ID NO: 19360 - protein, 928 aa, Acinetobacter sp.
MNTSAQTGNISGLIADGNGISVPGASVSIDGLRKGDISKFDGSFIILSVPVGKHTVRISYLGYDDLKKDVLVQENETTTTKFELKSGGIALEGIEITAYSLSGQSKALNIQKNNLNITNVVSTDQIGKFPDANIGDAVKRIPGITMQIDQGEARNIIIRGLSPQLNSVTLNGSRIPSAEGDNRNIQMDLIPADMIQSIQVNKAVTPDMDADALGGSVNLITRTAPQGFRLSSTLGSGVNTITNKRILNGSFLLGNRSNNGKFGWMLAASANDNDFGSDNIEAEWSDEFSYNDGRDEVGVAVNPYTNVFEQRTYLVQRVRRSFSANFDFQVNENNNIYLKTMYNWRDDRENRYRFEQEILDAEDIGIGDFTITDNTPTRFPVEIKRQTKGGLDNNRNRNTRLEDQKMQNYSFGGNHILGNLKIDWMSSFAKASEERLNERYAEFKSEYQINNDISDARLPLFTPVNSADFSNLSNFEFGEITEENKYTKEEDVNAFINFELPSDFFGYGEGFVKFGARGRFKTKLRDNNFFEFDLESAFPTLASAPNKDYSDSDYLAGSQYESGVFASEAWLGSLSLTDGDTVDDEFLRANYNVEENVWAAYLMTNQKLSEQLSVLVGLRFEQTNLTSTGNNILDEDTLAGTLTKKSSYANIMPGVHFKYDASKNTVLRFAWTNTLARPNYADITPTLDIVASDEEVFTGNPDLAPTTSMNFDVMAETYFSNVGILSGGLFYKNINDFVYTFQSETTADTFGPETTGFEVFQPLNGDKASIFGVEVALQKKLDFLPGVLKNFSLYANYTYLTSDASGIRNEDGEERTDLDLPNTTPNMFNASLGYADKRLNARLSANFSDSYVDEIGGNSFEDSYYDKQFFLDFNAGYTINKNLRVYADINNITNQPLRYFQGVRNRTAQLEYYGRRITFGLKYDLFKR

SEQ ID NO: 19361 - protein, 737 aa, Acinetobacter sp.
MITIVIIDKKGDTMTTIAKPAIKLSLLTSALLASFAATATANADIEQISIFGKKNPINTVPGSAHQLSQEELDTFKYSDIMRTLASVPGVYIQEEEGYGLRPNLGMRGTGQNRSEKITVMEDGVLAAPAPYASPAAYYFPTSGRMQQIEVLKGSSTVKYGPRTTGGVVNMVSRQIPDAELAGALDVALGQDGYGKLHAHAGGQGERIGAVTEVYRYQADGFRDINGVGGDTGFVKNDLLAKVAIDSAKDAKYAQRLELKLKYADEVSDETYMGLTDEDYAAKPFSRYSASQKDEMTTEHKQLQLIHIIDFSSTVSLATTAYYNDFARNWYKADKVDGKSLSKGGIEAASVFDANPEGAIDVSVKANNRVYISQGIQTELGLLLGDHQLDIGVRLHQDEMDRFQWADTYSLDANQQMSLTKAGVPGTDSNRIDSAEALSAYVQDRFTLGAFTLTAGVRYEDVTVEREDWGKANPGRNGDGAFKENSFSALLPSLSATWQLTDSTLLLAGVQKGFAPAAPGNTNGQEEESWNYEAGTRFVNGNFNAEAIAFYGDYSNMHGNCTAAQGCDEDKLDNQYNAGEVVVKGLELSAGYQFNTDGALSFPVKLAYTYTSTEFQNSFESEFETWGSVQVGDEFSYTPKHQLYLSAGISVEQWQLTLAGRYTSDMRATAGQGDIAADDLIAAKTLVDLSGRYFIDKQQEVYLTVDNLLDETYMTTRAHGSVFSGKPRSITVGYSYKF

SEQ ID NO: 19362 - protein, 500 aa, Acinetobacter sp.
MMKKIHKRRLLGSGGPLAMSAVLSLGLVPCAFAQTAGEGAPAQAAPSSAAPSESAPGAADNAAPADQTAAAPTGLWERSNLLGDMGGLRPWLGNYGVTFNLQETSEYMGNVSGGTNRGGAYQGLTQFGLVVDTQKAFGLPGGTFNVSGLQIHGTSLTARNLQTLQTASGIEADAATRLWELWYQQSLGNVDVKIGQQSLDQEFMISQYAATFMNAAYGWPVLPSTDLPAGGPAYPLSSLGVRARAQFANGVTVLGGVFDGNPAPGVGDPQKLNASGTNFNLGNGALVIGELQYAINQPSSNPSDPKPAGLPGTYKIGFWYNSNRFDDQGFDTNGLSLANPASNGVPASHRGNYSIYAVADQMVWRAGPDSPQSLGVFARIMGAPGDRNLVDLSVNAGVTLKAPFKGRDNDTVGLALGYAKIGSHAQDLASAQGTLTAGFPSRSAETMLEATYQYQVAPWWMLQADFQYFWRPAGGIPDPENPSQRIKDEAVLGLRTTIQF

SEQ ID NO: 19363 - protein, 332 aa, Acinetobacter sp.
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRNEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 19364 - protein, 730 aa, Acinetobacter sp.
MSLTFRNRLPRRALLPAALLSSLALVASPAFAEAAVDASDAKTLDRVSVRAEKSAPPASTTRLPITLQETPQSATAISLKRLQDESLFSINDVMRNVTGVSVSFYDTQRPLYYARGFAITDFQVDGIPTYSGSTNQEYDTAFYDRIEVIRGANGLLSGAGVPSATVNLLRKRPGKEFDASFSVSAGSWDYRRMEADVTAPLTADGRFRSRVVAAYTDRGLYYDRYDENKMAGMAVLEGDVTDSTTITLGYQSQDNNPTGSTWGTVPFFDNQGNFAHLPRSTNLSPKWSYWKRESNTAFANLEQRFGDNWLLKINTAYTRGNVQNVRLYGTGSPDPVTGSGIYLRAAAGDSKDTRRNVDAYLTGSFPLFGRDHDVTLGAQWSDLEGTTNTLALNFPTDWARCGSDRCYYIPNVYSWNGDISEVTYRRTGARRVAKTTQSGVYLATRLRLADPLSLIAGARLSRWETLSRSYNAAGAYTGTSGAYKVSDEVTPYVGLVYDITPNVSAYASYTEIFNPQNFKDRNENLLAPVQGSNLEAGIKTQWFDGRLTANAAVFEAKQDNYAVRDMGVPEGSLSDGTSAYVGVNGTKARGWEMDVNGEILPGWTVNAGYTHVKVTRAATDLLYANPPKDLLQLNTQLQLRGALERLSIGGGLQWQSKVQGYNITYPLGGTVTVNQPAYMLVQFNANYRISDSWTATLSVRNALDKTYWANLDYNNFGEPRFVAASLRWKF

SEQ ID NO: 19365 - protein, 663 aa, Acinetobacter sp.
MGKTNFKLSLLAGALVMAMQPSVQAQEQHNCTKDEKCNDYLVVTGDVMREPVNVVSDPKKPRLPLPAFEGSGFLKTIPGFSVTRKGGMGGDPSFRGMGGSRLAIVDDGQHVYGACGGRMDPPTNYIYPESYDEITVIKGPQTVKYGPVGSAGTVLFEKNRHRFTERGIIGRASITGGSFDRKDSIIEFVAGNADYYVDFDMDSSSSDHYKDGNDNPVQSSYDRDNIKVALGWTPSENTVIEFAMGQSEGEAEYADRLNKARQIDNESYTLLVQHDFDSELLKNVDFQVYSNENDHIMDQFDRGVNMGMDVMRSTSGGHFWLGLTPMMNWDLTLGVDHMQSDHQGRGINMMQDKGLDDLLRKPFMKNMEYANWGLFVESVYHLDHSKVFAGMRYDNWDTDLYVGQKGNRADDVFSGYARYEYRDGFSQYYAGVGHAERVPDYWEIMKTSASNPMQKSFDLEPEETNQLDIGWIYDNGLVFSSSLFYGKLDNYILVDSTGPMTVARNIDATLYGGEASIDYDVNEHFSAQVTLSYTLGDNDTDNVDLGQVSPLESKFSLNYQKDAWAAGLLWRVVDSQHRVTIGHGNIVGQDLAESSGFGTVAINASWNYDDHLRLILGVENLFDIAYAEHISKAAGGNDLPGSEPMFQVNESGRNFWAKLTYEF

SEQ ID NO: 19366 - protein, 363 aa, Acinetobacter sp.
MRKIKKIRPMLLIPISIAVLGLPSKAHAQSNVTLYGVVDSGVMYTSRTFDAGTGASGPHQVSATDGGISGSHFGITGAEDLGAGTKAMFTLESGFTTNNGALGNSNGNLFGRQAFVGLSGHFGTVKAGLQYSPFGLAIVDTDARHASFFGSQAGIYMGNFFATGIFVANAVSYTSPTIAGIQASALLALGGDPKGFQAGRQYAARVRYEWKDLVVNAALFSGNPDGSASISTPFPSTIEFSGRTIGASYRWGGATLKGSYTSYKIAGSFNEKVYAAGGEYLITPTLSTDVGVWYMRDSNDPANHSLLATAGLDYFLSKRTTLYGSAACVNNHGLMHTGFTVNGALYEPTGSSVGIVVGVRHLF

SEQ ID NO: 19367 - protein, 320 aa, Acinetobacter sp.
MRKHLMLHTGILGLCILPFIGTAHAADPVTFSGLFLAQNEQFRFSVEAGYLTARANEYVYEEGRTVSRLIWDINAAATITARAEMNMTPRWRLSGSATVGIDHSNFMADYDWLTPSPDWSHRSVHWDTQLDHYVALDLGASYAAWQINRTTLNILGGLRYTDFQLSSYGGSFVYTTEDGEFRGDSLSFPDGQAVITYRQRLPALYGGLGASRQIGSVHFDAGILGGVTLWPRDKDHHWLRSLKFKDEFKRSPYLALQLRASVPVSDKGEAFLSARFEKYFRMEGNTHILDTRTGQSSLFQDSAGASLQALNIGVGLRFRF

SEQ ID NO: 19368 - protein, 216 aa, Acinetobacter sp.
MKVNKKSMLGFAAAAAIVAGAMPAYAADVIMEQPPAPPAAPMEVAPVATWAGPYAGIALGYGFSGEVSADGAPGEVETDGFVGNVFGGWQGQSGQFVYGVEGDIGYNGMEGSEGGVDVEHGVDGSLRARLGYAATDNVLLYATGGGAASRLEASGGGLTESETAVGWTAGAGVDVKLTPKSFARLEYRYTDLSAEFDSVDVDTTSNKVMLGVGMQF

SEQ ID NO: 19369 - protein, 1211 aa, Acinetobacter sp.
MKLNLQPKKPYKNLGKKIPRFNFSTYLTVFIMLFFSYSAQAQNVTINFKDASLETVLKEVAKQVNYEVFYTQKLLKDAKPVTINVKNSSLKETLNRIFSTQNLKYNLANQTIVVTASKDKTESLGNDLIRVSGKVTNNKNESFPGVTVTLSGTNKTSITDFDGSFTFDNVPSNGILELSGLTIETKSIAINGRNTLTVIVEDKVAAMKEVVVTGYQTIARSNFTGAISKIDEKTLNENINSNLSSAIEGRVAGLMFQKNPSGLGSDQPILRGIGTFSSDQVGYSPLVVIDGLPTELTLDEINPYDIESVDVLKDAAAASIYGSRAANGIIVLTTKKGNGKLKVTINSDFFISDKPNLRDMNYASTSDMIDFEQAVYNRERARFADTATMFSSYGDIGNSSSKYYSPLYQLNRNLEEGKIDNAAYNSTLAQWRKNDYNKDYRDNVWQNELRQRYNVAFSGSTSKQNTYVSLNYDQSKGRIKYNSGRNFNLYAKSSFQVNNWLNATFGVNGTYSNEDVTEYDLGNYDIQKRYERITDDNGNLVQSSFSSVKDGFTSSGALNPAMVEKLAGLSGFKSTNFNVLDALKEGLEEQNSLSLRTFANIKAKLWKGLSYNTQFQYEVRKNDREQYYDINSYRMRYAINALTGYNPTTNAYTYVEGFSTGGRYKQSSSQASNYSFRNQLDFNQEFADGKHSVNALVGTEMRETFLPRSIEQVRYGYDPVTLSSAVLNNLALSQTGVPSYIFGNNRTLSALGRTQQEILHRYFSIFSTASYTYLSKYNITGSYRIDKADLFGVDPKYKNRPLWSAGLGWNVSNENFMKEVKWVTMLKLRSTYGINGNVDQSTTPYITATRRNDNLYQSLQYTNITAQPNPMLRWEKTQSTNVGIDYSLFRAKLNGSIDLYHKYSTDLLATTDLDPTVGALSRRINAGALLNKGVEFTVGSEWYNNGNFRINSNLVFAFNETTVKKVTRAQTTAASYVSSPTNFFVENDFFNSMYAYQYGGTVNGYPYVLDENGNPSITFDANGNPISTSIKSITNPDALVNVGTLMPTYTGSLSQRFSYKQFELNFLFVFSGGNVMRKETIDMSSDAVNLSGITDRYTDANPNGNTRLYVDFDESVRNYAGTISSQWRNSTANVVDGDYIKLRNISFGYSLPKAFANRISITSAKFTFQMNNIWYWSAAGNRIDPEVYTVNSGTRNLPLPKTYLFGFNLTL

SEQ ID NO: 19370 - protein, 533 aa, Acinetobacter sp.
MSKLWGYSFWSKVAMILPLTSAIASIIHTNTAIAQLSEDIISSDDLVEVQGQVTSVSQLSDVQPTDWAFQALQSLVERYGCIAGYPDGTYRGNRAMTRYEFAAGLNACLERINELIAASVVDKVTREDLAVLQRLQEEFAAELATLGGRIFALEARTAELEANQFSTTTIFGGEAIFGFAGAVGGDPPGTGDNHQATLHYLLRLGTVSSFSGLDRLRIGFVSGNFENRGLAGTVENPGFGDMALLSYQTDTNDQLFLDYLEYRFPAFNNRVVFTVRPVGFSLSNVLTANSPFFDSGRGAISRFGEGSPLFKIGALDGGAGFDWLVADRVRLQVAYGTRGSSDARLGISHSDHSALGVQLLLKPSANTLAGLTYINAYSANGRLDTLTGSFSAYTSGLLDEPMNFNAVGGSFQWRIKSNITLAAFGGVTFGESTTSNAYANTTTYSLSLGWSEPFGRNGDLFAFIFGQPPKLVAGRNLPLGEDRDTSLHFETFYRFRVSDYIWVTPGVFMVTNPEHNANNDTVVIGVLRTTFLF

SEQ ID NO: 19371 - protein, 906 aa, Acinetobacter sp.
MSVQHRHVPAGRTVGQRSIRDFRRSVMAISVATLLSAQAYAQDATTTAAPASDATTQQLDTVQVTGTRSSVTKAQLVKQNAEQIVDSIVAEDIGKLPDNNVAEALQRISGIQISRNYGEGSSIAIRGLTQVRTELNGRDIFTANDGRGLSFEDVSAELLGGVNVYKNPSADMIEGGLGGTVDLRTRLPFDYDGRKIAGSVQYNYYDLADDGKPAFSGLFSDRWQTGIGEIGILVNYSQQKSPFRQDTISIEPWYTQTDLPGYEGQGVSVPHGAGINTTVGERERKTGAFAMQWRPNDAVEVYTQVLRSDYDFSWHDYSFFALTGANPMQGLPGIQVNNRNEFVNGSFQNVPTESNTSLTERHSVTTDYSLGAKWTVNEKLTLSTDFQYVDATTTGTRYILSTGQVTSPQFNVDFRGDLPRLSVTDASGAEGYLADVNNYNGWRYHLDNKDDNTGTEFAWRSDMDLAFDSDFVRSFKAGVRYTDRDAETKGNIYRFMCINNCAGAPFSQYPGIGVMTNPITDFFRGESHAFGPTLTASDAAVANYQQTLAAFGATPLEFAPNNINTQSEKTYAAYGVLRFGVDGDIPFDGNIGVRVVRTEVGSQGVRTGTDAEGGGLIPVDAQQTYTDVLPSLNLRWMLSDQLQWRFAASRGISRPTFDKLNPNLSLSTGTSNGASTFTGTAGNPSLEAVKADQFDTALEWYFGQGSMMYGTLFYKKVEGFIANAVFNEVYDGQVWQITRPVNGDSGKIRGAELGYTQFFDFLPGWLSGFGLQTNYTYVDSEAPSPTATDTNGQSLTVPLEGLSKNSYNAILSYETARFQGRVAYNWRSDWLVTTAGNGTGNLPVYNKGFGQLDASLRFNINDVWSISLDGVNLLDTRRESYLGTESRYRDFVINDRRYGLTLRASL

SEQ ID NO: 19372 - protein, 718 aa, Acinetobacter sp.
MSIHMVHDKFFYNNEILIHMISFLICFMLIIFTVNNSQANSNDVSVSSRPKDISKSIFSDIQTLPILFQGKMHDDVITVISPKNSPLIFSDSPAKSLQSLYVIDVSDYLKGITGFSAIRNGGVNNEPVFRGMFGSRIRILMDNGEILGACFSHMDPVSAYIFPETFDILNIIKGPQTVLWGPVTSAGTLQFERYHPQFDKSKIQLRSNVTIGANNKIDKNIDSIMGSKYGYIRLIGNVSRSDDYHDGNKDQVHSAWYKWNADAILSFNLSADTYLEVSLGQGNGTANYAARSMDGLCFARESYGMKIETLDISKTLDKIELQAWHNYVNHIMADTVSHNTELSTEKCCGFSGNINNNVDRLIWGARGITVSQWDNIKCHSGADVQINTHREHMKSNSNWKTDIVSRDTGIFTELIFDSLSNRRFTGGTRLEYSVINFNNSSKYKRHGIVYPAGFIRYENNINPLLSYYIGVGTSFRLPDYWELFYTKFGENINIDDILKLKPEKTVQVDIGASFQHLQINGWISSYAGYVKDFIVCDYRNDDAIQDAISYAENIHAKICGTEVGLNYQFNEHWHTATNISWVWGMNIDDGCTLFRTPPLEGKITCQWIRGSYSITAKWRLALAQSINDSLMSPGSFVSRNMLPHTDVNCNTSGFGILSMNFAWKSSQFYKFSIGVDNLLNHSYREYLNSCVHKRLGYPSGTLIYEPGRTWWIKLGMEL

SEQ ID NO: 19373 - protein, 391 aa, Acinetobacter sp.
MFKVKFYIRHAVLLLCGSLIVGCSAIPSSGPSAKKIVSLGQQSEVQIPEVELIDVNHTVAQLLYKAQINQSFTQFGDGYASAGTLNIGDVLDIMIWEAPPAVLFGGGLSSMGSGSAHQTKLPEQLVTARGTVSVPFVGDISVVGKTPGQVQEIIKGRLKKMANQPQVMVRLVQNNAANVSVIRAGNSVRMPLTAAGERVLDAVAAVGGSTANVQDTNVQLTRGNVVRTVALEDLVANPRQNILLRRGDVVTMITNPYTFTSMGAVGRTQEIGFSARGLSLSEAIGRMGGLQDRRSDARGVFVFRYTPLVELPAERQDKWIAQGYGSEAEIPTVYRVNMADAHSLFSMQRFPVKNKDVLYVSNAPLAEVQKFLSFVFSPVTSGANSINNLTN

SEQ ID NO: 19374 - protein, 1107 aa, Acinetobacter sp.
MRQNKMIMRSLVLLGALFFWGNSFAQISLSVNKQTIKQIIPQIEKASGYNVFYTDKLPNLETKKDLNVSNASLEAVLKELFKGTKISFEIKANKQILLFQQTNKSVGAKKKVTGRIVDENDEPLIGASVIIKGSTQGTITNIDGEYTLEDVPEKATLTVSYVGYIPASVAVNGKNAINVVLQEDSKTLEEVVVIGYGTVKKKDLTGAVGSVGGAEVAARKTTSLSTALQGTIPGLMVTRNNNAPGANADKIYVRGITTIGNSDPLVIVDGVPGDINSVNANDVESISVLKDAASAAIYGSRAAAGVILVTTKRASDKELSLTYNGEFGWEIPTAEPEVVGVQRFLEMANELRYTDNPDGGKYQAYSEDQVNNWVKNNATNPNQYPITDWQDLILEKSATRQSHSIHLSGGSKVVKTKASLAYDEVGGLYGDRYFQRYTLRVNNDFNITQKLSATLDFNVKRTKHHMPQFTPFGMMRYMPAIYAGVWDDGRIAEGKSGANPYGLMKLGGTTEKWYTALGGKASIDFKPFDGFKISAIVAPRFNYDKFKTFKKAASYTLADDPNTIGGYLDNSGLYNTTKLSETRNDSYNVTTQLIANYAKKFAGKHDINLMAGYENYYEYIEELGADRDGYVLTNFPYLNNGPKDLIGNSGKGKEYAYRSYFGRVMYSYADRYLFQANIRHDGSSRFAKKHRWGTFPSFSAGWVLSEENFMKNLNWDWLSFLKIRATWGALGNERIGDFPYMSTIAFGNTIFYQNNGIYFDQTASQQKYAIENVTWEKTESTDIGLDISFLNNRLRVNGDYYWKNTKDMLLAMAIPDFLGFSDPDVNAGKMSTKGYELNVSWNDHIGDFSYGIAINFSDFTSKMGDLQGTQFLGDKVKMEGSEFNEWYGYVSDGLFLTEEDLKNSPKINDKNTQLGDIKYKDISGPDGVPDGKISPEYDRVLLGSSLPHFLYGGNINLGYKNFDLSLAFQGVGKQNARLAREMVEPFRNNYGNFPAIIDGNYWSPYNTDEQNAVAKYPRLTHVNKSSNYAMSDYWLFNGGYFRLKNITLGYTFPKEWMNAIGIKGARIYASASDLFCLSKYPKGWDPEMGVSEYPITTSILLGVSVNF

SEQ ID NO: 19375 - protein, 944 aa, Acinetobacter sp.
MRIYFIILSLFFCGLSFAQNTISGTVTDASNQPVPGANVKIVGSASGASTGFDGKFNIKHQQAFPFSIEVSMMGFASQTVVVHSKEQEIILVLLEEATSLNEIIVSASRAPERILESPVTVERMGLKDIKNTTAPSFYEGLENLKDVHFNTSSFSFKSVNTRGFATVANTRFLQLVDGMDNASPALNFALGNLLGISDIDVANVEVLPGASSALYGANAFNGIMFMNSRSPFLKEGISTYMKYGQTSQTTAGNNPFYDFGFRAAKKFTEHFAAKGNFSYLNAKEWIASDDKNVSNGAVDSRAIGHANNQNYDGVNLYGDEVSTFIPNVGQVSRTGYKEQELTDNKIESVKADFSLHFKPWANDFEIIAQHKIGFGNTIYQGANRYALKNFYMEQTKLEVKGKNFFARIYRSAEDAGDSYDTRFAAWNVNRAAKSDTEWFTNYATAFQLSQAYLGSNADQAAVIGRDYADHNNLPTTANFNLLPQFTAAPPVGQPRFEPGSAQFNAALAGVIKNADFTKGAKFQDKSKLYHADVNYSFKDVIKFADIQVGGSGRQYVMNSKGSIFTDYDGPIKYSEYGVYTQVQKKLMDDRLKLTGSLRYDKSKNFDGSFSPRLSVTYAAGTNKQHNFRISYQTGFRNPTTQDQYIGLDLGPFALIGSAPENLERYVEYRTPSVAGSAFLDPGQTQFKLTGENAYHNAYTVESYKAYASARSSGIIQSTASSLLVVASPTLVKPERVQSIELGYRTILKDFSVDLNGYYNAYNDFLSQTNTIAPLYGIVGTAKAATALDNGDRRTFQVYTNSKSQVKSLGFGIGLSRKVYKNFELGGSYNYSQVNFDQLSDPSFEVGFNTPKHRVKASFGNDKLFKNFGFNTSVRWNSEYLWESSFLDGMIPENVVFDAQINYAIPVLKSVLKVGGANLGGKDYIQVLGAGAIGTQIYASWTINP

SEQ ID NO: 19376 - protein, 244 aa, Acinetobacter sp.
MKKAFIVPALMGCISLPAFANTDDSKTGLYVTGKMGASIVQMSGQQFVYSGYADAGDNGTKNGDSHRTGVFGGGLALGYDFSNQFDIPVRAELEFMARDKANSTYNIRDRVRNGVHQTRDIKNQIKLNTLMVNGYYDIKNSSNFTPYISVGLGYAAVDFKTTRADSYTPGLSLHDTHTHTANNFAWSVGAGVNYAINDDWDMGLSYRYLDAGKADITTAVGDGENTSKIKVKANDIMLGLTYRF

SEQ ID NO: 19377 - protein, 631 aa, Acinetobacter sp.
MSNFRSNYRYTMFLILLLDILAILVFYPAKSHAELPKSDVSTAEAEVNKAPEAIVNQTLETSMIEAGDKGSGEVASPPAFCALSCVLPSSSIPPLTSKKATNPERVTPVSQLLEVAPPTNKKATNNSAGQVTSVSQLSDVLPTDWAFQALQSLVERYGVIAGYTDDTFKGNRALTRYEFAAGLNAALERLNELIATSTADLVKREDLDAIKKLQEQFSPELAQFRGRLDNLETRTAKLEANQFTTTTKLIGRAQIVLGSVLAGNNVVTKRPAPRNATLQGSTTLRLNTSFNGKDSLSLSLSGGNIESLGQTRAGLLGTFEGRTADNSSITFARNTILLGGVRYRFLPNPDTQVNIYALSDGASEIGLSGPINPYFESSSATGANGISRFSRRSLVYNYGDSGPGIAILQKLGKQVQVGIAYSAPNGGNPTANNGLFTGRYLALAQIIYYSSNRNFRVAATYVNTYSPANTQGLSGTNFGPAVGSNLVNSTVPGAGTVANLYGLQAFYQVNSKLAINGWISYGAHRYLGRGDGSAMDWAVGLAFPDLFSEGALGGILVGMEPKLTRLSQSVNLGAGAGQADKDTSLHVEAFYQYKIGDNIEVTPGLIWITAPDSDASNPDSLFAWVRTVFRF

SEQ ID NO: 19378 - protein, 201 aa, Acinetobacter sp.
MQYSDRHWSPYWAQDFSGSLDVTASGFVGGVQAGYNWQLANGLVLGGEADFQGSTVKSKLVDNGDLSDIGVAGNLSGDESFGLETKVQWFGTVRARLGFTPTERLMVYGTGGLAYGKVKTSLSAYDDGESFSAGNSKTKAGWTLGAGVEYAVTNNWTLKSEYLYTDLGKRSFNYIDEENVNINMENKVNFHTVRLGLNYKF

SEQ ID NO: 19379 - protein, 970 aa, Acinetobacter sp.
MSMFLNSKLSRSVKLAISAGLTASLAMPVFAEETAAEEQIERVAVTGSRIAKAELTQPAPVVSLSAEELTKFGNQDLGSVLAELPAIGATNTIIGNNNSNSSAGVSSADLRRLGANRTLVLVNGKRYVAGQPGSAEVDLSTIPTSMISRVEIVTGGASAIYGSDAVSGVINVILKEDFEGFEFNARTSGSTESVGTQEHSFDILGGANVADGRGNVTFYAGYERTKEVMATDIRQFDAWGTIKNEADGGEDDGIPDRLRVPRVYSEMINATGVINAFGGGIGRSTFDSNGNPIAQQERDGTNSFAFGSFPNGCDTCFNTEAYENYIPGVERINVGSSFNFDFTDNIQFYTDFRYVKSDIQQQFQPSFRFGNININVEDNAFLNDDLRQQMLDAGQTNASFAKFFDELGNRSAENKRELFRYVGGFKGGFDISETIFDYDLYYVYGETNNRRKTLNDLIPDNFVAAVDSVIDPDTGLAACRSQVASAQGDDYTDPASVNGSDCVAYNPFGMGQASAEARDWVSADVTREDKITQQVIGGTLGTDSEELFELQGGAIAMVVGFEYREETSGSTTDEFTKAGFLTSAATPDSYGEYDVTEYFVEVNIPVLKELPFAHELSFDGAYRNADYSHAGKTEAWKAGMFYSPLEQLALRGTVGEAVRAPNIAEAFSPRSPGFGRVSDPCDADNINDDPDRVSNCAALGIPPGFQANDNVSVDTLSGGNPDLKPETSTSFTGGLVWTPTFADNLSFTVDYYDIQIEDAILSVATQTVADNCVDSTGGPDTDFCSQVDRNPTTYDIELVRSGYLNAAALNTKGIEFQAAYSLDLESFNAPGELRFNLLGNQLLELERLEFQNRPDEINDEKGEVGDPELQFRLGIDYRLDDLSVSWNTRYIDSVVTYDVSENGGSPEDLYPGHIGSMTTHDLSATYYINENFMINGGVRNLFDALPPGYTNDALYDLVGRRAFLGIKVMM

SEQ ID NO: 19380 - protein, 942 aa, Acinetobacter sp.
MFQFKPNLLTLALLSAGVCINVYAADNEAAKAEAAATTQDESIEVIEVRGFRTSVIKSLNNKRFADTVSETISADDLGALPDQSIADALTRLPGVTAVRTGGQASGLNIRGLDGDFVAATLNGREQVTTGGKRAIEFDQYPSELINQAQVYKSPKASLIEGGVAGTVELKTADPLQAPKDHNFTVNARGSFNDRAGEIADAEEYGNRLSFSYQGKFLDETLGVAVGYAHLYQPYVASQFIGLRFNDDRRDVNGDGNLESISEGFEMQQKGGTDTRDGYMGAIHWQPNDNWSFKGDIFHSKFDSENFARGFRVKSLKNGQISDAIVEDGSMIGGTVSTDGTDNFAVFVVNDNDSKYSELTSGAVNIEWTNGENLTIAADISYSSADGEFVNGGTRAVIYDDMANNVRSAESITYKLNNLNPADISFAKDYTDTSTLGLREVGMWPYDQQNDLIAYKLDLNYQLDNSFVSSIDVGVRYSEREFNAQRSQAGYGFEFGTNPDNQPVLALTDDMTRVVNFGGELSGYPSFLAIDFDKAVDLVNAQLAATGQDPFVPTANWANNWTMIQSGTVNEDVLAGYVQANLDFEIGSIPVTGNIGLRVVNTDQSSTGLQQVGFGLGEEIVDEKGVVSTDYIHNKVGKSYTDYLPSVNLNFHLTQNDQIRFAAASVMARPPIDKLKSGMGSWYDDSATPGYKKYNAWGNTSPLLDPFYADQYDLSYEHYFEESEGAIVFAVFYKDIKSFINNFTIQPFDFEEAGFIVPDTIVDNGVEFPVVKNEGQYQTAVNNDNGGYIRGIELAYTQVFDFLPGALSGLGFTGSYAYSDSEVEFETDLSGESLAIPLPGLSEHVLNTTLFYTLDGFDTRLSMRYRSEYVSEQVAVESQLAFFDAETILDYQASYAMDNGLKFLFQVNNLTDEANKTYFGQTHQTGTIQSFGRQYFLGFSYTM

SEQ ID NO: 19381 - protein, 305 aa, Acinetobacter sp.
MGRIESKKRLKALVFLASLGVLWGNSAEKTPFFKTKNHIYLGFRLGTGANVHTSMWQQAYKDNPTCPGSVCYGEKLEAHYQGGKNLSYTGQIGDEIAFDKHHILGLRVWGDVEYAKAQLGQKVGGNTLLSQANYDPNAIKTYDSASNTQGPLVLQKTPSPQNFLFNNGHFMAFGLNVNVFVNLPIDTLLKLALKTEKMLFFKIGVFGGGGVEYAILWSPNYQNQNTKQGDKFFAAGGGFFVNFGGSLYIGKRNRFNVGLKIPYYSLSAQSWKNFGSSNVWQQQTIRQNFSVFRNKEVFVSYAFLF

SEQ ID NO: 19382 - protein, 245 aa, Acinetobacter sp.
MGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 19383 - protein, 224 aa, Acinetobacter sp.
MSKRILAAVAAVLAATTAQAADLPSTAAPPPVPDLALWSPWMLRLRALAVVPDPGARLSARGAPIVGAGVAVTDSVIPELDISYFFTKNIATELILGVTRHGVRGTGALAGTRIGSTWILPPTLTLQYHFTDFGPFKPYIGAGVNYSVFFGEQERLGFTSFKLSNSVAPAVQFGFDYMLDAHWGINVDVKKVFLDTHVKLSPGLIRGRVDLDPWIVGAGVTYRF

SEQ ID NO: 19384 - protein, 1166 aa, Acinetobacter sp.
MYKNYTKKVYAPLGYTHKILLVMKLTILLLIATIMQVSAGSYAQQVTFTRKNVSLEQVFSEVKKQTGYRILYPDRLIDDSNIIDVDFKNASIDEVLRRCLKNESVTYIVQLNRSIVLKEKEPSFLEVLADKLLDIDINGRVLDEEGRPISAVSVKIKGSNKVIVTGADGRFKLSVPNENTVLVFSFVGYVSKEIRVQQNMTVTLVPELNKLNDLVIVGYGSTRRKDLTGSVASVNVNEVKDVPFMSVDNALAGKAAGVQVVKADGSPGGAVRIRIRGGASLLGTNDPLYVIDGIPTVVTNNYINSQSDIVNPVEAANYGEDFNNSVSGAFSRGLNNLSGLNISDIESIDILKDASATAIYGSKAANGVVIITTKKGKLNSKPQLNVNYYVGVNKPVKEQVLNADQYKSALKEASTNYIAERTRLGLPLTTTAALRALGIINDPAFFGTANTDWVGLVLRTGFTQNADVSVSGGGAGSRYYTSLNYTKQDGTLIGTDFNRISGKINLDNEISQRFRVITNLNYGFTTNNITNGIYGQALTAPPTFSPYNEDGTYASLGLLNTDYRGFQNPLAVASGTNRGKDYSLMGSLSAEYDILNELKFKSTVSANFRAYNQLNYVPSYVEVGGFYGREDTQGGLGSQSNSNFLSTFIENTLTWNKEFNEDHRLTVLAGTSWEKNKSDYFSATGRGYPDDNFLNNLSSAAVPVSVSGANPLSQSSLLSFYVRANYVLMDKYLLTFTGRSDASSKFGPGNQVGYFPSGAVGWRISQENFLKDVKWLDELKLRASAGRTGTQNIGDHLWRTLYTPDAYAGNNALVPSQLGNANIKWESTTQQDLGLDFSFFKGRLGGTFGYYNKVTDGALLNLTPAPSSSYSSVIYNIAKIRNRGLEFELHGDLVRSKVFSWTGAINISRNISRVLNIDGGPFSNPADRNALNLGTSIVKEDEPLGLLYGRVSKGVIKTQEQLEAYKAAFPYYIYFQPMVNVGDMSYEMAEDGFWKQDIIGNAAPEFFGGYTNTLTYRNLSLMTLFTFSYGNELIYQKDVSDMTMSDLPNRGVRVLDHYSAEHPNSERPRYLFSETSFLTDANVYDASYIKLKSISLSYNIPSKWMQRLKINNLSVYGTATNLFTITKYPGPDPEVSDDPGSVIGGGRDVSTYPTTRSYTFGMRLGF

SEQ ID NO: 19385 - protein, 764 aa, Acinetobacter sp.
MQRTPLARACACLLLASLAATASAQQAPAAQGEASPTALDTVTVTAEHREQNLQDVPVSVGVVQGAAMRDYTAGGDDTLLALSGRVPGFYAETTTGRIFPRFYIRGLGNIDFYLGASQPVSIIQDDVVLEHVVLKSNPVYDVDQVEVLRGPQGTLFGRNTTAGIVKFDTVKPSDTYTGRVNASYGSYNTLSLDGGFGGPINDVLSFRVSALYQHRDDWVDNTFAGSSADGTRTPRKDAMGGYNDRNARLQVSLKPNDAFSLLGSVHTRDYDGTSTLFLRNAITRGSDKVDVPRDRVAYDEGHDNPQAYQTDGGSLKAIYDFGGVSLTSITAYETTSGYSRGDTDGGAAANYPVNGVPNGFGQSMGQIRDLDQYTQELRLASEGDDALQWQVGAFYFDGRDITDFYQRAYFLQTAARNPNNWVRLRNTNTSWAGFGQLSYKATDALTLTAGIRQTKDTKQTRLLKTADTAAGVVTYRGRRDVRMSDTQPSWDLSAMYEIDPQLSVYARVARGFRGPTIQGRSAVFNSDFTTADSETILSWEAGIKSSLFENRLRLNVSGFTYTVDDIQLNGNDSDGNGVLFNADKAKAYGMEADLDWRPISNLSITAGLSLLHSEIHDERVYAQVCALNGVVVCTVNDPTIRVGANTFAQIDGNPLPNAPKYNLNLAARYDIPVGNDGAFFVSTDWNKQGQTSFVLYDSTEFRSDGNFEGGLKLGYTGGYGAWEVAAFARNITNEKNLKGVIENYMAAVYNEPRVVGVSVNVNWQ

SEQ ID NO: 19386 - protein, 742 aa, Acinetobacter sp.
MKKTSLIVLLTMLSATAKAEEDPELLALHTWTAPEITVSGKKGDLLQNVTGKESAVLNPSQMSVYKVINMMPSISQQSVDPYGLADIVNYHESFRFRGVEATAGGAPGTTANVEGLPVTGRPGGGATIYDLENFENIAVYSGVMPANIGLGIGDVGGKIDMEIKRPEEKFGVTFKQSRGSDNFSRTYLRIDTGDLGGGLKAFASGSTSYAEKWKGYGASNRNNLMFGMTEQFSDKVKLEAFATYSKGNIHPYKALSYAEIRNLDSAYETDYGNNPAKYDYYGYNKNEFEDWMVMANLEVKTGEESKLNVKPYYWSDKGYYMETITLKDSNNNPYNRIRRWDIDHDLKGILAEYNTKLGKVDLDFGYLYHTQERPGPPTSWKNYSLNGNSLQFSNWAILSNSSSHELHEPFIEAKYRTGGWLLEGGVKYVNYTLPSILTYNTTGIGDVSYDDALATDPAIIAAKSAESTKTFSRLFPDVTITRSIGDNSSVHLAYGENYVTHVDIYPYFISQYATFSAHHITFQQLWDERKMEISRNIELGLKMNGSGWSIAPTIYYAMHNNKQAVLYDPDLGISYPMNNANAKGYGFELEAEYKPSRALKCYGSFSWNRFYFDQDIRSDAPGNPILAIKGNQVPDAPEFMAKGIVSYTIGEFTISPIVRYSSARYGDVQHQQKVDGATLFDLDLTWSKAMLGFRNVDCSLSFINLFDKKYVSLISTSDYKTLNSSYQPGAPFTVVASIALHY

SEQ ID NO: 19387 - protein, 463 aa, Acinetobacter sp.
MTTETRSLYSQLPAIDRLLRDSSFLSLRDTYGHTRVVELLRQMLDEAREVIRGSQTLPAWCENWAQEVDARLTKEAQSALRPVINLTGTVLHTNLGRALQAEAAVEAVAQAMRSPVTLEYDLDDAGRGHRDRALAQLLCRITGAEDACIVNNNAAAVLLMLAATASGKEVVVSRGELVEIGGAFRIPDVMRQAGCTLHEVGTTNRTHANDYRQAVNENTALLMKVHTSNYSIQGFTKAIDEAELVALGKELDVPVVTDLGSGSLVDLSQYGLPKEPMPQELIAAGVSLVSFSGDKLLGGPQAGIIVGKKEMIARLQSHPLKRALRADKMTLAALEATLRLYLHPEALSEKLPTLRLLTRSAEVIQIQAQRLQAPLAAHYGAEFAVQVMPCLSQIGSGSLPVDRLPSAALTFTPHDGRGSHLESLAARWRELPVPVIGRIYDGRLWLDLRCLEDEQRFLEMLLK

SEQ ID NO: 19388 - protein, 485 aa, Acinetobacter sp.
MKLKHLSLSVMIMGTALGLASTQAAASGYQFGSQSVSGQGTAHANGAEANDPSTIFTNPAGLSRLDGTQLVIGGTLVVPHSEYTDNGSRNVLGQPTGGGNGGTFAPKAVAAPTFYLSHKINDKITAGIGMYVPYGAKLDYGFDWAGRYALKSVNLQSLNINPSISFKLDERHSFGFGVSAQYMDATLEQMADATSGLALSVAKGLPGGVTPGNIATAMGMLKAAGVRGDGLAHVEGNDWGFGWNVGYMFQLDENTRFGLAYRSSIKQKLTGSSTWTFNNVTGSMVPFGIPLSAAAAAKAKHPNASASVDVTTPETVSANFFHQLNPKVALMADATWVRNSQLQQIDIKQYSTPAQGDLILHQNWKDTWRLSFGSNYQLNDAWMLRGGVAWEQSPVQSDDQRHPALPDSDRLWLSLGANYKINKQSSIDLAYSFIDFKNANVNYTDSCNPTGQKADGSLCTGNGGTVKGSYKTYLQLIGVQYNYRF

SEQ ID NO: 19389 - protein, 230 aa, Acinetobacter sp.
MSLKRVMGLMGSAALMASAGQALAADMPVPQEDIAAAAASEKSPWQIRVRALGVVPMDEGHVNGVAGSDLSYSSTVVPELDITYYFTDNIAAELILGTTWSDVDGDGSLPGIGVSDVGETWILPPTLTLQYHFTNFGSFKPYIGAGINYTIFYSQDDGKDSKKLDIENTFGAALQVGFDYMVDDHWGVNFDVKKLFLEADYDVTLNDDSKVSGTAELNPWLIGAGVTYRF

SEQ ID NO: 19390 - protein, 339 aa, Acinetobacter sp.
MNKNILALAVASATFGTQAVAVEVYNNDGTTFSIGGHVSVALEDSKQGDLGVTAVSPRINFNATQDLGNGFTADAKGEWSINYLDGGENALSTRLGYIGLTHESLGRGVVGTQWAPYYSVAGVADMPIAFANDFIYQDHGNLGTGRAEEMVSYANAFELGEAGKIALGLGWQGRKTDNNNSYGNRAQIALNYSIANVTANYAYNTGDVNYVGGVGTKTSESHVISATYGSYGKGLYLAGVYAMNEYMNSGDGNLLKDTSAYEALAAYTLNNGINLSVNYESVIDEELSKRVYSTSAVQAEYNFTPKFVGFAGYQFDLQGSGDYKEKADDKWMLGARYYL

SEQ ID NO: 19391 - protein, 864 aa, Acinetobacter sp.
MRFTQVLCGTASAVVLAGLTPLAAQAQDTETQTVDSIVVTAQKREQNLQDVPVVVTAVGAKLLQDTGVRDIKDLTILTPGLTVTSTSSEASTTARIRGVGTVGDNPGLESSVGVVIDGVYRPRNGVSFGDLGEMERIEVLKGPQGTLFGKNTSAGVINIVTKEPEFGFGATAEATVGNYNAHGASASVTGPLFGTETLAARLYVAARERDGYNDVVTGKGPSKRDQDADQGFYTVRGQLLFVPDDKSSFKLIGDYTKRDENCCGAVQIRTGPTSAIINALAGGKGVGALTDNPYDRVAYSNRGAPSSIEDKGVSLEGNIETPFGDLTSISAIRQWRTDNGQDADFTTADLAYRNKDGTNYSQFTTYTQELRLAGKTDKFDWLVGAFLADERLETKANFLYGNDYEAYLGTILLSGIASSLAPAGIVLNQANGGGFMSQASGRPVGTTFTGGQGLYDQYKQRATTVALFTNNSWHVTDAFDITVGLRYSIDKKDLDTYQTTSDGGVGCGSVLSAAGQQRIALALIGRGVPAALFAPGNPTGASLVSTVVGNMCLPWANPQFNGRGTKQNRSDKEWSGTVKASYRFSPEVFTYASFARGYKGGGYNLDRTQSSNGTPTGGAGITPIYDTSFPGEFVDSYEIGMKNTLFNRTILLNFTGFYQKYSDFQLNTFLGTSFVVRSIPEVTSKGVDADFLWFTPVHGLTVQSGFTYADTKYGDQKIPGDPGNALALLPGSRLSLAPKYSASASMTYEHPVGDNMKARFNVGAKYSSAYNTGSDLFPPKMQEAFTLVNARVGLGAADDKWTVELWGQNLFDKNYKQVAFNGTLQGSSGLSATSPTYTPAKDTITYDAFLGAPRTYGVTLRSRF

SEQ ID NO: 19392 - protein, 1043 aa, Acinetobacter sp.
MRYLRILCICIIQLFLSAVAFAQTQVTGHVADVRGEDIIGANVTVKGTSNGTITDIDGNFTINVDDKNGTLAVSFIGYKTKEVKIGEKARLQIVLEEDTETLDEVVVVGYGTQTKKSLTGAISDVKSDALTRSVSTTTAGALSGKIAGVSTRAVDARPGRGINLEIRNMGSPLFVIDGIPYGGMNSRDWLQVSDVSGSDVFNALNIEDIESITVLKDASAAIYGLRASNGVVLVTTKKGKKNDKVSINVNGYYGWQNLTRFPKLANAGQYVRGLAEAAQNRGEDPSKLYSPEELAKWEAGTEPGYKSYDYYDMVMRKNVPQYHINANVTGGSERTNYYLSVAHTGQDAMMRDFKYERTNLQLNIDTKITDRFTIGAQISGKYEKTEDVGLPGGDGYYSAILSMFKMQPIESPYANDNPEYINNVHENGYNPAAFSRDIAGYKDNLTRNANINAYAQYDFSFGLTAKATFSYNYTNSRFDGYQYAYQIYTYDKEKDTYNGTPAVGRWRSQIDRSVPARYMQLQLNYAKQIKNHNISAVLGYEASDYDWTKKTYGTEPSTDYLPLLQFDELNSFGDEWSYEARAGWIGRINYDFAHKYLIELLARYDGSYLYAANNRWGFFPGVSIGWRISEEKFFEKLRPVVDDLKIRASIGQTGTEKDVKLFDYLSGYTWNNGNAVLDGELVTGLNQRGLPITNLSWTKNTTSNIGFDLTMFNNRLKITADAFRKDITGVPAARYDVLLPSEVGYSLPNENLNKQAYIGAEGMVTWTDHIGDLNYTVSGNFTFSRYKSIETYKPRFNNSWDEYRNSAEGRWGGIYWGYQVIGQFQSEEEIRNYPVNLDGNNNRTLLPGDFIYKDVNGDGIINGMDERPIGYPEGWAPIMSFGGNIGLQWKGIDLNIDLSGGAMQGWRQNYELANAYHGNGNSPVYLLEDRWHRADLYDPDSEWIPGRYPAIRKGEFSYNNKNSDFWLHNVRYLRIKNLEVGYSLPAQLLRPIRAQKVRVYANVSNLCSFDNVGKFGVDPEITAAAAVVYPQQRTFLLGFNITY

SEQ ID NO: 19393 - protein, 139 aa, Acinetobacter sp.
MYFVLMRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGWICPYISRHLLSLNPLQARCRRYSRGER

SEQ ID NO: 19394 - protein, 335 aa, Acinetobacter sp.
MIGFSRGLAASLGMFALGAAWGQSSQVQISGLLDLGIYRDFKGTAQLGTIQRSHITFSGVEDLGGGLKTTFRLSHRLDLDTGLNEGFGQKPFWHGESTVGLRGDWGHVRLGRALSALWAHDWKFDPWGHINRVASSAWYQWFYYAPTDRVSNNGAPEFGRTPNGIFYDSPTLGGFTLHLSGSPERTQGAGGGKPYAASLEYASGPLSGLLALDRNGSGDRALFGAVKYRLGVTTLGETTLGDTSLMASADDSCRAQGLGRSRVLSVGATHKLAAQTTLRVGVGRQKLDGDTRLFYSLGADHALSRRTTLYLSLGHQRPDHKGGSTSLGAGMSHAF

SEQ ID NO: 19395 - protein, 669 aa, Acinetobacter sp.
MLFSTFAYADNILESAANERSNTSRGIVENKRVLPKSVVKAVFSKDLQSTTNITWQGKDTILHSGDIAKSMLQVPGFSMTRKGGGGSEVIFRSQVASRLPIFLNSGVLNGACGGRMDTTTTYIFPENYNRITFLKGPQDVRYGALISGGLLFERDILRLGKGSFNVDTSAMYGSFNRFDINANALAGGKYGSLQAIVSHYESADYRAGDRRIVHSAYNRESASLIGTFTPTSSTALEFDIDIGRGWASYADRAMDARTFDRISYNLALEQHINDTFDRLDVRLWHNAIDHIMDNFSHRPPQAINNNLYNISNPKRTNTGGRVEGRFYFGENVEFYVGSNYNHDSHESRNGGGATLQDANNVLNQKYNPNFTFKNLGFFTQGQYHSQSNFGIAFGARYDYLVTERKQLAARSAAEDKNNLASAFVRYEHYLDKSTLYAGLGVAQRGADFWERSKANGMNLSPETNTQFDVGLTYQDDAFKSKVSAYASHMANYILINYIPATASAFNTDAFLAGGEVEAEYIVWDSLHFYGSLAYTYGLNLSTKQGLQSHSPLPQVAPLQAQISSFYENGNWLLRLDVIANAVQNRYAFNYGNVVGKDLGNSKGFVTLNLYGGYKHKYFMLLAGVDNLTNTLYAYHLSKNGIDIGALDIAPTTRIYEPGRSIWTKMRVYF

SEQ ID NO: 19396 - protein, 363 aa, Acinetobacter sp.
MFLGYRNKWLCARAAAVAIMLLVAAVAHAQGSITLYGRVAGGVDYMNKIATGNGQTADLLRYGSNQWGVSLWGLRAKEDLGDGLSAVMNLESAFSSGDGQGAGVGLFSRYAVVGLSSSTYGTLWLGRAMGLPDSEGWTVDPMGMQAISIGTLQNGRSWGSRGNAITYASPDWGGLSFRAQAGLNGVAGNFNAGRQLAGSLSYDNGPILIKAIYEEIRDAKGEFTNLYTASRLYEAGAAYVVGGLKLFGGYSLTRSGGATVADADNPMAANKQQQFWLGANYQVSPALTLIGGAYRAIRNNSAGNGTLLALGANYFFSKRTLLYGTVGTVMNGGNAAFSVEAGSNRPLAGASQQGVYTGIVHRF

SEQ ID NO: 19397 - protein, 710 aa, Acinetobacter sp.
MLGKGIKKSWGWLGLTVLLLGSPCGWAAEFSASFKGTDIQEFINTVSKNLNKTVIIDPTVRGTISVRSYDMMNEGQYYQFFLSVLDVYGFSVVPMDNGVLKVIRSKDAKSSSIPLANNEQPGIGDELVTRVVPLNNVAARDLAPLLRQLNDNAGAGTVVHYEPSNVLLMTGRAAVIKRLVDIVNTVDKTGDREMVTVPLTYASAEDVAKLVNDLNKSDEKNALPSTMLANVVADGRTNSVVVSGEENARQRAVEMIRQLDRKQVVQGGTKVIYLKYAKALDLIEVLAGNGTSGNRNSSSSNASRPSSPRSGSSSNSNSSSGSSGSSSGSSSSSSSSSSMGFGSAFGSTSSSGGRTITIQGKEVTVRAHDQTNSLIITAPPDIMRDLEQVINQLDIRRPQVLVEAIIAEIQDADGLNLGIQWANKRAGMTQFTNTGIPISTAVIGTDQFRSNGTLTTAYASALSSFNGVTAGFYRGNWSMLLTALSSDSKNDVLATPSIVTLDNMEATFNVGQEVPVLTGSQTTSADNIFNTVERKTVGIKLRVKPQINEGDSVLLQIEQEVSSVADSNSSTNSSLGVTFNTRTVNNAVMVTNGETVVVGGLLDKTSVESNDKVPLLGDIPWLGSLFRSKSQEVRKRNLMLFLRPTIIRDPGQFQEASINKYRSFNNEQQQQRGEGNGVLDNNTLRLSGGNTYTFRQVQSSISDFYKPEGR

SEQ ID NO: 19398 - protein, 438 aa, Acinetobacter sp.
MLKAQKLTLAVLISAAIISSAQASEQSEAKGFVEDANGSILFRTGYLTRDKKQGAKDTSSVAQSAIVSIESGFTPGIVGFGVGVVGDGSFKIGENKNTGNQMIPKHNDGSAYDHWARGGGSVKARFSNTTVRYGTQVLDLPVLASNTGRMVPEYFTGTLLTSHEIKNLEVVAGKFTKDQMSDQINTDADASGRGLDRAIVWGAKYKFNDNLNASYYGLDSKNALERHYANVNFKQPLANDSSLTYDFSGYHTKFDANAHTYSATGTVAPNYAADGIADEEKTNNIWAISGTYATGPHSVMLAYQQNTGNVGYDYGQNADGFQSIYLPNSYMSDFIGNHEKSAQIQYNVDFGKLGVLPGLNWTTAFVYGWDIKVRNVTDDAQEREFFNQVKYTVQSGFAKDASLRIRNSYYRASDAYQGAYIGDTNEWRIFLDIPVKLF

SEQ ID NO: 19399 - protein, 787 aa, Acinetobacter sp.
MTRPLETRPARPTRLARPARSTPSPITRALAALGWLGLPLIALPGTAAAQAAAAQLDRVEIIGVSPLPGQGIDRNILPYSTQVLKRDAIDGAQAVNQSDYLNRRVVGVQVNEIQGSPFQGDLTYRGFRASPLLGAGQGLSVYLDGVRINEPFGDVVNFDLIPEFAINTLSLVPGANPAFGLNSLGGALAYTTHDGRSAPGFRADLSAGSFGRKRADLSYGRSDDSGWHQYVAVTGFDEDGWRDHSDGKLGQFFGKLGHDDGTTSWSLGALYAQSNLVGNGLLPAYTIDDGALVKDLYFSRRESVYTFPDQTRNKLGQLSFNGQHAIDANSSLAALLYVRKSSRSTINGDEAEEEPDDPGDPNAAFNNTATTQTGYGAALSYTRVSGAHQWQVGASVDRSRVEYSQYEQEGFFTDRRGVIPAPGEDRELSANVEGRSTHYGVYATDTWQVAPRTHVTGTARYNHSTVSNQLTTRDDDTGIIEDKPNERFSYNSVNPALGIAHRLGDAATTPTLFANVARNTRVPTVIELGCADPDEPCRLPAGLQADPYLKQVKSTTVEAGLRWPLAPGMRFNLAAFRTDNKDDILFRSTSVTGQLGYFANFPKTRNQGVDTEFAVTHGAFDVGIGYSFLKATYEANGVLRQGERNVTITPGTRIAGLPRHTLKLAVDWRVGDGLTVGSDLQAVTSRGVSGNEDGLLEDPEVGEDPEYKRVRLPGYAIVNLRASWKPSAQWELYANVNNVFDRRHETFGALAETMFDASGNYTGEEADALFVAPGTPRAVFVGLRYRF

SEQ ID NO: 19400 - protein, 417 aa, Bartonella quintana
MSKKQIFTRTLITAAITLASSQSMAAGFQLNAQSATGLGRAFAGDGVIADNASSMAKNAASMTLFDAPALSLGVIAIDSDIKVKDTKFSTSMMSDSVNDASIGGTSYAPNIYYIQPINEKLSVGASLYSNFGTKTEFPSDYGKQRLIGLNDLFGGITDVKSINLGLSAAYRLSHQLSIGGGLDVIYGQGKLQRGRNSAILGGKDALNIDADGVALGFNLGTIYEIDKNNRYGLSYRYSPTLEAKGDMSYGGNDIGNEKLKMPLPDMAEFSGFNKLNDKFAVHYSIQWIRWSEFDKLETTGGSFTKAYEWQDSWHYSIGGTYYLNNKWTLRAGYMYDTSAQNELTSISVPDSDRNWLSSGFSYHLDSKSTIDFGVTYLIGKDVKVNESQPVPVLGNASVSATTRANAWLYGLQYSRSF

SEQ ID NO: 19401 - protein, 715 aa, Bartonella quintana
MYKQSLLSASIVLALSSTSALAEDYALFDEVVVSSTRTNQTLINTAASVTVISDRQIEENMAKDVNEIFEYTPGVTMNSSSRQGAQTINIRGMEGKRVKILVDGSSQPGSFDGGPYAFINSSGISIDPDMLKSVEIIKGAASSLHGSDAIGGVVAFETKDPSDFLKDGKDFGGQAKLSYSSEDNSFSEHVALANRFGDLETLVAYTRRDGEELQNFRNSGDLENYAVENQDTSADNLLVKLQYQLNESHRIEFLAELIKDTSDSDIYHSSYDSYTGEDDTKQNRFAIKHIWFADGAIADTVTSKVSYISKEENGVTKRFKPAGPGFPPYVPANNDNLQTKDYEYTEDKLEIETQLDKEINNHYLVYGATYTHSDISNTNMEYNSDPATDDQLYVYTPDAKEQKFGLFVQDEISLMNDKLVVTPGVRFDYFSTDPGKNTGESLTDFSDSAVTGRLGTTYKLTDTGTVFGQISQGFRAPSFDELYYTYDNPGHGYVNDPNPDLKSETSISYELGYRHNTQASSSEIAAYYSDYDDFIETVVTKKVGGTTHYSNVNLESATIKGIEFSNTLLWDVLVGAPEGISTHFVASYTEGEDGNGNALNSVNPWNAVLGLNYDAPNQNWGTSLKLNYTADKSGSDINFDDENGGNAGQAELPSATVVDLTAYYKPMKDLTIRGGVFNLTNEEYYRWNDIRGDDELYKENSQAERNYGISAKYEF

SEQ ID NO: 19402 - protein, 125 aa, Bartonella quintana
MINSPRVCIQVQSVYIEAQSSPDNERYVFAYTVTIRNLGRAPVQLLGRYWLITNGNGRETEVQGEGVVGVQPLIAPGEEYQYTSGAIIETPLGTMQGHYEMIDENGVPFSIDIPVFRLAVPTLIH

SEQ ID NO: 19403 - protein, 1062 aa, Bartonella quintana
MIKVFRNHVCLCACTTAILSLLQNGREVYAATQEEEGKPYVIKVIPVVSANSSPQLSGSNKHKLPLKGESGGNYSPSMINIGNNDEGISGGDDYRVLSGKEGEKRHQNGGKGYEKNIDNTVRNEDSDERGVNPAFYYYSGLYYVCDNCGTGPNNVKSTGEGPKIDNKSYRITNENASNYPPGPTAITVKGIGTEVRGKNVTVSSQVADETFLMGVHVLENGKIVLEDPIIKNTVIGLRASNGVIEVKNGEIGESHEGVDAADRSFVLLEDTEINTANGNASLLSYEHSEVWMSGGSVDFMNSHGVSSMLGGKINLENVKVTGKGKEKNSDNHAVVRADLEGTVNLKGTTIRAMDVHGILLENKVNSIPLQEVKDLSNEDSHSESGVPVTEVNIKSSTININGAGSYGIYFQGEKPWSEGGDKKEGTSLGEEKSPPRLEIVNLDRTDFSVSDDTALYGENLISGAVSLMKSTLHSGNFLLKAEKGASITVLADGSTLEGRAHVDENSNAELYLGGRSTWILQQQLPKDQHKVANDSSISLVSLMGGSSIHFKRQEPSSVDDHQTLRIGKGKGEVYRAREGASIFLNSYLNSGGALDHQKTDRVLIHGDVSGKTMLHVHAVAGSPGGYTGRGGNDEGLSIIQVSGEAKQDSFQLEGGYVALDELPYQYKLYGYGPESDLGKANAGQRLVEGSGEFWDFRLESRSIDSDIKPKPDPRPTPPAPTPPSPTPSPAPEPHPVPKPGVRAVVPQVPTYLLLPNALRHLGLMNVSNQNKRLESLRIAAGGLLESHEKPFFFVRGYGGNQRYISNLSALEYGYDGELSYNALEAGVLLKAIENMYGTTSFGIIGSYEKFSLQPVNVEQSQKSTFDKWSVAAYGGMQHDAGFYVDGLVSYGFLKGDVLTTARGKTATLKGNPLSASLTTGKTFMVGEDGFVFDPQVQVVYQYLPFNKVRDVDGFDIDLGKIHQWVGRVGGRLTKMLVAGDEAQVISFYGKLHLAHGFEGKQFVHFKDAFQLGAFGSSLETGLGFNAQLSQNFALHGDLIYQHKLTKAGFSGTSFSGGLRYHF

SEQ ID NO: 19404 - protein, 676 aa, Bartonella quintana
MNVCLPSKPYHDLSKTSLAVALALVSAQSLADTAINNENTPLEETVVVWGAKVSSSSESVFAEDMSLRQADHMSDLLRDIPGVDVGGTHSVNQRINIRGFGETDLDIRLDGASQHANMFHHIGNLTLNPDIIKQVDIQVGNNSVTQSGIGGAVYFETKDARDLLRGSDQFGARVFGGYADNNSKQGSLTLYGLMSEKVDYMVYGHGVSRGNFKDGDGNQTYGSEGDVYNILGKLGFEPTHEHRFELAYDYYRDKGDYNPRPDMGGNANIGLTQDDLIPTTYDRNTITLNYELNKEKHIGRVNAFYSKTKIERDESAISGRWPGNRHSNNSAENRNQGFNAKVQSQLPVFGFDNSLTYGVDYVDKQSKSAYGGVEFMDESAISSAAFIEDKFYATDRFAVTLGGRYDNYKREATTSDKTFSDFTWALAADWEFVDGWTLFASGRTLFKGPELLETFIRYQDVAYLSDDIKPETGYNAQGGLKFNRHISEHFIGGNLTLFNTRIDDYIVAEGSGRPYVYNIYNKGDAQYRGFELSGTYSYQAFRSKASYSKSDNKDLTNGGPVVNAAGRSADIGDSIAVTLEYDIFAVDTLIGWTSIVVLDETNVQDGAPIKQGYNVHNFYAQWVPNQTPELSVTFGIDNIFNEQYVSHASRSGTARGFTLDDYEPGRNIKISAAYEF

SEQ ID NO: 19405 - protein, 354 aa, Bartonella quintana
MRHIPSTSLVAGALVLASIPAHAQSSVTLYGITDVGIEYANHVPSGKTSSSAVRQQSGNLAGSRWGLKGAEDLGGGYKAIFVLEGGFNLNNGTLGQSGRLFGRKAYVGVSTPYGTVTLGRHQNLLYELMYKYDALTFNPSYSAQSMDSQFVNRADNSIRYGLNIAGVTFAMLYSNGFDSTIPNGAQVPGATKVGREMSAAILYDRGPVSIGLTYDQLQGTSIATQSNTQSRALLGASYDFGMVKALAGVRWLDTRNTDTPPSSMLYWGGLTYHVSAPLFVSASVYHTQFRNPHGGPTMGALLVDYFLSKRTELYAEGAYVNNRSYSNVGIRGTGVDITTGADQTGVTVGIRHTF

SEQ ID NO: 19406 - protein, 725 aa, Bartonella quintana
MRIRQKNIYKGCAILSALSVSIPSFVFAQSNNLGSVTELKPIIIKEKNIENVSDSITILTNRKTAKDIDEKQISDVHDVSRLNPSVNYNSRNNSFVIRGLDANRVLTTMDGIALPWFDDIVRGRGGNTTFDFNALSTFDVIQGSDSSLYGSGALGGVVALRTLNPEDLITENKNWGSLIKGGYHSVDNSWHIDQAIALRNKQTFVLFQGSHVEGHERKNMGTVEGYEERTRKNPAQFDKNNLLFKIHQYFNGNHRFGLTAERFNYNINTHSLNASTRYAPGSVYDQDNKRRERFSLSYNYNGNEDALFDAFSGQLYWQKQISRHIMNGFRVKAPEGDYLRDNFLRDTSYGFNTHALKKMNIGTVSHTLKLATNVSSSQFHHYLLGKDNCHLKEYAQGCAFLPANRSDSPDTNSYNFGFALENQIGFADDHFRVTPGVRYDWYKHIPQKTSSYEKALISDKYPPERNGSRFSPKLRMEWDVRDQVTFYVQWAQAFRAPRVSELYLSYVKPPLYYVKGNPDLKSETSNGYDIGIRYGNANFGGSFNAFTNRYKNFITTEDKGSSEEFRFGRRHYVNLSNVRIFGVETKMHWVLNNGFHSNFALAYSQGKDLDKNEYLNSIPALKAIIGVGYAKDTWGADVVVTSSAKRDKVAKGSDYQKIPGYKVVDVSGWWKPFDKKGLVVRAGIYNLFNEKYWNVSDLPDGKSSTPKDYYSQPGRNFKVSFVQRF

SEQ ID NO: 19407 - protein, 1103 aa, Bartonella henselae
MKKSFLLYTVSGVLFYSSTSLSYALRSVTPPTMDSSSSRPVHAECPTNTSGVFNPYNDLCDGMGERRPSHPPHSSSEANVPTPSTAPSSSRLTTGNTTSSPSQKPDHAQETEGVQSHTTTTQNTPITQSSPTEMASTTGTAPTTEMEVKSRRRSGVSTSSTDSSSEKTSSNSAISLQSEATQSSPNLQSTSANSESTGSILTRPTTGQSPAPQESELTQSISVKPAPVQSASTQEVSEKSKPTKPVSEKTTTKLLSTPKESETRQRILLRPEADTQKVSKNSEPQKPESTRPTVEQSSTSNVSELSAISVRPAAGKLTSQETSESLKPAPVQPISPIKQSEKPAQIENISAGVEIQNGKTVTLHNKKIQDRGFAVHADGNNSKILMNGGTVDAGFVALSVSNGGEIDATDITVTSETTGLANIEGTINLKDSSVHVTGNYEANGIIFRNNPYRAPQKRYTRNAERNTNAVKKQEIAGKVNLENTNLFVDHGVGINLYGRNTNGVVSLKNSKIHADVLLKNIKNENESTNTLTLVTDHSSLEGQVKTSKDNRTIFDLKEETKWLLKPNKNAVNNDRVSDDDNILDDYRQFGLDEESFSNLSVLHLTDSAIVFDKPVEGLYQTLLIGPNLSQGNKTAPTAAVYSATGVAEIYVNTQWDKHSPITEQKTDRVVINGDVLGSTVVHITLQETDKKMTDNSAVWGEHMASLPLGTHGISIIQVSGQANENSFTLAGNYMTIGGQPYKYVLKGYKPGTSHESQSLLGNDSNFWDFRLQNAYIDNDKKVRALLPQVANYLTLPNALFSAGFADVNNQNTLLDAMRSTVFGANDNKKNNLFFSSYGEKVTLSSSRGPLHYGYDADVNYGALQLGIILAALESNDISTHFGLLGTYGKLAFTPKEMQDSEKTMLDKWSLTAYSGVQHSNGLYVNALLSYGTLKGNITTALVGNAAKLDGTEILNISATLGQKLATDTKGLVFEPQVQFIYQNLMFDILSDANGLKVDMENPHQWLIRFGGRLTKTIMATEENKAVSFYGKMNVIRTFGDGKTIKIADTFHLDPTGSSIEGGIGVNAYLSQSIVLNGDISYRQKLQKAGVTGTNVSGGIRYRF

SEQ ID NO: 19408 - protein, 873 aa, Bartonella henselae
MCKKSNKKNFLLCTIAGTLIFSHFGSTHAKTLLHHEIPTVRTTNGEEKKLNNVFIHTGSSGVHATKKAVATVTKETIHEIPEIQVTDGKEKAFDNVFIRTGSSGVYATKKAVATVTKATIHANSFALAVSTGGRVNAKEIEANVLQGGLSITNGIINVQDSIIEAKKESGIIFHKILDFFVKEGEEVVNKAILNNTKLLVRDGVGIVGPLSSKSVAEVQLRNSEIRSDVLLKNHLKKATDSDPHPVTLILTADNSIMEGRARTLQVNTTVFNLSNNSKWYLNVSQYDVDRDSSVFNYALHDIQQRALSTVSVLNLHNSSIVFNAPHALANGHYQTLSVGKIQTAEDSRLQENRDSSLATVYNATGNAKIYFNTEWSDGLPKEKQKADRLLIHGNVSGTTTIHINNLSKGEITRSKDSIPLNTRGLSIVQVSGKAEENSFKLANGYTTIGGLPYKYTLNAYGPTSNRGKANAEQSRLGEVSQESKENAPVTNTNHLVLGGVVVEIEQDIKGEPTSNRGKANAEQSLGGENKNFWDFRLQSATLDDEGEIRALVPQVASYLVMPNALFSAGLAELNNQNILLENMRTTLFEAKDKKEDNKKSGIFLSSYGHKITLSSNRSPLHYGYGADVHYTAIQAGVTLAALEGQNSTTHFGLLGTYGKLSFTPKGMEGADKSTLDKWSLAAYGNIQHNDGIYVNALFSYGAFKGNITTALIGNTAKLDGSHTVSASATIGHKLETDAKGLVFEPQAQLLYQRLMFDTLSDIDGFNVNMGKPHQWLLRIGGRLTQTIPSDEKGYATSFYGKLNLMKAFSNKSTVQIGDTFYLDAMGDSVEGGLGVNAQLSQNFALHADINYQHKLQKAGVSGINFSAGMRYQF

SEQ ID NO: 19409 - protein, 173 aa, Bartonella henselae
MCKITRLILTASIMMLCNLVHAQSAAPQTGASEFAGPYVGFKLGVNTSDASGVVNKASHTTAFPGFTAGYNFDVDRFVAGAEVFADLHHGSTTYKDGGLDAKLGLPFNQFMPYVRIGLTTDWPDIRPHWGLGVEYKFAKHMSAVGEWTTDTSNHDGTRRTNNSFTIGVQYHFN

SEQ ID NO: 19410 - protein, 1082 aa, Bartonella henselae
MSKKILFLFFCVFALAAHSQNVVIKGSVTDVNKEPLLGVNIKVKGTTTGTITDIDGNFSINGPKGATLVISYIGMVTQEVEYKGQPLNVVLKDDSQALEEVVVVGYGSMRKKDLTGSVVQVRPDKIANDNPKTVQDVLRGTPGLTVGYGESDAGAKGGGSMKIRGQRSVYTDGGHNDPLLILDGMFFYGELSEINPDDIAQIDVLKDASAAAVYGARAANGVIIISTKKGKQGKPTINFTASIGLTQKAAYRDRWQSPEAYLQHYVDWKEKNTYGVNAETGEYAAYSRPGNEYTSKPGYFRNPNNLDDVSLEAWRGYTTNDEGESDLSIWARRLGFRPNTALMDNLLSGKVMDWQDKAFRLGFNQDYNASISGAGEKIDYYMSLGYLRNEGAFVDDTYRAIRGNFKLNAKVTDWFEIGANINFQDRSDGEIGMDKGGFMENSPYAVFKDDEGNYVQDPLMFQYDRNNLTNWYYEKQFLELQKGYTTFNTIFNAKLKLPFGITYTFNAAPRLQYFHDRYFMSAERPNSKPTDRGVNREQAKRFDWSLNNTITWDHTFADKHHVILTLAQEAEERQYWSDRIEARNILPSDVLGFHNTQNGDKSASSFRSDDSHQTADGLMGRVFYSYDDRYMATFTMRRDGYSAFGSSNPYAYFPSGGLAWTFSNEKFFQPYTHIMSTGKLRVSFGKNGNRSLANPYEALANLYPGGGKMQGYITSSGDLYLMRYLMAQRMENPGLQWEKTQSWNFALDFGFLNDRITGTLEYYRMSTKDMIMGQRLPNFTGFESITTNLGQVDNNGLEIALNTLNIDNKNFQWSTTFSLSYNKNRIKHLYGDYEDILDASGNVIGKKEADYVGNGWFIDRPISAIWDYKVTGIWQKDEVEEAKKYGQVPGDPKVWNNPANDEYDADGNLKKVIYNNDDKVFQGQTAAPVTWALRNDFTLWKDLTLSINIYSRMGHKSLESMYLNNDDDGGGMTYRLVNKPAKEYWTVDNPSNKYARIEAQGPEGARGARRLYNRSFVRLENISIGYTLPRQWTKRVDIERAKVYATVRNAAVWGSKDWEYYGDPETGNYASRIWTLGLNLTF

SEQ ID NO: 19411 - protein, 2008 aa, Bartonella henselae
MINVLKNRTRLCALTTSVFFFLQGMDVSMGASAGVGDSLISNPFVVSAGEGFPSYRCEVGTFGQIDRGPIYCDDGEFHKMKRGSITVPVYGSAAVTAIGKIESLPASADLQDDDIDNTFHKIKETTVELDAVLLKSKGLSYSDELVTFENGIFTHKFSDSDELVGFGSAVYSVLDAKVDLKRSNIRGFIVGLNAESEGIIVMRGGEVRRSFLGAEASDASFVVLDKVAINVDGIGLYSDGSGINMVSGSLVFPEEGIGGISTNYGSITLKNVNIQIKKAGNVEVDSVQDSDNDGPKSVGFLLHEGFVSFDDVTFNDSDAAVLYILGGLDNVVRQSVEYASVLSVEDVSSVEVADVSLEDLLRPEYVVRNNNFITPYRKGQPADNNAFASAVSTMSAVLNEIYDDKGAFQATRAFKVSASIKSSNITLNGKESYGIYFKGRERDEEKLLSSSGANEAARVVLLEDTKLNVPDGLAIYGDEGSKSYIILGKKSRLSGNLSLKAEPNSIMSVFAHDSTILGGVVTDEHANTELFLSGNSSCHLIKSKDKGWKCSEADNYIDSCISAISLVDSSIKFVSSQSDQAHAGGYQTLRIGDESTLSYGVYNSLGGSAIYLNAHVISDDSGHTQMVSDKLLIYGFVSGETTVHVNDVVRRGGNSNTVRLEETQNKSHSVSMIQVYGLAREDSFQLSSPYVTMQGSPYQYTLRAYKMENSEKTFEGDLESDDTAEWWDFRLESKVQDGDTSTYLLYIPGSPINGVEEVAYTVVDGDDDLSKPSVLGRSEIAEDLIGDLSLVVVPSTLPERSASVASAELERSETEDEVSVILNPSSVETSIPPTVSGNSAGPVRGGQSAPVARSESDGGVTVVLSPSSVETSTPPAVSDNSAGPVGGEQSASVARSESDGGVTVVLSPSSVETSTPPAVSDNSAGPVGGEQSASVARSESDGGVTVVLSPSSVETSTPPAVSDNSAGPVGGEQSASVARSEESAATPYTVFTALQGTTESRPVGRILLSTPVKSTVVSTESRDPAPIISAAASPQPSVMQSIVTSKPSASVDSAGKESVSSQCNDRGRNGAETLQNSYLCNDGQTHTVTDLTLKASGALQHPMHAKSQNTIIKLEGATIMGAADSENNVDLTKLQLVSTVLAEDGAEVVLDKKSTVKNSSIGLEAQKGGKVKMTDGTVNARYVGVLAGSGSSVNLSNTKINVTGDLAIAGLASNAGEATMNTGVITLTSGVAVRSESGGNVKLDNVKITAKKGQQDQPDSAETFGRAAFLVSDRGSVEFTNGYVSTDANGLWMRDSNDSVENSTSDTGTSRRKRSSDVRPSLNRAHIELSDVKVEGDKSYGIYFDGTGRKEGSQQNRNRVLEEAVTELSGTGSTIEKVSVVKRSTVSQKEKTPIDITGAVSLKKTRFEVINGIAIYGNNSGGQISLEENTILSGDLLLSAENNSHISVSVDDSIIEGWARIDKSSYAKLDLINKSEWILKRSVKRNFATPDSGCIDSCVSSIRLVNSTIDFVPSESEDLYQTLHIGTGNAKVYEAHGDVAIFLNARLNPRDPSDQQVTDRLVIHGDVEGKTRLHIRGVSDIVGEGKDNNQIAHSVSIIQVYGQAEKDSFQLDGNYVALANSPYKYVLRSYGPQLTAKQEHIEQKFIKDGGAFWNFRLENQYVKPSVPTDGLVLDERADGFVLPERVVRSVVPQVPTYLLLPNNLFHVGLMDIGDQNKQLETLRMSAGGMLEVHENPALFLRGYGGHYRYASDLSALEYGYGGHLRYNAVKAGILLKTIESADNVVSFGVMGSYGKLSLQPKNVEHSEESTFDKWSITAYSTLQHDAGFYVDGLLSYGLFKGDVVTLARGKTATLKSKPLSVSLTGGQSFATGYEGFVVDPQVQVVYQNLQFDKARDIDNFDVEMGKLDQWVARVGGRLSKSPTGSEGISATSFYGKLYLVHGFRKKQSVHFKDAFQLGAFGSSLEAGLGFNTWLSPKFALHGDVVYQQKLTKAGFSGASFSGGLRYQF

SEQ ID NO: 19412 - protein, 763 aa, Bartonella henselae
MTAVIFRKTLLAMAVAATAIPAFAETVQLTNAGYNSERQAHTGNLEINGAYTGSTVKDAIKLSGSTVDKDLIFNANINNSGNLAGGEEAKGVSLQGGRIVGSVINRRLIDVTSTGATALDVATSLAVFENHGSITATGTGSKGLRIDGATITGSNAYITNAGTIRGDGAAIAIGTTRYSISNAQPWFIERGDFNIYNTGSIISADRAVDASKSNRPVELILRKGSVVVGNLIDLSNIELEGDTSFAGTDSHTDGYNIRLKTGGEVYVGGTSSSPTTMTFESTHTSINGDLYVDGNSALGLNLSNATDTKTAVLKVTGTTQFEQGAQVKLAAKGDDFNANGTTYKLIEAGKIELLGKDGTAVDSAGKLDVVSTSALLKIDSYTVDGKNVVAVVTGKGREEVAQVVADNGGSVNEQATLVTLSGDSIVSRLNDSDSFKQLLLNADGGQVAKLASELAPEVSGGARSAATTSQSLISNVTGSRTSSIRGASSGEGFKDAGVWVQSLYSDATQDRRDGIAGYNAYSNGIAVGADGKVNENLTLGLAYSFINTDVNGKSGNKTNVDSHAFTLYGGFEKGNYFVDTSLTYGFNDNQSKRSIAGTRAKADYDSDLLGLNLVGGYTYHVSPQVLIEPRLAARYSQVNIDGYREKGSSAALKVEDQRYEAIELGAGMRVAGSFSLGAGTLEPQAKLMAYHDFAADEAQSTSTFLLGSTPFVTTGAKAVRDSYEAGVGADYKLGAVTLGVNYDYIGKSGFDADVFSAKVRYDF

SEQ ID NO: 19413 - protein, 454 aa, Bartonella henselae
MFKMKNITLALLMSGALVGCANIGDSYQASLEDYKQYEEITKQYNVKENWWSLYDDAQLNRVVGQALINNKDLAKAAVAVNRALYSANLVGANLVPAFNGSTSSAAQRRVDISTNSAISHKGSLNVSYTLDLWQRLANTVDAAEWSHKATAEDMESARLSLINSVVTTYYQIAYLNDAISTTNETIKYYTDIGNIMQTRLVQGVADAASVDQAQQAILTARNNKLNFETQRKTAEQTLRNLLNLKPNEALNITFPHIMNVKTAGVNLNVPVSVIANRPDVKAAQFRLSSAFKNAKATQKSWFPEVNLGASLSSTASTVGTALHNPVAAGTVGISLPFLNWNTVKWNVKISEADYETARLNYEQRITTALNNVDTNYFAFTQAQSTLSNLQQTHSYNQRITQYYRNRYNAGVSELREWLVAANTEKSSQLAILNAKYQVLQSENAVYSSMAGYYL

SEQ ID NO: 19414 - protein, 696 aa, Bartonella henselae
MRHKLGLLSSLGLSFISTLTWGEETSTVLETIRVQAESTREDVSQNSSATKFTHDVLDVPFNRAYLSKQIMEQQDVQRIDDALTLVSGVFHQNSFGGGFWDNYSFRGFSTDPNLGAAMIRNGLSVNRGISAPKDVVNIESLEFLKGPMAALYGRGETGGLLNLNSKKPQWESESELNLRANTQEQYRISLEHTAPINDELAYRLAVAHEDNQSFRDHVSSERWFFSPQLTWKISDQTQLDFDSEFTEHKGTFDRGVSTVNHQFVMDPKTFTGEPDDGDLKIKDYFYQLRLSHEFNPDWKLNSAVSYKDAQMVGFATEPRRMQADGRTLERQRRYRDYTSEDVLAQTELLGKIDTSWARHEILLSTELGQLDYKQNQLRRNHSTSSTNTIDIYQPEYGKYLPNLTPFTDTKERQRYFALNVQDQIFFNDQWSVLFGNRFDQVEQDFKNHIKQTEDNQTLHQNSPRFGVNFKASEQWAFYSNYGRSFAMNSGMNRNGQTFAPEKGESYEVGTKYKINDQSVLSLALFKMKKRNVLTTDPIDSNFQTAAGEVSSKGVEFDLNSQINDRWFVNANYSYTDAQIEKDQDLAKDARLSNVPKHQGSVSTNYEILQDGARKAGVGANLTYVGERSGHNLDNGFNLPSYTLVNLNGYYAPSDRLRYQLNVNNLFDKTYYVSSYSDLWVQPGEPLNASISAQWKF

SEQ ID NO: 19415 - protein, 809 aa, Bartonella henselae
MRYKTFLLAAASLASVATMANAQSATDTDQTSVDELVITGTRTAGRSRLDTLAPVDVVSEKALTRTGTTELAQSLSTLAPSINFPRPAITDGTDHIRPATLRGLAPDQTLVLVNGARRHSSALVNVNGSIGRGSAAVDLNAIPTIALDRVEVLRDGASAQYGSDAIAGVINLRLREARSGGGATITYGGYNTLVETARNTDGRRERDGETVTVQAWQGLPLGADGFLTVSAEYRDRNPTSRGDIDVRVTPARVTSRYGDAEVKDKTVYLNAGLPVGSGWEAYGWAGYQTREGGSAAFPRIVGDARQTPVASIYPNGYLPIIATDIEDSTAAFGLKGDLAGFKVDLNVVYGKNKIDYRTESSANASYGAASQTSFKSGGMTYDQTVVGLDVSRGVDIGAYEPLNVAFGAEARWEGYSIRAGEPASYNRGPITTAAAGAQGFPGFQPSNVLSRDRDNIGLYLDLESRLTERFTASAAVRYEDYSDFGSTTTGKLAARYELTEGFAIRGAVSTGFRAPALQQQFFTTTSTNFIIINGVSTPVEVGTFPATSAVAKVLGAKPLEAEKSDNLSAGVVFQRGPFELTVDAYQIKIDNRIVLSENIQGSATGSATAVAIYNLLAPFNVTAARFFLNGVDTETKGLDVVARYRIDDDQAGRFDLTAAANFNKTDVTKLPTTNTLSSLPVPPSLFNRANVLTFEEGTPKRKITLAGDWSREAWGATLKTTFYGSVLSPNNDPTGAFDVRTGSKAVVDLEGRYAINERLNLAIGANNLFDEYPNRTPANVNTTNATAFTGFSPFGFNGRFFYGRVSVSW

SEQ ID NO: 19416 - protein, 916 aa, Bartonella henselae
MDKMQPISQALYSLLFLGCMGAGFPLYVQGQNVDELPPDSIYNIGYARGSLKNISGSVEQITEKQMNRELITNPLEAIQGRVPGLTILKSNNGMAALESVRLRGTTSLTSGNDPLIIVDGVLGDLTMLTSVYPTDIESFTILKDASETAQYGSRGASGVINIVTKKGRAGKTRVNYNGSFGVSHAYRRLDMLSGTEYRKLAAERGWSILDKGYDTDFQKAIEQTGLQQNHNIAFYGGGEASNYRVSLGFQNREGVIQNEGMKLFTANMNMSQKMLDGLIDCELGLFGSMKRDRTLFDLQKTFYSAAAFNPTFPDFPDPETGSWDQITTASQITNPLAWMDVDNREETSYFSSHARLTFHLLKDLKMVLFGSYTYSTTENAQFLPTTVWANGQAYRGNRKSEALLGNLMLTYQKQLGAHFLDVLALGEVEKNRFHGFYTTTTNFSSNELGYHSLQGGALRPWEGTGSYYEEPHLVSFLGRVNYTYDDRYVLTVNLRTDASSKFGRNHKWGVFPSVSAAWNITREKFMRRFHLVDNLKLRLGYGLAGNQGGIDSYTTMALVRPNGVTPVGNSPLVTYESLKNVNPDLKWEVKSTFNAGVDMGFYGNRLLLSVNYYLSKTRDMLYMYDVSVPPFAYNKLLANLGSMRNSGTELSIGITPLRTKDMELNINANVTFQRNKLLSLSGMYEGEYISAAQYTALAGLNGAGLHGGYNNIVYQIVGQPLGVFYLPHCEGLVSDGNGGYTYQIADLNGGGVNLEDGEDRYVAGQATPKTLLGSNISFRYKRFDVSLQINGAFGHKIYNGTALSYMNMNSLPDYNVLAEAPARNIHDLTATDYWLESGNYVNFDYLTVGWNVPIKKQRFLHGARLALTINNLGTISGYSGLTPLINSTLVDNTFGVDDKRTYPLSRTYMISLGLNF

SEQ ID NO: 19417 - protein, 1113 aa, Bartonella henselae
MRIRKNGAEMLARAGRSSLLASVAAAALSIAPAAQAVVPNDNLSPEDIVDGTDVNGVGIMYRDDGFVCTGTLINPRTVIFAAHCVNDLSTPDYSTVNGGVPVAFAFQSDARPGLIDWISNGYRTNTALSVYNVNNIAYHPDSLDPPALSFLYGDVAMATLDTPAADVPTWTMLFSALPAPAAINETTGTGYHVTVTGYGRTGSGTTGNSVGIDFRRKTAENFLGMLGSLDDIDSFLFGAPGGYTQNLYQTDFDDPDRENPFDFNAFKDDALPNEGNTAGGDSGGPLILDQAFSEKTILGVLSGGSRYFFEQPESSYGGTSFYQPLYLFWDWIAQNNPYRYATTKAGDGKWSDADHWVTALDPNYRIIDSNGSLVNGVPTSPGAGAFGQDDAQKFGQLCYQPTDGSDNVCYDVGTDTLIVNGEPATGETQAVANAGGKTVSNNKGKVEIAERSPTAANASLNSTAQPQAEGDVSATALPDATLANGLPGASGFVPDNIDPVASQGVIGRYYDVTLSAAGTTTLDTDVTIDRFTISGGESALDITSEGSLTSEMDVAHLAGRVNVDGSLTSTGDYFLLSGLLSGSGTLRAPFLTSVMGTIAPGGVGTVGTLSVEGNAILTSGSTLHIDIGPNGASDVLAVKASDAGDDGVASVGGRVVVGATSGTRPRYGDSYTLVTAEGGVEGSFEQPAQLTAILKPVLSYSDNAVSMRIDAGLYADVVNGASVTQTSFAQLLDQNRSLYANYANLYGEADLLSVEGIQATLEAMAPRTETLKTSMSEVLNDNMARFYRDRLTKLDGGAMGGTLTMTGQPMQLAAASLNNIDLGMDQGGNESVTREGVLPDDMSAFLAGGYIDGKAQPMRSTMPMGRDTFDGWYVALGIEKAFGDNGVVGLSGSFSELKGNTAASDWGRARLYQGTVYGAFDLGGLKLDAVGSAGTMATRSRRSFSVGTTPYTLYGSDQELALSGEIGLSKALGNDGFSIVPRAALRGAYISSGNLAEYGGDAALVIHRQAIKSTQGRLGATAKADRGGFRPYLTANYVHEFQDQPAFLQANLIGGTGPLAPFALGGQDRNWAEIGGGLTVTTGNVDISLSADTTAWRSDVEYQSYRASLKFRF

SEQ ID NO: 19418 - protein, 448 aa, Bartonella henselae
MTTKTVFSISSVALAISVALLCFPSNAMAADSDKIIELERRLDALEKELIEAKDAANKVDRIKFSKSSPTPELISKDGSSTLEFTGRFQADYVSADELYTGNKFTYEDKFNDASLRRIRFGIEGYFSNVWKYALEFDFDGESDVEIKDANVSYRGWDNNELTIGFQKFGFGLEATGSSKNLAFLERASTDTFSPERGIGIEWGYIANYYNFKIGYGMNAGFDDDDKNFQQDIFNARFTAAPINNNVHLLHLGASALYTLNNDEVLETRYRARPSSKPAGRIIDTGKFDADSTQHYGIEAAYQRNNLLLQAEYMIAKADQVDDPTITVDSYYAQAVYTLTGESWQYSNKKGTFKAISPASAISAGGYGAWELAVRYDHANFDDTDSDIIGGKKTDYILGVNWYLENNLKTQLNYVHTKADYKEAYVDIDGVTRYDQDGNIIQARVQFAF

SEQ ID NO: 19419 - protein, 453 aa, Bartonella henselae
MNTKRLITVSIFALVSASAAQAADVGIPHQSAPTSLPVIAAPAFTWTGFYAGIQIGGFSSKTDMSIVGKGKSVLLSKDLLPKLSGFESGLYAGSNIDLGDNFIFNIDTDLIWSGQKYTKTIALGASDNVSVDNLVTRSRRSLRLENQLLGKSPKRKVQRTASAAPAAPAAPAPASSSSSSSSSSSSSSAAAAAAPAPAPAPAAPASVTASESAVARPSLTPTVSGTPGRPVGTTEASAVPGTGRLYLARSGDSEQSVSGTQPVLSAHRGTDQNAHSHRVNNPHGNPHGGSSAAGRSAQGEQTVNEKSASVYGIEEVKKVAASLGVDQGGRAETLTHTLKQNWAGATRLRIGFAADRIMPYVAGGIAYTQLQDIVSISLKEQDGEAVSRKNLTNETKTMIGYTLGGGIDFAMTDNVLLRAEYRYSGFGKKKFAKEKLEVNYKTNDFRIGVAYKF

SEQ ID NO: 19420 - protein, 406 aa, Bartonella henselae
MNIKTLLLCSTVAFIGISGAHAAPDIVEKPKSIKYLRACDAYGAGYFYIPGTETCMKLSGYVRASFKGGHDVDAKTNADLDQHKKTYDVSSRLALIFQAASETELGTLRSYARLTSDWVNGKSGAGGRLNAAYIRLGGFSVGLDDTIFSTWTSYGEVINDDLIAPAGNVRTNFVSYTFASNTGFAAIIGAELGNASDPIGPDKKYYYIDKSDQVSIVADNDLLSKQTKDYIPHILLGAQFVQGWGGVSTITVYDSHYKKWANKTRLDFKVNDDINVWVTGGYKTNVDYYTADEQNVLSRENTTIYAGWGGKWAAWTGVTYQITPEAKLNTQISYSAVKTFSASANIVYTLVPGFTITPEVSYIAWKDDRTFKGQQDSAQRNSTPNYTHALNGKNALQTMIRLQRSF

SEQ ID NO: 19421 - protein, 353 aa, Pasteurella multocida
MKKTAIALTIAALAAASVAQAAPQPNTFYVGAKAGWASFHDGLNQAKYLEAPEATFGFKRNSVTYGVFGGYQITDNFAVELGYDDFGRAKLRMAEKDQKAKDAAKHTNHGAHLSLKASYPVLDGLDIYARVGAALIRSDYKVYDHSDPAKLPQFKRTHSTQVSPVFAGGLEYAFMPELALRVEYQWVNNVGKVKDVLGERVDYRPDIGSVTAGLSYRFGQSVYVPEVVSKTFTLNSDVTFGFDKADLKPAAQNVLDGIYGEIAQLKSASVAVAGYTDRLGSDAYNLKLSQRRADTVANYLVAKGVAQNAISATGHGEANPVTGNKCDSVKGRKALIACLADDRRVEIAVKGNK

SEQ ID NO: 19422 - protein, 349 aa, Pasteurella multocida
MKKTAIALTIVALAVASVAQAAPQPNTFYVGAKAGWASFHDGLNQAKYLEAPEATFGFKRNSVTYGVFGEYQITDNFAVELGYDDFGRAKLRMAEKDQKAKDAAKHTNHGAHLSLKASYPVLDGLDIYARVGAALIRSDYKVYDHSDPAKLPQFKRTHSTQVSPVFAGGLEYAFMPELALRVEYQWVNNVGKVKDVLGERVDYRPDIGSVTAGFGQSVYVPEVVSKTFTLNSDVTFGFDKADLKPAAQNVLDGIYGEIAQLKSASVAVAGYTDRLGSDAYNLKLSQRRADTVANYLVAKGVAQNAISATGHGEANPVTGNKCDSVKGRKALIACLADDRRVEIAVKGNK

SEQ ID NO: 19423 - protein, 348 aa, Pasteurella multocida
MKKTAIALTIVALAVASVAQAAPQPNTFYVGAKAGWASFHDGLNQIEYVSKTSFGSKRNSVTYGVFGGYQITDNFAVELGYDDFGRAKVRANSKTTAFDAAKHTNHGTHLSLKASYPLLDGLDVYARVGAALIRSDYKLYAPLINKRLSPHFKITQVSPVFAGGLEYAFIPELTLRVEYQWVNNVCKFEYADGQYADFRPDIGSVTAGLSYRFGQSVYVPEVVSKTFTLNTDVTFGFDKADLKPAAQNVLDGIYGEIAQLKSASVAVAGYTDCLGSDAYNLKLSQRRADTVANYLVAKGVAQNAISATGHGEANPVTGNKCDSVKGRKALIACLADDRRVEIAVKGNK

SEQ ID NO: 19424 - protein, 353 aa, Pasteurella multocida
MKKTAIALTIAALAAASVAQAAPQPNTFYVGAKAGWASFHDGLNQAKYLEDADATFGLKRNSVTYGVFGGYQITDNFAVELGYDDFGRAKLRIAETDQKARDVAKHTNHGAHLSLKASYPVLDGLDVYARVGAALIRSDYKVYDHSDPAKLPQLKRTHSTQVSPVFAGGLEYAFMPELALRVEYQWVNNVGKLKDVDGNRVDYRPDIGSVTAGLSYRFGQSVYVPEVVSKTFTLNSDVTFGFDKADLKPAAQNVLDGIYGEIAQLKSASVAVAGYTDRLGSDAYNLKLSQRRADTVANYLVAKGVAQNAISATGHGEANPVTGNKCDSVKGRKALIACLADDRRVEIAVKGNK

SEQ ID NO: 19425 - protein, 351 aa, Pasteurella multocida
MKKTAIALTIAALAAASVAQAAPQPNTFYVGAKAGWASFHDSLNQFNDITEPATGFKRNSVTYGVFGGYQITDNFAVELGYDDFGRAKARATDPKTKETVDAAKHTNHGAHLSLKASYPVLDGLDVYARVGAALVRSDYKVYDKEPADLSFLKRTHSTQVSPVFAGGLEYAFMPELALRVEYQWLNNVGKLKDAKGERVDYRPDIGSVTAGLSYRFGQSVYVPEVVSKTFTLNSDVTFGFDKADLKPAAQNVLDGIYGEIAQLKSASVAVAGYTDRLGSDAYNLKLSQRRADTVANYLVAKGVAQNAISATGHGEANPVTGNKCDSVKGRKALIACLADDRRVEIAVKGNK

SEQ ID NO: 19426 - protein, 156 aa, Wolbachia endosymbiont
YYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARY

SEQ ID NO: 19427 - protein, 181 aa, Wolbachia endosymbiont
YYVRLQYNGEVLPFKTKIDGVAYKSGKDNNSPLKASFLAGGGAFGYKMDDIRVDVEGLYSQLSKDADVVSDDKAADSVTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVLYSTVGAE

SEQ ID NO: 19428 - protein, 193 aa, Wolbachia endosymbiont
SYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 19429 - protein, 181 aa, Wolbachia endosymbiont
SYYARLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVG

SEQ ID NO: 19430 - protein, 162 aa, Wolbachia endosymbiont
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYTGARYFGSYGA

SEQ ID NO: 19431 - protein, 196 aa, Wolbachia endosymbiont
SYYVRLQYNGEFLPLFTKIDGIDYKKGTDIYSPLKASFIAGGGAFGYKMDDIRVDVEGVYSYLNKNDVKDVVFTPADTIANSLTAISGLVNVYYDIAIEDMPITPYVGVGVGAAYISTPLATAVNSQNGKFAFAGQARAGVSYDITPEIKLYAGARYFGSYGAHFDGEKADPKDAAKKVADKGAYKILYSTVGAEA

SEQ ID NO: 19432 - protein, 199 aa, Enterobacteria phage BP-4795
MRKLYAAILSAAICLAVSGAPAWASEHQSTLSAEYLHASTNVPGSDDLNGINVKYRYEFTDTLGMVTSFSYAGDRNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPIESVAIDIAYEGSGSGDWRTDGFIVGVGYKF

SEQ ID NO: 19433 - protein, 1784 aa, Chlamydia trachomatis
MKFLSATAVFAAALSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDVLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKECGGAIFTDLASIPTTDTPESSTPSSSSPASTPEVVASAKINRFFASTAEPAAPSLTEAESDQTDQTETSDTNGDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSASTNLKGSQGDTADTGTGDVNNESQDTSDTGNAESGEQLQDSTQSNEENALPNSNIDQSNENTDESSDSHTEEITDESVSSSSESGSSTPQDGGAASSGAPSGDQSISANACLAKSYAASTDSSPVSNSSGLEEPVTSSSDSDVTASSDNPDSSSSGDSAGDSEELTETEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTPTLSTTIEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIVDTTTSGSGGTPSTDSESNQNSDDTEEQNNNDASNQGESANGSSSPAVAVAHTSRTRNFAAAATATPTTTPTATTTTSNQVILGGEIKLIDPNGTFFQNPALRSDQQISLLVLPTDSSKMQAQKIVLTGNIAPQKGYTGTLTLDPDQLQNGTISVLWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 19434 - protein, 1774 aa, Chlamydia trachomatis
MKFLSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLTECVDSLSEDTLDSTPETEQTESNGNQDGSSETKDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMTF

SEQ ID NO: 19435 - protein, 1774 aa, Chlamydia trachomatis
MKFLSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNISVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETKDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSNVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMIF

SEQ ID NO: 19436 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGDQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGNSRRTVTFSGNTVSSQSTTGQVAGGAIYSPTVTIATPVVFSKNSATNNANNATDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPLWTLYGSYTIEADAHTLAHMMNCGARMTF

SEQ ID NO: 19437 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 19438 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGNQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPLWTLYGSYTIEADAHTLAHMMNCGARMTF

SEQ ID NO: 19439 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDFLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDLTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 19440 - protein, 1460 aa, Chlamydia trachomatis
MKFLSATAVFAAALPSITSASSVESQIETKDLNSSRTGSSSSQSFTEIIPENGAEYRVSGDVSFSDFSNIPEEAETLAISHKEQPNNEVVLSEENHQASFQDSAQNQTENASEGNSPNSENTNQSSTTETESITTDEQVQNDNESAASVPTTVETATAMRLPSYHLQTESLVEGATEEDQNQPNSQNTSSGGGAFYNSQQGPLSFINDPDKDSSLTLSKIRVIGEGGAIYSKGPLSITGLKKLALKENLSQKAGGAICAESTISISSVDSIIFSKNTVTPPAANKPELPNDPSGSNGNDGSDDSNSSGNTDSNESNPNNSASNNTGSENELSSSTPSAQLPNPATPFLSSVSTNSQPIDTEPENAWHAESGSGGAIYSKGKLSIASSKEVVFDHNSATKNGGAIFGEEEIALEKIASLKFDSNTTGEKGGAIHAKTVTLSDIKNTLIFVNNTAKTPEENSLKSSQLNNQNPSEEEHQDTSEGEESQSLETSPITNQDSASSHVAIFRSIAASSSQSNSENIPNADGSTSAGGDAGSSSQPSTPGSDSSINHVIGGGAIYGEAVKIENLSGYGTFSNNNAVDHQISGSTSDVLGGAIYAKTSLTIDSGNSSGTITFSENTTSSKSTTGQVAGGAIFSPSVTITTPVTFSKNSAINATTSSKKDTFGGAIGAISTVSLSKGARFSENIADLGSAIGLVPTTQDAETVQLTTGSYYFEKNKALKRATVYAPIVSIKAHTATFDQNISAEEGSAIYFTKEATIESLGSVLFTGNLVTPIQSTTVLTSGNTSKYGAAIFGQIANASGSQTDNLPLKLIASGGNISFRNNEYRPDATNTGQSTFCSIAGDIKLTMQAAEGKVISFFDAIRTSTKKTGTLASAYDTLDINKSNDSGSINSAFTGTIMFSSELHENKSYIPQNVVLHSGSLILKANTELHVLSFDQKEGSSLIMEPGSVLSNQDIADGSLVVNSLTIDLSSVGRNSASGDNIFMPPELRIVDTSTNSGNSSSTPPSSNTPPNSTPTAQAPISKNFAATTTTPTTPPTTGNIVFLNGVIKLIDPNGTFFQNPALGSDQKISLLVLPSDQTKLQAQKVVLTGDISPKKGYTGTLTLDPQQLQNGVIQALWTFKSYRQWAYIPRDNHFYANSILGSQMSMATVKQGLINDKLNLARFDEVAYNNLWISGLGTMLSQRGGQRSEEMTYYSRGASVALDAKPTQDLIIGAAFSKMIGRSKSLKLERNYTHKGSEYSYQASVYGGSPFYLTINKEAGRSLPLLLQGVISYGYIKHDTVTHYPTIRELNKGEWEDLGWLTALRVSSILKTPKQGDSKRITVYGEVEYSSIRQKQFTETEYDPRYFSNCTYRNLAVPVGLALEGEFKGNDILMYNRFSVAYMPSIYRNSPVCKYQVLSSGEGGEIVCGVPTRNSSRAEYSTQLYLGPLWTLYGSYTLEADAHTLANMINCGARMTF

SEQ ID NO: 19441 - protein, 1784 aa, Chlamydia trachomatis
MKFMSATAVFAAALSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDPTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGFEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICRVPTRNSARGEYSTQLYLGPLWTLYGSYTIEADAHTLAHMMNCGARMTF

SEQ ID NO: 19442 - protein, 1770 aa, Chlamydia trachomatis
MKFMSATAVFAAALSSVTEASSIQDQIKNTDCNVSKLGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGDQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNTTDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPLWTLYGSYTIEADAHTLAHMMNCGARMTF

SEQ ID NO: 19443 - protein, 1784 aa, Chlamydia trachomatis
MKFMSATAVFAAALSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDPTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSRSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLSLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 19444 - protein, 1784 aa, Chlamydia trachomatis
MKFMSATAVFAAALSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDPTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 19445 - protein, 2886 aa, Vibrio mimicus
MRDILGFVSIFGRSEFPSRGAGQAKSSIAIPRIAPVRLAALLAAGLAGGALAASDASAQFFVTASSATYETGDEPRIDPGENAFISHTIWGNGSETLTGFTFTVDYGAVLAGARLDLGSISTFNCGTPEVSSNGLGLVSVSSVDPVGQCLIRYSVSIPASTPASSASNTYVASPSNITGTGSTSGAIDRDWDDFNIEVGLDTAAPSPVITGPGGPVDAPFNIDISFLEFGLYSETIDGFAVSDLVVANATVAFADLGGDAAQTGDGVSSVTIEVTPTGAGTPITVQLPAATVVDQSGNDNTASSVYSVVYDVDGDPRDDVDFTAVFVANPVDPLDQATLRFTITNNSADDLTAGQFDLDIDASSSTDFVGVAPAALPCGASSTATLFSANTFVRFSSMELLSGGSCSFDLPIEIDDALAAGNYGFSTTALNYNLGVDSYTDTQAADVLTVDFAEGAGGTIQFTKTFADDEVAPGDTIDVEFFIAATGAFTTTGIAFTDDLDAMLSSATATGTPLSDVCGAGSSLTGTSVLSLTGGNLASEGSCTFTVTLSVPAGAADGTYTNTTGNLTATRSDDGAVTIDPASDSFDVNVPGGTPPSVTISGDTDDLGVAFSRDIAVRFSEPITDLVAGDFALTNATSDGLSGSGSDWTLTVSPVGTGAVAVFLPAAVVQDAEGDDNALSNTFTFDAVAGDPEIDIEGNSVSIVDGDVSPSLADHTQFVPTDVTAGTSSRTFTIENLGTDTLTITNVALSGANMADFSITSAPAASVTPGATTTFTIGFDPSVAASRAATVTVTSDDADEASYDFAIAGVGTVLPEIRVAGAGNTINIAYADASPSVADGTDFGSLAADSGAASATFTINNDGGAALTLGSEAVSISGSNDFSVTAQPATTVAAGDSTTFTILFDPAIAGASNATVSIANDDGDEAPFLFGIMGVGTDNIAPSGHTVAFDAALYGASNYAAASFTIDDPETLTNYSYTISSDGGGANVTGTGNIPIPAAGDPSEFQVSGVDVSGLNEGTLTVSVVLTDASGNAATAVTNTVALDLTGPTPSISTGSADPVSGAFSLTVDFGEAVTGFLVGDISVGNGALSAFSDNGGGDFSATVTPSADGSVTVDVGSGVAQDAAGNDNVAATQFVIENDETPPTVALSTGSADPVSGAFAITATFSEGVNGFGLGDFSVGNGAASNFAATSATVYTATITPAADGTVTVDISGAVAQDDAGNNNAAATQFSIENDETVPTVALTSGAADPIAGTFTITATFSEDVTSFAAGDFAVGNGAVSNFSATSATVYTATITPAADGTVTVDVAGGAAQDSAGNDSTAATQFSIENDETVPTVVLTTGSVDPVSGAFTITATFSEGVNGFGLGDFSVGNGGASNFAAMSVTVYTATITPASDGSVTVDVGANAAQDGAGNGNAAATQFSIENDETLPTVALSTGSADPVSGTFTITATFSESVTGFAVGDFSVGNGSASDFAATSATVYTATITPAADGTVTVDVAGAVAQDAAGNDNSAATQFSIENDETLSTVTLTTGSSDPVSGAFTITATFSEAVTGFAVDDFAVGNGSVSNFLATSTTVYTATITPATDGTVTVDVAAGAAHDGAGNGNAAASQFSIENDETGPAVVLTTGSADPVSGAFTITATFSESVTGFGLGDLSVGNGAASNFSATSATAYTATITPAGDGSVTIDVAAGAAQDSAGNASLAATQFTIENDETAPTVALSTGSADPVSGAFTITATFSENVTGLVLADFGVGNGTASDFSATSATVYTATITPAADGTVTVDVAGAVAQDAAGNNNTAAPQFSIDNDETVPTVALTTGSSDPVSGAFAITATFSEAVTGFAVDDLSVGNGSASNFSATSTTVYTATITPTIDGTVTVDVAGGAAQDSAGNDSTAATQFSIENDETGPAVVLTTGSADPVSGAFIITATFSEAVTGLALGDFSVGNGAASSFSAISANVYTATITPVADGTVTVNVAGNAAQDGAGNGNVAAAQFSIENDETAPMVSLAGPAIDQVGTFTVSVDFSEDVTGLVLADFTVGNGSAANLAGSGNSYTVDVTPATSGSVTVNLAANSVQDAAGNANVAATQFAVDADLSLPGLDSLAVSDADLRVEDVGRSFTLTATFSEAMDPGQAPVFTFSTDLSATLSLDSGAFSAGDTVYTATYSVTDGGQVAADVDVTVSAAADAAGNALPDSPVADLLSVEMRRGSLFVAVAITGATDGSFDFSGDLGDFSVATVSQAGVTSFNDLVEGSYTFTAAAVDGFNLDAIGCTGGTSVLDSATGSATVTLGPTDSVTCEFTQIAEPDVDETVIPDVTIELPTLTDDPTSATSSFDLQNVGGEAFYFTASTDQPWLVIDPTSGSIPATGSLEFTVSFTAAVLDLAPGSYTATITVVEVSPPSQRGGGRKANALETLEIPVNIAIEPRLGDLTIITRTTAPEEGEGSFSYTSTLTALDGQTVLTAGGSASTTVNDVLRGSYVLTQLASEGWDLASLSCTGDLDGGNIYDLASGQVTIDLDAEENMVCTFANRRNEDYIRGVTLSAIRNFMATRADLILTNSPRLAGRMRSDRSSATPNSFAADFRDGRLNAQMSTSLGALRQAAEASQPQQPGAERFSLNGRTGLSSLDVWMQASVASVSDNRAGLGSDADFSIVHVGTDIMVSANVLAGVLLQYDQTDMTTGDWNSAVEGNGWMAGPYMVARISDRTYLDLRAAWGRSDNSVNPIGTYTDSFETDRWLIEANLAGDILHGGWRVTPGVGLAYFHESQDSYTDTLGIFIPGQTITIGRLSAGPEVAYRFENAAGGYVEPYLNVTALYDYDDADVFNAAGTLQTLGHLRGDARLGLTVEMANGGRISGEVSMIGLGEGDFEANNAMIRIRLPLSMH

SEQ ID NO: 19446 - protein, 152 aa, Escherichia coli B
DGVTGAKKKNADTNVTTDLYKASFMAGGSAFGYKMDDIRVDIEGLYSQLSRDTFETAPAPAIADNLNALSGLVNVYYDVVIEDMPVIPYVGIGVGAAYLSNPLAIKVTGDKEYGFGFAYQAKAGVSYDVTPEVKLLRGARYFGSYGAKFDKP

SEQ ID NO: 19447 - protein, 341 aa, Haemophilus gallinarum
MKKTAIALAIAGLTAASVAQAAPQANTFYAGAKAGWASFHDGLNQFENSQNAYGTLRNSVTYGVFGGYQITDNFAVELGYDDFGRAKFRQDGETVIKHTNHGAHLSLKASYPVLEGLDVYARVGAALIRSDYKPTKRAAPNETHEHSLKVSPVFAGGLEYNLPSLPELALRVEYQWVNKVGRDGSRVDYTPSIGSVTAGLSYRFGQSAPVVEPKVVAKTFALNSDVTFAFGKANLRPEAQNVLDGIYGEIAQLKSVQVDLAGYTDRIGSEAANLKLSQRRADTVANYLVSKGVAQEVISSTGYGEANPVTGAKCDAVKGRKALIACLADDRRVEISVKGNE

SEQ ID NO: 19448 - protein, 1254 aa, Uncultured gamma proteobacterium eBACHOT4E07
MYIQFREPISTSPAQPDAGHRHLFSCAPAAAINPITLAIIVAFSALVLPQTARASCNSSGVGTYVCEGENHAGIILSGTDIAVETQPGFSITEPGGADPALSLIGSGVISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSTTYLTVVGQINASNGEGITLISQATDGSTLVNIDVNNIASEYDAIYLHNSVTGADNGTSTIDLITRGALVSQQGYGINIETNTADTYVTVGGLVHGGNGTAIGIHRLENVQTSATLELQSGYALEGVTQALVFTGSYAEINDAALDLANSHLVLGGTGDAVFDLTRIDNREEAILDGDPNRITGFGTLTKTNNSIWTLTGSNMADGDANAFLSANIGGGILVLDNATLGLTPATTILNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGHGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 19449 - protein, 193 aa, Pasteurella multocida
  misc_feature (75)..(75): Xaa can be any naturally occurring amino acid
  misc_feature (190)..(190): Xaa can be any naturally occurring amino acid
  misc_feature (192)..(192): Xaa can be any naturally occurring amino acid
VSDEETSYYVRLQYNGEILPLYTKVDGITNATGKEKDSPLTRSFIAGGGAFGYKMDDIRVDVEGLYSQLAKDATXVSDNKAADSVTAFSGLVNVYYDIAIEDMPITPYIGVGVGAAYISNPSKADAVKEQKGFGFAYQAKAGVSYDVTPEIKLFAGARYFGSYGASFNKETVSATKEINVLYSAVGAEAXVXL

SEQ ID NO: 19450 - protein, 353 aa, Pasteurella multocida
MKKTIVALAVAAVAATSANAATVYNQDGTKVDVNGSLRLILKKEKNERGDLVDNGSRVSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLSSGEKAINFKSAEFNGFTFGGAYVFSADADKQALRDGRGFVVAGLYNRKMGDVGFAFEAGYSQKYVKQEVEQNPPAAQKVFKDEKEKAFMVGAELSYAGLALGVDYAQSKVTNVDGKKRALEVGLNYDLNDRAKVYTDFIWEKEGPKGDVTRNRTVAVGFGYKLHKQVETFVEAAWGREKDSDGVTTKNNVVGTGLRVHF

SEQ ID NO: 19451 - protein, 565 aa, Escherichia coli
MISKKLSIVHCQLSIILAFLPLSVAYAQQDSTLNRTVVVENEYNPNIMDASKINVLPKVEEPAVMKKGIEYATALRPVLAWTYESMSPITREWAMNRAKRGYVRAGYGNYGNVDFKAGYLWDITGKDRLKVGVSLDGMNGKLKHWNAEDWKSRFYSTEFRLDYSHDFSKVTLNLGGGLQSQVFNYMPDSEVHTASARAADKQHHTLGDFHIGVSSRDESLPLQFTLQTGLKYFGIKYPLDYSDNASTGKEKIVHTEGDVWGKLDNEQRVGIRFEMDNLFYSSDSLMGNYTSLGLNPYYMLESDDWRVRVGAHVDWQSGEDSGIDVSPDVKAEYLFSDSYVLYLHALGGRELNDYRRLNAFSPYWSLNARMPSTYVPLNATLGFKASPVNGLWFNIFGGYRISKDELFCNLVDADGYYFTHFLQDKAKTAYGGAELKYGYKDWFDASLKGTFYSWKTDNENEELYLMTKPKFELNFYAEAKVFEGLKVYLGYEYVQRKEYVIEEGNSSRDFGLGNISNLSVGASYTFLKDLSVFGRVNNLLNKQYYYEYGYPAEKLNVLAGLSLVF

SEQ ID NO: 19452 - protein, 252 aa, Haemophilus influenzae
PIRDSIGRRLRLFGSLSKTYPLPCGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLAVAAQLDVSEHAHKTKNSTTDIAATASYCFRNAVPRISYADGSI

SEQ ID NO: 19453 - protein, 370 aa, Haemophilus influenzae
SPSFDSSAYAAPRALHNPDWYENDYEEIPLDALEDEDVSESVDTSDKQPQDNTELHEKVEAVSLQPRAAQPRTQAAAQADAVSTNTNSALSDAMASTQSILLDTGAYLTRHIAQKSRADAEKNSVWMSNTGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPSAGIRYSRLSSADYKLGDDSVKVSSMAVKTLTAGLDFAYRFKVGNLTVKPLLSAAYFANYGKGGVNVGGKSFAYKADNQQQYSAGAALLYRNVTLNVNGSITKGKQLEKQKSGQIKIQIRF

SEQ ID NO: 19454 - protein, 299 aa, Haemophilus influenzae
QTYRTVKHTDGKVTEVKTGSEIADFGSKIGFKGQEDLGNGLKAIWQLEQSASIAGTNSGWGNKQSFIGLKGGFGTVRAGNLNSILKSTGDNVNAWESGKATEDVLQVSKISAPEHPYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLADASNSHNSQTEVAATVAYRFGNVTPRVSYAHGFKGNVAKADEDNTYDQVVVGAEYDFSKRTSALVSAGWLQEGKGANKAVSTAST

SEQ ID NO: 19455 - protein, 153 aa, Collimonas fungivorans
TGLKKNTADTTDTTDLYTASFIAGGGAFGYKMDDIRVDVEGIYSQLNQDTTVTGTSVPAGGIAKNLTAISGLVNVYYDIAIEDMPITPYVGVGVGAAYVSNPLAKKADDNKASGFGVAYQAKAGVSYDVTPEIKLYAGARYFGSYGATFGQGT

SEQ ID NO: 19456 - protein, 344 aa, Collimonas fungivorans
MKKSLIALAVLAASGAAMAQSSVTMFGIVDTGVTYVNHANAAGDSLYGLTTSGNATSRLGFRGTEDLGGGLKAGFWLEGEIFGDNGNASGFNFQRRSTLSLAGNFGEVRLGRELVPTYSKASSYDLFGQTGIGQFMGWSNWIGSATADANDIRSSNMISYYTPNFGGFSGGVGYGFDEKTSGKEARYAGITGSYDNGPLSVTMAYDRRDLAGSVSRDTLSVGGSYDLNVVKLSTILQQSKYEAPGVADAKFNAYSLGASAPVGAGEFKLQYALYDQKAIDSKAHQLSLGYVHNLSKRTALYGTVAYLKNKDSSNLGLATKGLTVAGPGAGNNQTGVQVGIRHAF

SEQ ID NO: 19457 - protein, 347 aa, Collimonas fungivorans
MKKSLIALTLGALPVAATADVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQSYSIPSLFVEKLQVHRLVGGYDHDALYASVAVQQQDAKLTWRNNNSHNSQTEVAATAAYRFGNLTPRVSYAHGFKGSVHSADYDNTYDQVVVGAEYDFSKRTSALVSAGWLQEGKGAEKIVLTASAVVLRHKF

SEQ ID NO: 19458 - protein, 318 aa, Neisseria meningitidis
MKKSLIALTLAALPVAAMADVTLYGTIKAGVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEDLNIEKYQIHRLVSGYDNDALYASVAVQQQDAKLALPNDNSHNSQTEVAATLAYRFGNVTPRVSYAHGFKGSFDDADLSNDYDQVVVGAEYDFSKRTSALVSAGWLQEGKGENK

SEQ ID NO: 19459 - protein, 315 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADLSNDYDQVVVGAEYDFSKRTSALVSAGWLQEGKGENK

SEQ ID NO: 19460 - protein, 331 aa, Neisseria meningitidis
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRHKF

SEQ ID NO: 19461 - protein, 331 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHRVQEDINIEKYQIHRLVSGYDNDALHASVAVQQQDAKLVEENYSHNSQTEVAATLAYRFGNVTPRVSYAHGFRGLVDSADYTNDYDQVVVGAEYDFSKRTSALVSAGWLQEGKGKNKFVSTAGGVGLRHKF

SEQ ID NO: 19462 - protein, 315 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDATNYNNDYDQVVVGAEYDFSKRTSALVSAGWLQEGKGESK

SEQ ID NO: 19463 - protein, 332 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLALPNDNSHNSQTEVAATLAYRFGNVTPRVSYAHGFKGSFDDADLSNDYDQVVVGAEYDFSKRTSALVSAGWLQEGKGENKFVSTAGGVGLRHKF

SEQ ID NO: 19464 - protein, 329 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGENKFVSTAGGVGLRHKF

SEQ ID NO: 19465 - protein, 329 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDDVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGGVGLRHKF

SEQ ID NO: 19466 - protein, 316 aa, Neisseria meningitidis
MKKSLIALTLAALPVAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDATNYNNDYDQVVVGAEYDFSKRTSALVSAGWLQEGKGESK

SEQ ID NO: 19467 - protein, 327 aa, Neisseria meningitidis
MKKSLIALTLAALPVAAMADVTLYGTIKAGVENSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 19468 - protein, 316 aa, Neisseria meningitidis
MKKSLIALTLAALPVAAMADVTLYGTIKAGVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENK

SEQ ID NO: 19469 - protein, 317 aa, Neisseria meningitidis
MKKSLIALTLAALPVAAMADVTLYGTIKAGVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDNVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKF

SEQ ID NO: 19470 - protein, 317 aa, Neisseria meningitidis
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWFQEGKGENKF

SEQ ID NO: 19471 - protein, 708 aa, Helicobacter pylori
MKKTLLLSLSLSLSFLLHAEDDGFYTSVGYQIGEAAQMVKNTKGIQELSDNYEKLNNLLNNYSTLNTLIKLSADPSAINDARDNLGSSSRNLLDVKTNSPAYQAVLLALNAAVGLWQVTSYAFTACGPGSNENANGGIQTFNNVPGQDTTTITCNSYYEPGHGGPISTANYAKINQAYQIIQKALTANGANGDGVPVLSNTTTKLDFTINGDKRTGGKPNTPEKFPWSDGKYIHTQWINTIVTPTETNINTENNAQELLKQASIIITTLNEACPNFQNGGRSYWQGISGNGTMCGMFKNEISAIQGMIANAQEAVAQSKIVSENAQNQNNLDTGKPFNPYTDASFAQSMLKNAQAQAEILNQAEQVVKNFEKIPTAFVSDSLGVCYEVQGGERRGTNPGQVTSNTWGAGCAYVKQTITNLDNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVNSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVYLNYVFAY

SEQ ID NO: 19472 - protein, 741 aa, Helicobacter pylori
MKKHILSLALGSLLVSTLSAEDDGFYMSAGYQIGEAAQMVTNTKGIQQLSDNYENLSKLLTRYSTLNTLIQLSADPSAINLARENLGASAKNLIGDTKTSPAYQAVLLAINAAVGFWNVLGYATQCGGNANGTKSTSSTTIFNNEPGYRSTSITCSLNGYKPGFYGPLGIDNMKKINEAYQILQTALKKGLPALKENSGTINVKYNYTCSGEGNNNCSQEATGVNDQNGGSITKTQTIDGKTVTTMISSKVVNSTAPGNTSGVSYTEITNQLNGVPDSAQALLAQASTLINTINSACPYYSVTNKNGGPQMEPATGKLCGFTDEISAIQKMITDAQELVNQTSAINTNEQTTQVGGSGGKPFNPFTDASFAQGMLANASAQAKMLNLAHQVGQAINPDNLSGTFQNFVKNFLATCNNPSTAGTGGTQGSAPGTVTTQTFASGCAYVEQTITNLNNSIAHFGTQEQQIQQAENIADTLVNFKSRYSELGNTYNSITTALSKVPNAQSLQNAVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 19473 - protein, 740 aa, Helicobacter pylori
MKKHILSLALGSLLVSALSAEDDGFYTSVGYQIGEAAQMVTNTKGIQELSDRYESLNNLLTRYSTLNTLIKLSADPSAVSGAINNLNAGATGLLKEKTNSPAYQAVSLALNAAVGLWNTIGYAVMCGNGNGTEGGPGSVVFSNEPGQKSTQITCNRYEATGPGKSMSIDEFKKLNEAYQIIQQALKNQHGFPELGGNSTKVTVEYEYECKQNNNGNNINDGVNQFCRAKNGSSSSGSNDTSTQTTTQDGVTITTTYSNNKATVNFSITNNAQELLNQAANIMQVLNTQCPLVRSTHDENNAGNGNPWGLSTSGNACQIFQQEFSQVTSMIKNAQEIVAQSQIANANQKAEIANPSNFNPFTDASFAQSMLKNARAQAEMFNLAEQVKKNLEVMQNNNNVNAELSGFGKGMTNFVSAFLASCRNGGGTLPNEGVTSNTWGAGCAYVGETISALNNSIAHFGTQEQQIQQAENIADTLVNFKSRYSELGNTYNSITTALSSIPNGSSLQNVVSKKNNPYSPQGIETNYYLNQNSYNQVQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 19474 - protein, 732 aa, Helicobacter pylori
MKKHILSLTLGSLLVSTLSAEDDGFYMSAGYQIGEAAQMVKNTKGIQDLSDRYESLNNLLTRYSTLNTLIKLSADPSAINGVRNDLGASAKNLIGDKANSPAYQAVLLAINAAVGFWNVVGYVTQCGGNANGTKSTSSTTIFNNEPGYRSTSITCSLNGYTPGYYGPMSIENFKKLNEAYQILQTALKQGLPALKENNGTVNVTYTYTCSGRGNDNCNALVGNGSGEDKRNGGSKTETQTIDGKSVTTTISSKVVQPNHGAAYTEITNKLDSVPDSAQALLAQASTLINTINSACPFFHAPNNQANGPKWEWPSNKLCGAFSQEISAIQKMITDAQELVNQTSVITSNEQSAQVGGNKPFNPFTDASFAQGMLANAQAQAKMLNLAEQVGQAINPERLTGTFQNFVKGFLATCNNPSTAGTGGTQGSPSGTVTTQTFASGCAYVEQTLTNLNNDIAHFGTRAQQIQQAENIADTLVNFKSRYNELGNTYNSITTALSSIPNAQSLQNAVSKKNNPYSPQGIETNYYLNQNTYNQIQTINQELGRNPFRKMGIISSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVY

SEQ ID NO: 19475 - protein, 737 aa, Helicobacter pylori
MKKHILSLTLGSLLVSTLSAEDDGFYMSAGYQIGEAAQMVKNTKGIQDLSDRYESLNNLLTRYSTLNTLIKLSADPSAINGVRNDLGASAKNLIGDKANSPAYQAVLLAINAAVGFWNVVGYVTQCGGNANGTVSTSSTTIFNNEPGYRSTSITCSLNGYKPGYYGPMSIENFKKLNEAYQILQTALKQGLPALKENNGKVNVTYTYTCSGGGNNNCSTKEATGVNEQLGGTKTETQTIDGKSVSTTISSKVVQSTNGAAYTEITNQLSGVPDSAQALLAQASTLINTINEACPFFHAPNNQAGGPKWEWPSNKLCGAFSQEISAIQKMITDAQELVNQTSVINSNEQSAQVGGNKPFNPFTDASFAQGMLANAQAQAKMLNLAESVGQAINPKRLTGTFKNFVTGFLATCNNLSTAGTSGTQGSPSGTVTTQTFASGCAYVEQTLTNLDNDIAHFGTRAQQIQQAADIADTLVNFKSRYNELGNTYNSITTALSSIPNAQSLQNAVSKKNNPYSPQGIETNYYLNQNTYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHVAQHGIELGVKIPTINTNYYSFMGAELKYRRLYSVYLNYVFAY

SEQ ID NO: 19476 - protein, 187 aa, Wolbachia endosymbiont
SYYIRLQYNSEFSPLNTKVDGITGAQKDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGA

SEQ ID NO: 19477 - protein, 187 aa, Wolbachia endosymbiont
SYYIRLQYNGKILPLFTKVDGITYKKGNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 19478 - protein, 196 aa, Wolbachia endosymbiont
SYYIRLQYNSEFSPLNTKVDGITGAQKDSKDTNDLYKPSFMAGGSAFGYRMDDIRVDIEGLYSQLSKGALSRVPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAYKVLYSTIG

SEQ ID NO: 19479 - protein, 205 aa, Wolbachia endosymbiont
SYYIRLQYNSEFSPLNTKVDGITGAQKDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAYKVLYSTIGAEAGVAFNF

SEQ ID NO: 19480 - protein, 187 aa, Wolbachia endosymbiont
SYYIRCQYTGEILPLFTKVDGITYKKDNSDYSPLKASFLAGGGAFGYKMDDIRVDVEGVYSYLNKNNATDAKFTPDTIADSVTAISGLVNVYYDIAIEDMPITPYVGVGVGAAYISTPLKDAVNDQKSKFGFAGQVKAGVSYDVTPEVKLYAGARYFGSYGTNFDKSGGEKDKGGHTVPYSTVGAEA

SEQ ID NO: 19481 - protein, 207 aa, Wolbachia endosymbiont
GPISDEETSYYVRLQYNGEILPLFTKIDGIQKTKGKEKGSPLKASFVAGGGAFGYKMDDIRVDVEGLYSWLNKDADVVGDTVADNLTAISGLVNVYYDVAIEDMPITPYIGVGIGAAYISTPLKTAVNEQNSKFGFAGQVKAGVSYDVTPEIKLYAGARYFGSYGAHFDKSEEVDKAVGGKETKVTKDAYKVLYSTVGAEAGVAFNF

SEQ ID NO: 19482 - protein, 147 aa, Wolbachia endosymbiont
GPISDEETSYCVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKGQKGFGFAYQAKAG

SEQ ID NO: 19483 - protein, 201 aa, Wolbachia endosymbiont
FGPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEAGVAFNF

SEQ ID NO: 19484 - protein, 233 aa, Wolbachia endosymbiont
FFSSLLFSSAAQAASEDNGRGPYVQADLNYAYEHITHDYPADNAKIFDDYRDIKTRSTHPRLSVGYDFGNWRIALDYARYNKWKHGKHIHAENTKKVKNGTEVKTIADHTDKGTFKAESNYGISAIYDFDTGTRFKPYAGVRVGLGKIRHSIAVEDKGEIIIANISATGGLKDAHPPVHESHSIRRVGFGAVAGVGIDITPNLTLDTGYRYHYWGHLENTRFKTHEASLGMRY

SEQ ID NO: 19485 - protein, 202 aa, Wolbachia endosymbiont
GPISDEETIYYIRLQYNGEFLPLFTKVDGIEYKKGTESHNPLKASFIAGGGAFGYKMDDIRVDVEGVHSYLNKNDVTGATFTPTDAIADSLTAISGLVNVYYDIAIEDMPITPYIGAGIGAAYLSTPLETAVNGQNSKFGFAGQVKAGISYDVTPEVKFYAGARYFGSYGANFDTSTGGKGKGGHTVLYSTVGAEAGVAFNF

SEQ ID NO: 19486 - protein, 260 aa, Wolbachia endosymbiont
IQPPKTFSSLLFSSLLFSSAAQAASEDGSRSPYYVQADLAYAAERITHNYPEPTGADKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPKGGTPAGGPVIKTDPSKPPYHESHSISSLGLGVIAGVGFDITPKLTLDTGYRYHNWGRLENTRFKTHEASLGMRYRF

SEQ ID NO: 19487 - protein, 200 aa, Wolbachia endosymbiont
GPISDEESSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 19488 - protein, 203 aa, Wolbachia endosymbiont
GPISDEETSYYVRLQYNGEILPLFTKIDGATGAKKKNADASTTTDLYKASFMAGGGAFGYKMDGIRVDIEGLYSQLSKDTLEKAPDPAIADSLTAISGLVNVYYDIAIEDMPITPYIGVGVGAAYVSNPLATKVTDDKASGFGVAYQAKAGASYDVTPEIKLYAGARYFGSYGANFGKATKGDAGIKVLYSTVGAEAGVAFNF

SEQ ID NO: 19489 - protein, 202 aa, Wolbachia endosymbiont
GPISDEETIYYIRLQYNGEFLPLFTKVDGIEYKKGTESHNPLKASFIAGGGAFGYKMDDIRVDVEGVYSYLNKNDVTGATFTPTDAIADSLTAISGLVNVYYDIAIEDMPITPYIGAGIGAAYLSTPLKTAVNGQNSKFGFAGQVKAGISYDVTPEVKFYAGARYFGSYGANFDTSTGGKGKGGHTVLYSTVGAEAGVAFNF

SEQ ID NO: 19490 - protein, 196 aa, Wolbachia endosymbiont
GEFLPLFTKVDGITYKKDRSDYSPLKLSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNFYQA

SEQ ID NO: 19491 - protein, 197 aa, Wolbachia endosymbiont
GPISDEETSYYVRLQYNGEILPLFTEVDGIEYKKGTENHTPLKASFIAGGGAFGYKMDNIRVDVEGLYSQLNKNAVTGAAFNPDTVADSLTAFSGLVNVYYDIAIEDMPITPYIGVGVGAAYISNPSKVDAVKDQRGFGFAYQAKAGVSYDVTPEIKLYAGARYFGSYGANFDKTAKDDAGIKGVLYSTVGAEAGVA

SEQ ID NO: 19492 - protein, 197 aa, Wolbachia endosymbiont
GPISDEETSYYVRLQYNGEILPFKTKITGITHKSGKDEDSPLKASFLAGGGAFGYKMDDIRVDVEGLYSQLSKDGDVADNPAIAESLTAFSGLVNVYYDVAIEDMPVTPYIGVGVGTAYVSNPLATKVTDDKASGFAFAYQAKAGVSYDVTPEIKLYAGARYFGSYGANFGKTAKDDAGIKVLYSTVGAEAGVAFNF

SEQ ID NO: 19493 - protein, 198 aa, Wolbachia endosymbiont
GPISDEETSYYVRLQYNGEVLPLKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEAGVAFNF

SEQ ID NO: 19494 - protein, 199 aa, Wolbachia endosymbiont
  misc_feature (198)..(198): Xaa can be any naturally occurring amino acid
GPISDEETSYYVRLQYNGEILPLFTKIDGITNAKGREKDSPLKASFIAGGGAFGYKMDDIRVDVEGLYSQLSKDATIINTSEANVADSLTAFSGLVNVYYDIAIEDMPITPYVGVGVGAAYISNPSKVDVVKDQKGFGFAYQAKAGVSYDVTPEIKLYAGARYFGSYGASFNKVTVSTTKEINVLYSAVGAEAGVAFXF

SEQ ID NO: 19495 - protein, 201 aa, Wolbachia endosymbiont
GPISDEETIYYIRLQYNGEFLPLFTKVDGIEYKKGTESHNPLKASFIAGGGAFGYKMDDIRVDVEGVYSYLNKNDVTGATFTPTDAIADSLTAIPGLVNVYYDVAIEDMPITPYVGVGVGAAYISTPLATAVSSQNGKFAFAGQTRAGVSYDVTPEVKLYAGAHYFGSYGANFDKTDKDGKEELKVFYSIVGAEAGVAFNL

SEQ ID NO: 19496 - protein, 202 aa, Wolbachia endosymbiont
GPISDEETSYYVRLQYNGEILPLFTKVDGIAYKKDNSDYSPLKASFIAGGGAFGYKMDDIRVDVEGVYSYLNKNDVTGAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 19497 - protein, 282 aa, Anaplasma marginale
MNYRELFTGGLSAATVCACSLLVSGAVVASPMSHEVASEGEVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 19498 - protein, 282 aa, Anaplasma marginale
MNYRELFTGGLSAATVCACSLLVSGAVVASPMSHEVASEGGVLGGSFYVGAAYSPAFPSVTSFDMRESSKETSYVRGYGKSIATIDVSVPANFSKSGYNFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 19499 - protein, 946 aa, Actinobacillus suis
MIKLRFNLSIAALCVLQYNSALAQEQMQLDTVIVKDGIQQQKISEIKKSAKQLAKQQVQDSRDLVRYETGVTVVETGRMGSSGYAVRGVDENRVAITVDGLHQAETLSSQGFKELFEGYGNFNNTRNSVEIETLKQATIRKGADSVRVGSGALGGAVMFETKDARDFLTEKDYHFGYKTGYSSADNQKANSLTFAGRYKNFDILALKTWRDGHELENYDYKTADGSVQGKEREKADPYSIKKDSTLIKFGYSPSDNHRFSVVADLYEKKNRGHDFSYNLKPTTYINVDEYELRHTNDKSKRQNYAFVYENFSANPLWDTLKLTYSTQKIKNRARTDDYCDGSHCKETENLAGLQLKDGKVVDRDGNQPNLGVDELGLTTITDSKGTYTEGVNLVRAYWFDCSVFDCNKSVTAYYKDYSNNITSEEVALTKTYTDEKGRKFATLDPKSKFKSILLPGSKGYTENIYTERDLDTDTKQLNLDLTKSFSLLGQEHSLEYGGSYSRTEKKMVNRGGFGATSNTQWWTKRFLGMRNNFFKGTEEVITCKNATGSDQWNGLICPNEDTFSFLIPVEAKNGSLYFADNLKANDYLSFDIGYRYDDISYKPKYVAGQTAKIPDDMLQGLFVPLPDRPTKEQIRQNAEENIKYLSRNVKYQKHSYSLAATADPFSFLRVQVKYANGFRAPTSDELYFTFKHPDFTVLPNVDLKSERAKTKEAALTLHGDLGFITTSYFKTDYDNFIDLKYLGPKNLMNAFGGSAMARPYQIYQNVNRQEARVNGLEISSKLNFGQLWQALEGFNASYKYTYQKGKMEGNLPLNAIQPRTSVFGLGYEHPEEKFGVDVYVTRVSAKKAEDTYNMYHSEEKAKDSYLKWRSGAYTLLDMIAYVKPWKNVTLQAGVYNLQNRKYLTWESVRSIRPFGTSNLINQTTGKGLNRFTAPGRNFKLTAEVTF

SEQ ID NO: 19500 - protein, 763 aa, Actinobacillus suis
MIKLNKKVAPVTLAVSLALIGANSYAAEQQTNQVNKGELERIEVTARKTVENLQEVPVAVTSIGAQELAENGISVMTEVQQFSPNTTLQSSRGTNSTITAFIRGVGQQDPLWGYEAGVGIYIDDVYIARPQGAVLDLLDVQQIEVLRGPQGTLYGKNTIGGAIKYVTKEMDGDATLNIKGTVGSYGQKDLKVTGQLPLIDEKLYVGFGFATLNRDGFGEFLTSDLTNQDRENYNKDVTAARVTLEYTPTDDLFFKLAWDKTKDTSNSKGGYRLLPSILTDAPVPDSVYDSYTSLPTWNEVELEGYSFTARWDMSDSTSIKYVGASRDGYSPTNIDFDNTSKRIFDVPAIYEDEQTTHEIQLNHQGDNYKLVSGLYYYDGESCGQFEAILEEFGKSLNLPGLTREVSGCSNSKSKAAYIQGSYDFDNKWSMTLGARYTKDSKEAIVNNGLIFDTVYPESGWIPGYVRPEGQLVPTVLDDSEDWSRFTPRAGVEYQYSNDIMFFASYAQGFKSGTFNPRATTPEPAAKPEVVDSFEFGMKSEWNNNLRANITLFTLDHKDRQYISVLPGDSGSDLNQRLGNIGESTSDGVEIELNYVATESLSFNASIGYIDSSFDNVIDFDPNTGAAFDKSDRFSVSNTPDLTFNLGATYRMYTDMGDFVVNGNYYHRGDYALFEEDSLLTQDAYGLLNLGVTWYSADGHWTAGVYGKNLTNEEYMIGGYQFVAPDPSDPTNVSKYQPGLGGDNTLIGYFGDPRTVSLTVGYRF

SEQ ID NO: 19501 - protein, 471 aa, Escherichia coli
MAGNKPFNKQQAEPRERDPQVAGLKVPPHSIEAEQSVLGGLMLDNERWDDVAERVVADDFYTRPHRHIFTEMARLQESGSPIDLITLAESLERQGQLDSVGGFAYLAELSKNTPSAANISAYADIVRERAVVREMISVANEIAEAGFDPQGRTSEDLLDLAESRVFKIAESRANKDEGPKNIADVLDATVARIEQLFQQPHDGVTGVNTGYDDLNKKTAGLQPSDLIIVAARPSMGKTTFAMNLVENAAMLQDKPVLIFSLEMPSEQIMMRSLASLSRVDQTKIRTGQLDDEDWARISGTMGILLEKRNIYIDDSSGLTPTEVRSRARRIAREHGGIGLIMIDYLQLMRVPALSDNRTLEIAEISRSLKALAKELNVPVVALSQLNRSLEQRADKRPVNSDLRESGSIEQDADLIMFIYRDEVYHENSDLKGIAEIIIGKQRNGPIGTVRLTFNGQWSRFDNYAGPQYDDE

SEQ ID NO: 19502 - protein, 448 aa, Escherichia coli
MVMSQKTLFTKSALAVAVALISTQAWSAGFQLNEFSSSGLGRAYSGEGAIADDAGNVSRNPALITIFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAIYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGNTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 19503 - protein, 389 aa, Escherichia coli
MKKYYFAFAAFLGSALHATVALSTGTNQAALAGGGVAAPQDSTWVKLNPASIVGMGNRVDLSLEYLRPQNEIEMGSGGLPNAFESSVDDTGNLFFPHFSMVEQLDDQSAYGVALFVNSGYSSDYSGARSTPGHLGDYDRRLEYSSYKLSLVYAHEFNNGWRVGFGPNLSYARVKTDMLTLTTGQQTRGNNEWDDSFGVGFQLAVHREWDRFAFGMSYTSRVWFSEFGKYEDVTTHPLDMPNILQTGIAYKLRDNLTWTFDWQYLNWSSVKASGNDVTDGGFGWSNHNIFKTGLIWAVDEQWTLRGGYSWGEAPIDSEALFANAFAPIIIEHYLSAGFSYRVNEKWEIAGAYIHGFENSVTDNGGQIPLAEGTEVTSSVDIVNIGLTYYF

SEQ ID NO: 19504 - protein, 1042 aa, Escherichia coli
MLMKRHLNTCYRLVWNHITGAFVVASELARARGKRGGVAVALSLAAVTPLPVLSADIVVHPGETVNGGTLVNHDNQFVSGTANGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKGKLQVNAGGKASDVTQNTGGALVTSTAATVTGTNRLGAFSVVAGKADNVVLENGGRLDVLSGHTATNTRVDDGGTLDIRNGGAATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASDATWNIPDNATVQSVVDDLSHAGQIHFTSSRTGTFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRILAGSRSHQTGVNGENNSVRLSIQGGHLGHDNNGGIARGATPESSGSYGFVRLEGDLLRTDVAGMSVTAGIYGAAGHSSVDVKDDDGSRAGTVRDDAGSLGGYMNLTHTSSGLWADIVAQGTRHSMKASSGNNDFRARGRGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 19505 - protein, 182 aa, Escherichia coli
MRITSIIVSGLLLGTTLFAHEQDSVHESEKPYYVVVKGIHNYGDRNGNEKGDHGNGIGVDLGYRLGHGFAIEIDGSYEKTKVTVFEETETLRENIKYWTTSLDVAYTYEMSESLGILFKVGYEYEYEKTDSENGHDTGLVYAAGFEYAFDSTWKILGEYEKSTIEGPKGDMITLGVMYNFDL

SEQ ID NO: 19506 - protein, 732 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQIPWGLDADHERFTSNQMFFDLAQASASGGLNNKKIYTTGRYPSYDITNLAAFLQSGYDINNLFTLNGGVRYQYTENKIDDFIGYAQQRQIAAGKATSADALWRLSRLRHFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 19507 - protein, 742 aa, Escherichia coli
MQTGPYRITKGVALLLAGTMLASPLLAEEAAPAEEIVVTALKRGNVQLQDVPTSIAVVGQQQLEARGVAEFADFARSVAGLNFVDSGAGDKRYIIRGINAAGEAQTALYYDNIPMTGIGGAATSFGDRQPDLQLYDVQQIEVLRGPQGTLYGSNSQAGVIRFVTNKARVDRFEGSAQGELSTTRDGGTNYGIRGMVNVPIVQDVLAIRAVGYSEDYSGWVDNVYRNEKDFNDTKRDGARVSVTFKPDEQTNIVGQYFYQNLRTGGRAYTRPYDVTIGDNFFPAIGRRATSQIGRETRSDKINIFALTADRDLDWSTVTIAGSYFKRDVLDYVDNGPSFRYFEYLQRIGEFPPVTVPIGSLSYSPQKSKMWTIEARMATKFDGPLNGVGGIFYSNRDNDFETNTTVVDPISGRPDFSQPLISRRNFFDKTKDFAVFGELTYDITEQLSVTGGARWFRTKRDLVANTIVPFFGLGAPGTTSAKAKNEDVIFKGLVSYKVTSDVLLYAQYAEGYRSGGTNASSFSGVPPQYDPDTTANYEIGAKTSWAGGDVVFNVAAYRIDLKGLQSEQRFGPGGAFSGVGNIPGTAARSKGVEADLLVKPAPGLTVQFAGNYTDAKLAKDVPSLGAAALKGSNLAYVPKYNLSLSADQAFAISDKVDASVGFSASRTGKIETTYYTEFNQPSRGYTLVDTRARISWDQFKLDLFINNLFDKAAELTVFNTINDPHVVLANRPRTVGARLGIDF

SEQ ID NO: 19508 - protein, 611 aa, Oligotropha carboxidovorans
MRVRDALRNVSGVYLSDTGGNFGEQFNIRGFRSNNYTNAFLSSIVDSFVFVDSANIERIDVLKGPSSVLFGRAEPSGIINYVTKRPLPTPYAAVGFTAGSYDFYRTTVDLSGPLTSDGNLAYRLNVAYEDANSFRGTQGRRVFFAPVLEWKVGPETKLTFEVEHTRDNRPFDQGLFAVGNGVAPVPYNRLFADPKGLISGNVTRVTALLEHRFAENLTMRSGGRYTSYLESYPSLFSAGELLPDNRSLLLANQRGYGYTESVTFQNDLIWKPRTGSIDHTVLFGLELGKFAQSFDAFFGFANVIDIYQPPPYVFESPPGSSVFVGIITTSSFGVYLQDQISFSDNLKLVLGGRYDTVSAPFTDLQTGDVSPSEGQAFSPRVGLLYKPASNVSLFANFNQSFAPSSGLSTTGTPFLPTRGTGFELGAKADLLANRLFANLALFKIAKTNVVTADPANPRFSIQVGEQESQGVELDVSGELLPGWNVVASYAYTDARISRDNTFPVGNRLPTTPLHGGSFWTAYRIGEGALEGWGAGAGVFMVGERLGDLDNSYSVPGYTRVDAALYYRRGSLNAAINFKNLLNAQYIEAANFRTAIYPGAPFTVQGTLEVRF

SEQ ID NO: 19509 - protein, 348 aa, Neisseria meningitidis
EGRNFQLQLTEQPQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAAS

SEQ ID NO: 19510 - protein, 295 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVKENYSHNSQTEVAATLAYRFGNVTPRVSYAHGFKGSFDATNYNNDYDQVVVGAEYDFSKRTSALVSAGWLQEGKGESKFVSTAGG

SEQ ID NO: 19511 - protein, 266 aa, Neisseria meningitidis
GTIKAGVETSRSVAYHGAQADRVKTTTEIADLGSKIGFKGQEDLGNGLKAVWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEY

SEQ ID NO: 19512 - protein, 74 aa, Neisseria meningitidis
YGLASIGPGYFDKGSERMAKGIGFSDNLALGLNYNFLKELVLDLRLGFRHVSNAEIKQPNEGYDAIEFNIGLAY

SEQ ID NO: 19513 - protein, 149 aa, Neisseria meningitidis
LVVYTRLGGMVWRADATQTNPTYGRISNHDTGVSPLAAAGVEYAVTKNWATRLDYQWVNNIGDAGTVGARPDNSMLRVGVSYRFGQDEASPVVAPAPAPAPVVETKRFTLKSDVLFTFNKSTLKPEGQQPLDQLYTQLSNLDPKDGCVV

SEQ ID NO: 19514 - protein, 650 aa, Photobacterium profundum
MKMLKLMCGASGAALLWSVPAVAEDKATDRANEPVSANASNMSIAASRREILVSASRDTDLLENEYTGSFTVIDEEELEQRQTRDIADVLRDVPGVAVSSVAGQTQVRLRGTEANQVLLLVDGIEVSDPGSGEFDIGTLQAELGSRVEVLRGPQSALYGNDAIGGVIAYDSGRFDGFGVRLEGGENNTINGAARWGVDDGTLAASLSATVVSTDGEPNARAIAGNGLRDIGRDSYTFSGKLSADVSENFELRATARYVETEGETNDQDFAFGSPTFGLVIDSPGVGFENKAIYALVGGRLETLGGDWTHDVSLQLADVARETFAPFGLTSETESDRFKASYVSAFQINDEGGITFAVDYEQEGFNNVATFDDRKETENVGLVGEYRHSGDRFDFSAAIRHDFNDRFQDTTTFRIGAGYELTETTRVRAAVGTGVKNPTFFELFGFFDGTFVGNPDLEPEESTSWEIGLDQTFANGDAVLSVTYFNAELESEIFTTFSPPTFVATPGNRATESEQQGVEVALAAQIGPQWTLNAAYTYLDADEDGVIEVRRPESIASAALTWTAPRDMASATLVLRHNGDAFDNDFSAGTFPAPLTTLDDYTLVNLNARVEIAEGIDIFARAENLLNEEYEQVFSFVSPGRTVIAGFSAAF

SEQ ID NO: 19515 - protein, 230 aa, Photobacterium profundum
MLARSTVVHILKRIFCAGVLICVGILRTSAASLSLPPAPYSYTVLDQDLAAALQEFGNNLNIRVNVSADVRGRIRGRMPDLPPREFLDRLTALYNLQWYYDGLVLYISAAQEAQSRLIVLNPISFDALKAALDALNISDERYIVKPAPGEGLILASGPPRFVALVDQTLKGLVAEAQARRSPAAERSQHESVLMLFRGSSSTVFRDGRPEASPETPLHGGAVREAGPGQK

SEQ ID NO: 19516 - protein, 460 aa, Photobacterium profundum
MIINKAYRRLATLLCGVVLAAGLGVGVSTPAQAGMGNTASTYGLLPMDVASAQGLSLFNAQASALYYNPAYLTRDPRGELTLGMMHAGQELRAASQGSPSGGGSPVTREGDVLSDAPSQQVLIAMKTDLTDLTKFNHPLYFAFIAGVEKYGEEMLAFNSQTSTEGQFFQYGRQPLFLNLGGGVELFNGITGGASAHVSLRSDATLVASADLAGNTQYERLDVTARPVIRPVVSVNFEWGKVFCGNNDRCGFLGDLETALAFRGHTEARTSVESNITIPGTVVDPGITLLIDTLDSYQPDIYSAGLLYHLSDRFRLALAVEQQNWQDLEGKLDRDTIKDQANVALKDIVVPRIGAEWTVNDSLILTAGAAWQESPLESLQTPDVNYLDSDKTIVGVGASWIVRNPPVLAFPLRLDFGYQFQRLEKREFELTTTRPGVTNPYETVSADGEANIFSGSITVKF

SEQ ID NO: 19517 - protein, 187 aa, Photobacterium profundum
MNKFTLPFLLTSFASLSAPHAVNANTAEPSTYLGANYGGYKSRGGEFEEDNDFVQGILGFQLLPVLGIEFDYTDFGQAQNRISSVEIDGYGASVVGRIPLSEDFSLFAKGGRFYWDAEVQAFGVKDSFEGDEPYYGAGMTFSISDAVDFNLEYNRYEVELKSSQIDNRLSDEDSDIDTLKAGVRFKF

SEQ ID NO: 19518 - protein, 259 aa, Photobacterium profundum
MFFKRGKILSAGRLNKKSLGIVMLLSVGLLLAGCSGSKSSDTGTYSGSVYTVKRGDTLYRISRTTGTSVKELARLNGISPPYTIEVGQKLKLGGAKSSSITRKSTAKSTTKTASVTPSSAVPKSSWPPVGQRCWLWPTTGKVIMPYSTADGGNKGIDISAPRGTPIYAAGAGKVVYVGNQLRGYGNLIMIKHSEDYITAYAHNDTMLVNNGQSVKAGQKIATMGSTDAASVRLHFQIRYRATAIDPLRYLPPQGSKPKC

SEQ ID NO: 19519 - protein, 800 aa, Photobacterium profundum
MRYELFVSPCSIRNRVGFLFSSLKHKIQSGILYTFFTNFKIFSCLCKFPIRTLFLITTSILYAQESSRSTPAETNKETSNKRSEITVQGKKDPRDYEIFKTPSSISRLNEQDILDTGISRANDIDKQVPNFAIIDSGARNFTYYNIRGMRSTLFSDPSVGMIVDGVPLADNVALNTELFALESIEVYRGSQATVFGKNFQGGVIEINTKKPNNMPQGKVTADLGNYKKKEYSFFYNTPLVKNKFYIGISGKSTERSGYLNNITGFNYPNNLTSDIPIEIRKTHPDGRRGKSGRLRLYWTPTESLEIDLQANAESFDDGSLNIVNYLASKSERRKSLIKGCAVSPESCEKNFRTYLNRTKSARKVYWDYEGVSNTTGKTYSSNINYKLPKAIFKTTSSVRKMEIDPLIVDGDFTISAFSKSEYIEHSTTRTHETSLESKNQREPFQFKIGTLLYHKISDKEFTQEHLTQTYTYSVLKGLNAPARETHHSKIEDKSFSFFTHNSYTFLEKFTITLGARIETQKIGIGHSRDAKGALLDNPYGDMRLLSPHYVRNNSYRYNVSRFIFDYKPIESLMIFTGISRGYKNAGYSTVVNQPSLAAFKPEINDTIEVGIKSKYFKDFLGINLTYFYTEATDFHVIRAISIAEAVNLNAEKVTIRGAEIESYMKPWKYLRLGFSAGYTEGRFNKFYDRVLDTNFDGKHVHFIPQYDVVSYLQYRSLFGLFFRCEFQVVGKMYFAADNTIYSAPYTVANLKIGYEEERLSAYIYCNNLNNEYYFTSYIDGTFQAVPGTPRTYGFIVNYKI

SEQ ID NO: 19520 - protein, 873 aa, Photobacterium profundum
MNKTTYFPGLFPGVTPPLAGVALSTLAALFPSLSHGESYFNPAFLSADTATVADLSRFEKGNHQPEGVYRVDIWRNDEFVATQDIRFTTSAGKAGEKSGGLMPCFGLDWVKRLGVNIAAFPALSKDANDTCINLPEAIPGSEIAFDFSTLRLNVSLPQASMLNSARGYIPPEEWDEGIPAALVNYSFTGSRGSDTDSYFLSMLSGLNYGPWRLRNNGAWSYSKGDGYHSQSWKNIGTWLQRAIIPLKGELVMGDSNTGNDVFDSVGFRGARLYSSDSMYPDSLQGYAPTVRGIARTAAKLTIRQNGYVIYQSYVSPGAFSITDLNPTSSSGDLEVTVDEKDGSQQRYTVPYSTVPLLQREGRFKYDVVAGDFRSGNSQQSSPFFFQGTLIAGLPEGYTAYGGTQLASRYTAVVLGTGRNLGDWGAVSVDLTHARSQLADDSTHQGQSLRFLYAKSLNNFGTNFQLLGYRYSTRGFYTLDDVAYRSMEGYEYEYDSEGNRHDVPDVKSYHNLSYSKKGRFQINISQNLGDYGSLYVSGSQQTYWNTSDTNTWYQLGYASGWQGISYSLSWSWNESVGISDTDRIVAFNMSIPFSLLSGRRYSRDSAFDRTYATFNANRNSNGQNSWQSGIGGTLLDGRNLSYSVNQGHSSTNGYSGNASANWQAAYGTLGVGYNYDRDQHDYNWQLSGGVVGHADGITLSQPLGDTNVLIKAPGAQGVRIENQTGVQTDWRGYAVMPYATVYRYNRVALDTNSMNNNTDVENNVSSVVPTQGALVRAAFDTRIGVRALITAKHAGKPVPFGSIVRENTSGVTSMVGEDGQIYLSGLPLKGELLIQWGEGANARCVARYALPEESLKQAVTLTNVTCESPTARQE

SEQ ID NO: 19521 - protein, 327 aa, Photobacterium profundum
MSKMNYILPLALLISGVVNAATENPWYAGARVGGTSYSDFSGLGPAQIDKEDWGGGVFLGYNIVPWFAVEGGYTYLGEADIKGTNTSIEQQGIDLVGKFTWNVTNSIDLFAKAGGFYYFADSSGPIDVSDDGIIGTAGVGAEYFFNKNLSARLEYQYYHDVELKDSGIDASWDTHFYGISLVYGWGAPAPIAVVEPAPEPAPVPAMVQVEPITVALPFAFDSDTLSQQDIDQLQPIAQRLVNFPETELFVIGHTDSRGAEAYNQNLSEERAAVVAGYLATHFGIEQSRIQAQGRGELEPVAANDTEDGRAQNRRVEVFTPGFEMEGQ

SEQ ID NO: 19522 - protein, 1278 aa, Photobacterium profundum
MCIDNHKMIFNDGVLFLTGCQIMNKKRIVFIRKGYLLIFPAVVACAFTRANAASQIMASCQGRNVTTSCQASRQNVSGGSQAWNVADGQWLIFSDMANNASGGAVFLQQGADFTISPQNETGMTLFANNSISGEYNNGGAIFAKENSTINLANVIFDSNVAGGYGGAIYSAGTNDAGDVDLNITNAIFENNIANDGKGGAIYSINNDVYLSDVIFDNNQAYTSTSYSDGDGGAIDVTDNNTDNTHLSGKTIINNTSFTNNYAEGYGGAIYTSSTTSPYLIDISVDDNYDQNNGVMIDENNSASGYGHSATAAAGGFMYIGHSVAEFNIAADKTLIIGNTSNDGAIDSLAGTGVIVKEGAGELVLNADNNAFTGEMSIQNGEVTLGRSDELMNVGDTHCQSDPQDCFGLMVGSTVHPEYQAELNVGNTQQTFVHSLTGFANGILNIDAGGNVTVNQGGFSGTIQGEGQLTVAQDGSYLLTGAQSMALTGDIVVEDNAVLSLAGNQADLLAMQSDPQSIVLNGGVLDLSDFTTWDGDGSYNDGLQISGSGGTVIGSNDVVDISSGDDLHIGGSDASQNGVYVVINAGDQRVTLANNNGYLGNTQIASGTLEVSDNSQLGDTSYNRSVIFTDPQQHSEMDVTADVDTRSATTDQGRNIEMRADGEIRVEDGVDTQWGGLMADSTGQQLDSVSTLTKSGGGTLELTASGTATSAVHVEDGTLKGDAENIIPYASSLWVGEDGVFETGQNQDIRSIDATSGGDIDITDGTVLRLTQQDTSQALDAALFSGGGTLVNATDGMTLTGELNTNLETDSLTYLSDVTVNGDLTNTSGAVSLQNGVAGDTLTVNGDYTGGGMLLLDSELDGDDSASDMLVLNGNTSGSTTVEVNPITGIGEPTSTGIKVVDFVADPAQYQNNAQFSLAGNGYVNMGAYDYTLVEDNNDWYLRSQKVTPTPPPDPTPDPTPDPDPDPTPDPTPEPTPAYQPVLNAKIGGYLNNLRAANLAFVMERRDHAGGDGQPLHLRVIGGHYRYTAAGQLAQHEDTSTVQLSGNLLTERWGDDGEWMLGAVGGYSDNQGDSRSNITSTRADNQNHGYSVGLTSSWFQHGSQQQGAWLDSWLQYAWFNNDVSEPGDGTDHYHSSGIVASLEAGYQWLPGSGVLIEPQAQVIYQGVKQNDFTAANHAWVSQSQGDDIQTRLGLHSEWRTAFHVTPTLDLNYYHDPHSAEIKEDGSTVSDDAVKQRGEIKVGITGNISQRVSLRGSVAWQKGSDDFSQTAGFLSMTVKW

SEQ ID NO: 19523 - protein, 366 aa, Photobacterium profundum
MKTTLFAIAAMSLAGTAAAQSNVTLYGSIDEGVAYINSLKSSASSGSALRMDPGTMQPDRFGLRGSEDLGGGTQAIFQLESGFLGDTGSSVVAGKLFNRTAWVGLTNDRLGNIQLGHQADFMFDYLGRLSNGFQLTNFYLFHPGNFDNLANQFQIDNAVRYVSPIFGGLQLGGMYGFGEVPGSPSKSRSYSLGAYYTNGGFRAAAAYTASNDRALDIAGRLGITNTLGTTLVPGVMTPMSSVKSFGAGTLYQFSNLPVQINAVYTQTRITLSGANARAQNVDLGTAWHYSAANTLNVGYTFSKYEGARWNQFSLGNVYAFSKRTQVYVQGTYQRASGDAQSAAINGVGVAAQRNQMVVSTGVHHSF

SEQ ID NO: 19524 - protein, 169 aa, Photobacterium profundum
MKKLLLAATLALTCLPASADILGISVGASAGASRVDYKGNSDTGYEYGIDGTYHINDIFSVNVGIVQGSADVDDDFSSSKNDIDYTAVPITVRGDLPLLIGSLYAKAGTSYYDVDISNASFKDDGWGFTGGAGFVLTLIPLIDLTLGYEYRDMGEVENNAVVLGVGFRL

SEQ ID NO: 19525 - protein, 722 aa, Photobacterium profundum
MKSLSLGLPAVLLSVSGIALAQSGETDDRIIVTGSPLAHELDEVHVGTSVLTDEELRRRQAQSLGETLRSLPGVSATAFGPGASRPIIRGQGGSRVRVLENGVATIDAASLSPDHAVPLNPALADRIEVVRGTTLLRYGSNASGGVVLVDDGRLPSEVPTDGLEGAFRLGGSTVDNGVEAAGGITGTLGTIGPVTLVGHLSGAILDTEDYDIPGFAESARLRALEEEEEGEDHDDDHDDDHDHEHEDEGRDVLANSDVLSETAAIGFSAIGDNGFLAVSAKSFSSTYGIPAGHAHDHEHEEEHGDEEEEEHDHEEEEAGVFIELEQQRVDLRGSLSLTGPFEQVDLFAGYTDYEHIEFEGPGEPGTVFATTGSDLRLEVLQRERNGWRGAIGLNVDQRQESAVGEEAFFPEADTLQWGLYTVQEWIRGASTVEAGLRVEQTDIDADGGESRDFDTVSVSGSYGYQFTDQLSAGLTAFRTERAPAAEELFSDGPHLATGAYELGNPLLDIEVAAGLEAVLRYATDRFTLTASSFFTDYQDFIYERSTGENAETLLLARGVEAEEAEEFGDLPVLAFTGADARFSGGELAIDLGLGTLGGLDLSASLVGQIVEAELANGDPLPRIPPAQVLFGLEAAREGLSLRAELDHAAEQDETAEGELPTDSYTVLNAFADWTPFSGNEALTVSAAMLNLTDEEVRLHTSYLKDEVPMPGRNLRLSVRYVF

SEQ ID NO: 19526 - protein, 351 aa, Photobacterium profundum
MKKTVLAALLPAMLVAGAAQAATVYQGEDGSNIDVYGRLGFNVNDRDNNPDDSKFVGQFDGRLGLGGSQTVNDKVSVIGWAEYQVGAAEGKNEGSDLSARYVWAGVDASEYGKITGGRVASGLIMSTDIADVFSLSDVTLARQAGLVNKNATQVFRQDDTLQYQNSFGALDVSAAYILGNNVKDYETKNGYNLAARYTIDMGNAGKLAPVVSYQQNNADNGRSDNVDKYDFWSVGTRYYLNDLMLGAVYSEDEVTYKGQENSQDKVYELTAVYDVNADWVLRAGYRNLENTGGDETKYKDTTVEAQYKMTDRSSIFTSYVFRDGDNGTGNIWGDWNNAEEDYVNVGLRYEF

SEQ ID NO: 19527 - protein, 992 aa, Photobacterium profundum
MSKMSAIRLLLVGATSLSSLAVAIPAVAQTTVASIRGRVTDSAGAPVAGATVTLTSAGTSRAQTTTTNAGGSYILNGVRAGTYRISVSDPAKGSFQRDIAVGVGTAATVDAQLSSATDTAEGGSTASADGDGAQIVVTGSRLRETRTSEIATNISQEQLRVLPQTDRNFLSFAALAPGVRYNDSETDKSFSSGASPASQVNVFIDGVSLKNKLREGGVAGQQNSRGNPFGQLAVQEFRVITQNYKAEYEQAGAAVITAVTKSGTNDFHGEIFGQYTDKSLTEKSFIDKRDGNPKPAFERKQYGASLGGPIIKDKLFFFAAYEGNDQDRAFNVRSTGAADAIAEFERFSGRDITDFEGSFVSPFRSDFYFGKLTLTPDDYQTFDVSFSRREESDIQGFGGNTAYSYAENKINVVDTYQFKWTYDDDTILNEFNASYLNYTFNPTALNPDLPAYDYQGVILFGGKDSTRREVQQSYNFRNDITYTGFTGHAIKFGARIEFTDISFDNQAFIQPRYYFRREPNNNLNFAFPAEARLGLGSGLIQSSNTQLGLYIQDDWDITDRLQLNLGLRWDYESNGFNNRYTTPPAAAAALRALTTISYFNPEDYITDGNDRSPFKGAFAPRFGFSWDVKGDRSTVIFGGAGRYYDRNNFNNTVDELSRTINPIGLFRFSADGLPRDGQPTVAWDPAYLTRDGLLALINSNPEIGLPELFAVKNNAKPPVNDQFSLGVRQRVGIFEASLTASYQRGKNGYTNLFATRNDGGFGTCCDGDLLAAVRQAGYSNVIIGYDGLDTRYKALYFTLDKNYTKASGWGVNIAYTLGKAEKNGGDLFSLDAPTPDAYGWRNSPGDERHRVVFSGIVDLPLGFQLSTLTTLGSGQAYQVTDGTNGASSGFNDFTARYPEKNCIKGLFAFCEVNVTLAKNFPLFGRDDQVSFAVDVLNLFNNKNFRDFDGFFNNTINPETGEVTDPLLPANGANAANLLTLPRRIQFRVGYRF

SEQ ID NO: 19528 - protein, 355 aa, Photobacterium profundum
MNMKFIAIAVAAATVSIPASAATVYQDDNTVFNVGGRAEVRGNISDANKEFDDTGVETNDSTYKDKSRVRLTVDGKQTYNSDITFVGKYEFELTEKTDGGSDDVAMNTRHLYAGAETSFGDIFYGHQVNAVTYLTDWTDVAETFSGYTNEYNVATADRAKNMLRYATTTSYGLTFQVDGNFNSDQQSDGYGAIVAYELPIGLELGAGYAASDQTFDQTITTLDSSGDPITTPTYETDSSDTYLLAAKYANDGIWLAAMYQGGDISFDGTKDSDFSAVDLYAGYSFGDNTVNMTYNYYSADDIGALDIDFIGIEYARYMGSVALFGSYKFNLLDEGEGGEGDNDEDELQLGLRYGF

SEQ ID NO: 19529 - protein, 361 aa, Photobacterium profundum
MNKKIIALAVAAAAVVSTATSVSAATVYQDGASKVTIGGRLAVRAEYTESVNDQDSTTKLENNSSRINFGFEHEMVPGWIAGAKAEWGYDALASGSQEFSNRLGNVYFLNEQVGTITLGKQWSTYYDITAWTDVFWIYGGEASGTYDGRANEDGHGDSGTGRANEALSYRKSINGLNIGVQYQFEGDDIKTGLSTTHREYGLQSALSYDFDFGISLGGAYSLTKYEGQADDKTWTLGALYQSDMLYVAGQYGQYENHTSVNGNLKGVTNKAGVSGVAENATGYEFIAAYLVNGGEYQVYGGYNGLEDDDTKAEYSYGLIGAAWTPGSMIFSAEYKLGVTDKDNLGNDSGADQFAVLARYNF

SEQ ID NO: 19530 - protein, 1198 aa, Photobacterium profundum
MYKIYYTIGYGMRSHTIDYQLKKWLMRTCLTIALLCAAFLQISLAAMSQGVTLSKKNAPIAEVFKEIRKQTGYDFVITNALIKQAKPVTIVSRAEDLTAVLDRCFADQPFAYTIKNKMIVIQPKTSSLIQQIGEIFNNFEVRGMVLDEKGLPLAGANLWILGQTKAYTVTEDGKFWFDNMTGEESIIVRFVGYKTDTVKVNNRRNLVIRMEPMISALSTVEVTYNTGFQTLTKERATGAFGKPDMKVFSERTGSMDIIQRLEGQVAGLQIATMGNTLSSNLNGNGVSTRRSLVRGESTVRLSKEPLYVVNGVAIEELSAVNPDDIKDITVLKDAAASAIWGARAANGVIVITTKSGTGGRPVISYNAFVNYSARPDLSYSNAMNSKEFIQTAKELFDPATFPLNSVVYSGMAPHDLILYSGPKGDPEVNRKLDSLASIENRSQVSDLFYRPAMTINQTVSASGGRDGYNFYASLGHTGIQKTTPGSNSNAYKLNLTQGLTLGSRVKLTLNTSLINTVIRSKNYPNLGGASFLPYQLFRGADGNNLTVNYLSGYPEVFRESHQALSRINLDYVPLDELELGHRDNNNVNINVTANATVRLFKGLSFVGTYGYQKSPGTAIYYLDNKAITQRIQIVNLTQANDVNSAPVYNYPVEGGLYQTGNNDQRNWTVRNQLAYEANFRQGRDHLTVQVGNDVNEGYNMSSTTTIIGYDETLGTYPILDYARLRMGIPGTVSGYGSLYFTPYEIMKVKSRFISYFGLSSYQINNKYSIDASIRQDYSNQFGKDLSTQNKPSWSLGAKWQIAREDFMKPVTWINDLSLRVTHGLTGNSPGVGTGARNDVFYAVNSSNSGSTLAGDALTLSLVANNALAWEISRTTNIGLDFGLLNRRLSGSIDAYYKSTDDLIGSLPLSPWTGRQQGVTGNIGKIVNKGLELSLRSENIRSSNFGWSTNFNIAYNYNKLLSYSVPDAYSNTANAIVGGWNPQIGYNTNAMFAYRFAGLDNMGDPKIYRADGSVTKVPNVAQPEDVAYMGSTRSPVFGGLGNSFRYKDFSLTANMVFSLGAVMRRDVNTFYAGRLTTTNYQNYLLNRWKKEGDEMDTNIPSFVADYSVNYSRRDVNYYTMSDLNVISASYLKLRDLTLSYNLPSTAVSFLKIQQVNMFVQATNFLLWAANKDGIDPEVPRNTSVINPGHTYSLGLNLSF

SEQ ID NO: 19531 - protein, 163 aa, Photobacterium profundum
MDTETIEIFNNSDEWANQLKHALSKGENLALLHGLTPDILDRIYAYAFDYHEKGNVTDAEIYYKLLCIYAFENHEYLKGFASVCQSKKKYQQAYDLYKLSYNYSPYDDYSVIYRMGQCQIGAKNIDNAMQCFYHIINNCEDASVKSKAQAYIELLTDNSEDNG

SEQ ID NO: 19532 - protein, 422 aa, Photobacterium profundum
MNKKLTCTIVAGAILGMTAPSFGAGFRISDQGAKSMSMANAFAAQADDPSALAFNPAGIAFLKGSQVQVGSTTVLVPQTEFTGTTRLSGSTTVTEKANRDIFIAPTFYVTTSLESVPLSFGLGVNSFFPLAKRWDAGGNFRDSIQEIEIKPINFQPTLAYRFDALKLALAAGLDITYAMASLQKVAYSPFPPPSGPYTALGNMGVDATAVGLGYNVGAQWKPLRQLTFGAAYRSQVKLKLEGDANFAATTAGAAITGPGTTRGTAKLDITLPDVLTLAVAWKPIESLTLEFDAERTGWSSYDKFAPSFGGKLAPLSTSEAKNWEDVWAYRFGTQFAATKSLDLRAGYAYDISPTPDATIGPELPDADRHNITFGLGLHNDYAAFDMGYMFVHFVDRTVSNAKQTGEYKSDAHLFGVSITTKF

SEQ ID NO: 19533 - protein, 565 aa, Photobacterium profundum
MTMLSRRWPSPLMVGSLLVLPVVQVQASGYHFGSQSVAAQGSAHANGAEAADASTIFYNPAGLARLKGTQLTSGLTILLPDGKYEDKGSRDVFGNPVSGDAGEFLPDAAAAPNFYFSHEINERVTVGLGIFTPFGAKLDYKEDWAGRYGIQSASLETVTFNPSIAFRFNDHHSIGFGVSAQYIKSVQRGAADVKGASRQLAGQFVDANYDSTRNAADPILGPIVGIIAGVPVPEEITSCRGVADRDGFVDCVASNFADNVQGDGYFRVKGDDWGFGWNIGYMWEPTESTRFGVAYRSNIRHTLEGETKWSFAGVQGSVPSPDTSLEGGFTIPILDIYVPPTDALRELFDEGNWVNPGDFAATRLHPNSKAKTAIDTPEMLSFNAFHQLNDKVALMADLTFTRHSRLDEVRIGIDQVAGYPYFNGVTEGDLSVKQDWKDTYKISLGMNYQYSDDLLLRTGVAYDKSPVNSTQLRHPAFPDADRYWLSFGANYKVTRDTSLDFAYSYVQFSSGKMDYQDGCSPAGWVPGSGGLYQDSGVRCTGNGGNFTGEYETRIHFIGLALNHTF

SEQ ID NO: 19534 - protein, 677 aa, Photobacterium profundum
MLCAAVAHAQTDAPAASGTPAAAPAPLAPIFVTANPLGDTELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGMTGALDARYGGANSVRAGAAQVEGGNGRFAFHVDAFDRETSKLRIPGYARSSQQRAIDGPDAPQPEGNVPNSDGRVHGGAVGASYTWADGFAGLSYSGYESNYGSVAESDVRLRMRQERLAFASEVRNLSGPFTKLKFDFAYTDYRHKEVDNGETATTFRNRGYEARIEARHRKIGPFEGAIGVQFGQNTFSALGDEMLVPSTRTNSVALFGLEEWQVVPALKLSLGGRFEHVKVDPDPAGVEKFAGAQPRDFNAGSLSAGALFSLTPVWSIAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGVELDGKWRAFSRRGHTVDLELTADYTHARNVDTGQPLPRIAPLRATLAADYGYGPFGARAQVTHAWSQHRVPDDDFSTDGYTSLGVMLTYKFRVGPTHWLAHLRGDNLTNQEIRYSTSVVRGFAPQGGRSLMAGLRTTF

SEQ ID NO: 19535 - protein, 609 aa, Photobacterium profundum
MRWQHSTDNWFNEVIVGTENSENNPTPRTLGNGIVYTYFQPRAGSTDIDERTFLTTGSAGGKNAQRKSQKGWFIQNDLTFTSFQWHGEHTIKMGVNYKDIELTSQDAAALNPQFSYRVSNGSIDSTPYRVDFIAPYTTPGQRATGVSPSKQYGIYLQDDWAATDKLMINIGVRWDYEDTPAYTNFVTSQAFVDALYANDAENPGQPWANRLLPSGINVADYISTGNNRKNFKDAWAPRFGFSYDIFGDEAAIVHGGAARSYDRNLFEQLALETSKAALSPVAVYFENPATGTCYRADRTCVAFDPRYLNGIDQLNTIPGVAGSAELFMFNNKLKTPYSDQYSIGITNQVGDWLTDVTFQRILSYDGFAMGLINRYPDGSYFQNGNVPWGEPVPGYQNTILGSNGLEQRNSQVLLSADKPYTKESGWGLTLSYTHTSARQNRNIDEPYGFDKATIRGYPFVKSDAVAAHRFVASGSIDGPWGVTFGAKLVLATPEPINTIACFGFTDPDGATCQQVGVTPPGSGKFLVGGDIWGYRTVDFQATKEFTVAGDFKLNARVNLLNAFNFKNYSAYAYNGFGSNGQFAPDIAINTSGEINYVPRSVVLEIGAKF

SEQ ID NO: 19536 - protein, 415 aa, Photobacterium profundum
MNKKRLFSKTLLAATITLATQQATAAGFQLNAQSATGLGRAFAGDAVIADNASVMSRNAAAMALFDSSQFSTGVNYIKTDIDVTDIGYAGQNISDTNNSSGTAVPNIYYIHRLNDQWAFGAGIYSNFGTTNNFDSNFGSDSMIPGASVYGGTTEIKSINYALTVSYRINEQFSLGGGLDIVQGTGTLKRESALLTPTGNTTALDVEADGVGLGWNLGAVYELDKGNRFGFSYHYSPEIEAEGDMYMNNGAGGNAIDGHKLLMPLPSMAEFSGYHEIKDTKFAVHYSVQWIGWSAFDELNTKEGVNINNYEWQNGMHYAIGGTYFLNDAWTLRAGYMYDTSAQDELTSISVPDSDRQWLSGGFSYHFAKKHTVDFGITYLMGDDVDVSETSAPTPTLTATTHADAILAGVQYSYSF

SEQ ID NO: 19537 - protein, 821 aa, Photobacterium profundum
MNKNKLIFALLFLCFTCISFAQNAHVKGIILDNENHPVSNVNITSGKNNTQSDVNGFFDIEVISNKKASIIFTHISLKMISLTVSLKPNEVFVFNPVMNNSQEQMGEVFVSSKNRKRVQGITTVETATIKKIPGANAGIENILKTLPGVNSNNELSTQYAVRGGNYDENLVYVNEVEVYRPFLIRSGQQEGLSFTNTDLVQNVDFSAGGFQAKFGDKLSSVLDITYRKPTQFGASLEASFLGGSASVDLVSKNKKWSAVTGVRYRNNSLLVNSQDTQTNYTPTFADIQTNINYDISEKWQMSFLGNISQNKYLYQPLTRETKFGTIDQPMALAVYYEGQEKDQYDTYFGALKTTYKVSPSLTLKLIGSLFHTTEQEHFDILAQYRLGNIDPENPNNASSIDFTRGIGSQLNHARNDLDALIANVELKGTKEWQESQLEFGLKYTRESIRDRIVEWEMIDSAGFSINPPLVILPENNQPYTPYTGPLLSYQDIRATNFNTINRFSGYAQWNKQSQLGSNQIWYHLGARFQSWKVSGALEEGKNQVVVSPRAQFAIKPDWDMDMVFRISGGLYHQPPFYRELRDLDGVVNPNVKAQEAVHVVLSNDYNFKMWNRPFKWVTEVYYKSLSDVNVYSIDNVRIRYVANNNAKAYAQGLDFRLNGEFVPGTESWVSFGYLKTEENYENKGYIARPTDQRLKFAMLFQDYMPNIPSVKLYLNLVYNTGLPGGAPAYSDPYLYQNRLNDYRRADIGFAKVFVDASTQSSKTSWLKNFKELSLGVEIFNLFNNQNAITNTWVRDVYSKNQYAIPNYMTSRVFNIKLNARL

SEQ ID NO: 19538 - protein, 1259 aa, Photobacterium profundum
MSLWKKISLGVVIVILLLLGSVAFLVGTTSGLHLVFKAADRWVPGLDIGKVTGGWRDLTLSDVRYEQPGVAVKAGNLHLAVGLECLWNSSVCINDLALKDIQVNIDSKKMPPSEQVEEEEDSGPLDLSTPYPITLTRVALDNVNIKIDDTTVSVMDFTSGLNWQEKTLTLKPTSLKGLLIALPKVAEVAQEEVVEPKIENPQPEEKPLGETLKDLFSRPVLPEMTDVHLPLNLNIEEFKGEQLRVTGDTDITVRTMLLKVSSIDGNTKLDALDIDSNQGILNASGTAQLSDNWPVDITLNSTLNVEPLKGEKVKLKVGGALREQLEIGVNLSGPVDMDLRAQTRLAEAGLPLNVEVNSKQIYWPFTGEKQYQADDLKLKLTGKMTDYTLSMRTAVKGLEIPPATITLDAKGNEQQVNLDKLTVAALEGKTELKALLDWQQAISWRGELTLNGINTAKEIPEWPSKLNGLIKTRGSLYGGTWQMEVPELKLTGNVKQNKVNVDGTLKGNSYMQWMIPGLHLELGPNSAEVKGELGVKDLNLDATINAPGLDNALPGLGGTAKGLVKVRGTVEAPQLLADITARGLRWQELTVAQVRVEGDIKSTDQIAGKLDVRVEQISQPDVNINLVTLNAKGSEKQHELQLRIQGEPVSGQLNLAGSFDRKEERWKGTLSNTRFQTLVGPWSLTRDIALDYRNKEQKISIGPHCWLNPNAELCVPQTIDAGAEGRAVVNLNRFDLAMLKPFMPETTQASGIFTGKADVAWDTTEEGLPQGSITLSGRNVQVTQTVNDAALPVAFQTLNLTAELRNNRAELGWTIRLTNNGQFDGQVQVTDPQGRRNLGGNVNIRNFNLAMINPIFTRGEKAAGMVSANLRLGGDVQSPQLFGQLQVTGVDIDGNFMPFDMQPSQLAVNFNGMRSTLAGTVRTQQGEIYLNGDADWSQIENWRARVTAKGSKVRITVPPMVRMDVSPDVVFEATPNLFTLDGRVDVPWARIVVHDLPESAVGVSSDVVMLNDNLQPEEPKTASIPINSNLIVHVGNNVRIDAFGLKARLTGDLNVVQDKQGLGLNGQINIPEGRFHAYGQDLIVRKGELLFSGPPDQPYLNIEAIRNPDATEDDVIAGVRVTGLADEPKAEIFSDPAMSQQAALSYLLRGQGLESDQSDSAAMTSMLIGLGVAQSGQIVGKIGETFGVSNLALDTQGVGDSSQVVVSGYVLPGLQVKYGVGIFDSIATLTLRYRLMPKLYLEAVSGVDQALDLLYQFEF

SEQ ID NO: 19539 - protein, 792 aa, Photobacterium profundum
MEKIDMESAKNPLKKTTLALLCCSTAFSLSAKTDTDSDKNHFLTEIVVYADQNKSMSSTQSVTQDDMKKSPVTNGNITDYLRSNPHVRYENSDQNGLQRGEIKPENISINGADYQQTTFFVDNVNINNDMGFGSDLFDGTMATVPFANHSQGYFFDANLLSSIVVHDSNVSASLGGFAGGAVVAKTKQYDGKDRLKFSYRTTDASWAKFKVEDKDLERFKNAIPEGSVAEFQPKYSKHFFNITAEKGLSENLGMVIGLSRRTSSIQQSRQINPQGDRDKQTHTRRSDNALLNFNLTPNDKHRFELGFRYSNYRERKFFNTNIDSNVFDYHRAYGVTFSWINALQSGILTTTLAYDNFDDTRKSASTSMKTIIEDENDYTLGGMGNSQLNQKNSHFSLEYAMNSFDLSHINHSISLGSVFQHTQYRFHRESDAEAEIINRIDLGNGKIEIKSSNLAKKGTVKTRYQNIALYVEDLMTWKNLEFRAGLRLERDNYLKNTNLAPRTVFRYKPFEDTAFSVGWNRYYGRSFASMKLSEGIFKLDGHDTFRYKDLSQFKTPYSDELSFGVEQYVANLAFHLKYILRDNKQRIVLQEEDVMLNGERKKLRYYQRGKDYKTNVLTFQINTQAPWELGPTRWTSAVAFDWLDSKAIDHGRGYNGSTPVILDGKLMTYEQMLKKVNAYKETWGLRLNLDMFVPRFDLSWANTIYVKPPTTLTERVSSNTPEVYRSYDYGTYTQWDTSLRWQPTFAEKHRPYIKLDVLNVLNKTRKGAGPNGQDLGIYTPGREFWLEVGYEF

SEQ ID NO: 19540 - protein, 195 aa, Photobacterium profundum
MVDQAQDTLRPNNRLSDMQATMEQTQAFENRVLERLNAGKTVRSFLITAVELLTEAVNLLVLQVFRKDDYAVKYAVEPLLDGDGPLGDLSVRLKLIYGLGVINRQEYEDAELLMALREELNHDGNEYAFTDDEILGPFGELHCVAALPPPPQFEPADSSLYAMQIQRYQQAVRSTMVLSLTELISKISLKKAFQK

SEQ ID NO: 19541 - protein, 1127 aa, Photobacterium profundum
MRKSLSFHSSVRYFKYIVLVLLFYPLTVLGAQGHITVKGQSITIKEAIMLIEKNSNYVFFYNAADLKNIRLKNINCSGPIDKVLNEVFANTGITYLIQGNDVVLKVSKTESAQQAKKTEIVGVVTDARTGEAVIGASVAIVGTTTGVITDIDGKFVIQAGPQDVLKISYVGYTAKEVKVGNRKVLAIDLSEDAQALEEVVVTAYGTGQKKASMVGSVQAIRPAELKVPSTNLSNSFAGRLSGVVAVQRTGRPGADGSDFWIRGISTLSEATSPLIIIDGVQVSSADLNALDPEVIDGFSILKDATATAMYGTRGANGVMIVTTKSGQNLDKPIINFRVEGQISQPTKTPKFVDGATYMELFNEAVKNDGSPDVLYSQDKINGTRMKLNPYVFPDVNWYDEMFNDVAFNEKVNFNIRGGGKKIDYFSSISVNHESGMLKNRSKDFFSYNNNIDVMRYAFQNNINAYLSKSSKLSVRLNVQLRDLREPNRGIDDIFADAMNSSPVEAPVFYEPDGITNHVKWGTTDRLITAYQGNPVAQLTTGYNDTFESTVIAALEFEQKLDFLTKGLRFKALGTFKNWSKSINKYSAGWNKYLLGSYEQNEDGSYSYTTNRVGNEVSTDLNSTNETAGDRRIYLEAMVDYNRTFGRHDVNAMLLYNQDELVNNVPGNNLINSLPKRKQGLAGRLSYAYDGKYMAEVNMGYNGSENFAKGHRWGFFPSIALGYNISEESFFEPLRKVITSMKLRGSWGLVGNDQIGGERFIYMPTINLSGKGFTTGIDQNYGLSGPVYTRYENNSITWEVGEKINLGIDLQLLNSLNIVVDIFRETRRDIFQKKGTIPTYLGTGNTDVFGNLAEMKNQGLDLSIDYNKAFSKDFYMNFKGTFTYAHNEITKYDEAPKYAFQSKVGQSANVSQGYLSNGLFLDEAEIDRYNQQMGSTLGAGDIKYLNVSNMHGYGDDIVDVDDWTWIGNPTVPEIVYGFGPSFKYKNWDFSFFFQGVAKTSLFMSGFHPFGDNSLRNVLQFVANDRWSPTNQNVDAKYPRLTRKTSLNNTNPGNSGRTSDYWMRDGSFLKLKNMELGYTFKRMRFYISGSNLLTFSKFDLWDPEQGGGSGLKYPTQRVFNVGFQMTFNN

SEQ ID NO: 19542 - protein, 574 aa, Photobacterium profundum
MKKILSILMILVLVGGVAFAQVEPEVRGSATLSWGIDFGAGSETDYTKGGADNHAVATHGFYNTNNFQVRLPFFKRQDFAGGSASKEADVYADVSFKATPVATGWTESGKAVSVKAILHFYGAYMTVYGKPDFKANKALGWDPINADDGDQGKDWFNPAFTGWGTKIGYKKADLMGLDVGLKLGSNGSWHQKASDGKDGKRREKDSKYAFGLDFAMEPVEKYLGVEATINATLGKFFNKTPLENPGDYGYNAGNVPANIGGKEGKSGMVNFGLAFKSEPIEEMTVKLGFDGVTGLTYTDNEGKIQETLGWDAGLSVGYKWVDAALYLCGTGTKYQGYNVAGNDHTKWKNYGANMAAHLGFVSDEEAKKGTGFVDGLAFHVTINAYDLLAKRNSEDIPEATRKANIGALSTYDAALTAYLEANPNKTEADFQADPANAAVVNAFKVAKALFKTKYASIPLGLNLGVSYKYDLTDSMWIKPYAEFYAETNHYKQHADTYAGDPDKMIDKLYLGMAYELGVKFQPIEKVQVKASWEHGKLNKDTYEGSFNGGEYMIKTPLNHKMHNGTFVLSLKLTY

SEQ ID NO: 19543 - protein, 1054 aa, Protochlamydia amoebophila
MKLFAFAMLSLVPLVTVCSVFSKEVDIYSGTYGNDDVEVFQPEEVTYHLAGRDGVFYEGAFTFDNYNPDKGGAGNRQGVFSGYSTHFSSTEGTSLGFHCTGLNPGKNSSASKSFIFVMGPWESGEEFVAPQVTFQNLGDLSFIADNMDMIGITDGATAGTGGGRYGKADIVSFNNVGNIEFRGLNHGGIGFSRLNSLAFTNTGDISFTDMKMGYSSNGGAIFINQGGDSSLYSNPGDGNISFDHTGNIIFRNLVKTSYYMSSAGIFTNEGSISFNDTENILFENNTSTGGPAAIGIGSIFLPDNQPSLSFSNIRGDIIFRNNKASGGSMPGMAGAITIYGSFKLVQTGDVLFENNVTDKNTAGAIYCGNNEGKRFGGQWLLSADGGNIVFRGNLVKGSSGVFARALGIFAYAPENDYTGISQPNGNLTMDFRAQAGREIVFYDGIDIESITVAMPTLHINRIPADWADYGGIPVEFGGTVRFSGALTESFLVRNDGESDGDYAERVETSRRVKLESNIIVEGGRLVLEYGMNLANESGDVWQGSSRVEQDKPVFNLAGGVLEMTSGSSISAQQVIVSGHGSGAILRVGAAPIGSDSWEGKTYELPSLSAVTIDMSHGFDWDLMPFSERGDSGINITASGEFLLGGTIGIADTLDDYASAAWGRDREFVIFNMDSSSKRPQGELKGVISNTTQSSTVDSPYTYGGTWEYEWRDMDGDGEDDQLLAIWKHEAGCRPDQVRPEQAGELALNSLWSSASNAASLGNTALAQLTPVRLYQRYARNVWGMGLGDFARQRSRGGVDGYDYDGGGYSVGMDSDFGGKSGIWGIAFGQMHGFSRSRDFNGRITQDSLMGSIYWGRIFRSGERSLWTVKADLTWGMTDNCMKSRFSNGMDAHGEWNNRTWLVQAEVSRSIQYAGGWTVSPFLRMEFTHGTEASFLEDGSYARKFEGAVLRRLSIPAGVSVERSGDWKGRHWMQVLRLSYVGDAIQDVPEASVYSIYSDIFWRARGVQPARHAVRVEYDAALQWNDRWTVYAGYGMEARGSSVYHRINAGVSRAF

SEQ ID NO: 19544 - protein, 1672 aa, Protochlamydia amoebophila
MRKLIQTILLGWRLLAGLPVLGHLMARPCARTRQGVLAMLALGACQMMLSSPAWAAACTVSFSTTANTQKSYVFTSGNTSSCDPFLIGIAYDSAGDANSSTGPVFNTATSQGGTIAIYNGSVPPSGDPNTNGFVYTPPTNFSGTDTATFYTSNDGVTWLPNGTVSITVTSTAPTVTGISPSSGGTGGGTSVAVTGTGFTGATAVKFGSTNAGSFTVNSATSITATSPAGSAGTVDLTVTTSGGTSATSSADQFTYAAPPTANASSATVAHGSSSNAITLSISGGTPTSVAVSTAASHGTATASGTSITYTPTASYSGTDTFAYTASNAGGTSAAATVTITVSSATVSYAPASPAAGTVGTAYSQSVASASGGTSPYTYALASGSLPPGLTLSTGGTLSGTPTSAGTFSFTVTATDSSTGTGPFSATSGTLSLTIAAPTITVSPSTLTSPTVGAASSQSVSASGGTSPYTYAVTAGALPAGMSLSSAGTLSGTPTAGGAFSFTATATDSTGGTGPYTGSRSYTLTVNAPTLSITPAAGSLSATSGVAYSQAFVAASGTAPYTYALSVNSGALPTGLSFNTATGMLSGTPTTAGTANFTVTGTDSSTGTGPYTVSATYTLTTSAPTISLAPATLTGATVGTAYSQSVTASGGATPYTYAITSGALPAGLNLNTGTGALTGTPTAAGTFSFTVRGTDANAFSGTRSYSLTVAAPTIALTPTTLAGATVSSAYSQSVAASGGTAPYTYAVTSGALPAGLSLSSAGVLSGTPTAGGSFSVTISATDSTTGSGPFTGSRAYTLTVGSPTLTISPASTAGLTAMAGTSYSQSFSAGGGVSPYTYALTVNTGTMPAGLSFHAASATLSGTPTTAGTVSFTVTATDGSSGAGPYAVSGTYTLTVSAPTLTVAPATLPNPAIGTAYSQSITASSGTAPYTYAVTSGALPAGLSLSSAGVLSGTPTAGGSFGFTVTATDANSFTASRAYSITIGAATVALNPATVPGATLNTAYSQTFTASGGIGPYTYAVASGTLPAGVSLNSTTGVLSGTPTALGSSTFSIRATDSSTGAGAPYTGTRGYTLVVGQAIGTAPPVTATTTSTVPVTLHPTANATGGPFSSVVIVAAPASGTAVVNGMDIVYTPTPTTSGNVAFTFALVNTAGTSAPIQATVTVNAVPIAVAQKTASTAAGQTVNVDLTDGATGGPFTGAAIVSVVPANAGTATIMQQTSQTTAGVKALAAAAPVYLLSFTPASAFSGTATLTYTLSNAVSTSTPAVVQVSVAPRRDPSTDPDVNGLINAQIQAARRFATTQIANYHQRLEALHGTGRAPSGNGLTVALPGPRGDAQARCQDVFGIAARDACLRGDSTAGKPAFARGKRNADLQASRGDADAGPDLPGADATADAGQPDLAFWTAGTLDFGFANTSAQRSGFRFTTGGITAGADYRVSDRLSVGAGFGYGRDSTDIGNAGTKSTGDSYSVALYGSYRPLPTLFVDGVAGFGTLSFDSRRWVSDANDYAMGSRNGHQVFASVSAGYEHRDSVWLFSPYGRLSVSESTLDPFSETSAGLNALTYFQQTVTTVSGSLGLRTEYAQKTRWGTFLPYARVEYQHDFNGQSNAGLAYADLASAGPAYYVMGSPYGRDRMQVGLGTKFRTGPLTFGLDYSVMVGMGGLQQGVRLTFAAPF

SEQ ID NO: 19545 - protein, 825 aa, Protochlamydia amoebophila
MEYYFCIMFTQSTENQMKFKYLAVLVFFVASAFGAARAQNVKGVVYGADTDEPLIGASVYWAGTTVGTGADAEGNYTIHRVKGYDMLVAGFVGYTSDTIRVESGVERVDFRLSNDGVELEEVVVNSTLGGNYVKRDGILKGEMISFAGLCKMACCNLAESFENSASVTVGYSDAISGARQIKMLGLAGTYTQILDENRPIMRGLSAPYGLSYTPGMWLNSIQVSKGISSVTAGHEAITGQINLEHRKPTDDERLFINFYLDDELRPELNLSTALPVTKDKKLSTILLLHGSLDTHLLGDMDDNGDGFMDLPKTRLGAVANRWLYTADNGAQVRWGFKYLAENRLSGQKHYKASMREEMDTDWDKGAMYGSQIKNRELNAYFKFGMPVGPGVYDEDQQDELRSNIAFVADYDRFRERAYFGLNDYDGTDNMVSLNMMYNHYFSFRHSLIVGVQSHLQFLDESLLNPTPWLDAAGAWNLDRQENEVGAYAEYTYTIKDKLSVVAGIRGDYNGYYDKFYVTPRGHIKWNITPTTILRGSAGLGYRSTNVITDNIGVLATGRHITFERPTALSAGAAAVRGPLNPGSAYGGYTTWMVADGGAGNFKALNRMEKALTAGGSLTQIFTLVKEEDATLSFDYFRTQFYNSVIADQEYSPNDIYIYSSDKRSFTDTYQVDFSWTPVERFDIFATYRYTNSRMTIDRPDGSTALVERPLVSRYKALLNLQYSTRYNRWVFDVTAQLNGPSRLPTQTGDLADSEMSPTYPMFFAQVTRKVGKFDIYVGCENILDYKQKHPILNADDPFSAGFNSSVIWGPLMGRKFYAGLRINFY

SEQ ID NO: 19546 - protein, 878 aa, Bdellovibrio bacteriovorus
MKYSTTLLSSAIALSLAFAAQAQDSAGTQATDLDAVQVVGIRASLEKSLDTKRNNTGISEAITAEDIGKFPSTNVAEALSQIPGVTLDRRFGQGERVSIDGTDPSLNLSFLDGHPVAQAIWLYGEQPSRGFDYTLLAPQILGRAEILKSSEARLTEGSLGGTVLMHTRQPLDLKVNEVAASIGYSYSDQAGQGKPNAALLYSWKNAAETFGIAVSAQHYEERVDRRGMEVFGYVPASTFANAAGGVPADADVPNSINAAWFQQDRERDSAVVNLQLKPSEALEFNLSGLYINENFDNYNQSMYSFLTWNAGTVAAVDQLGGVRNGVVTSGHSSANAIPRGGTVIYDNNVRESEVTTKGLDLRGAFRGEGWGLNGQVGQSKSENKDLSQYFIEPFYNGGFSWDTRRGIRFDDSVAARNPANWGSAGGWFGNNGIFSTESKDTYGQLDLNLQFDSVFNQLLLGVRHGKHDERFELNVYGGVTPGTLADVGTIGLTDLQGFYPDHGRHIQAGRNNVLNWIRNSPVDYSAPDPASYLNNSWALEQTNNAAYAQLNFSSGGLRGNLGVRYVDSKTEGSGFVYSGTPSLADAGSLWQTRTRKEDFLLPSLTLSYDTSDDWVFRFAAAKVIAWAPYNQMVNNTFLNDTTLTGSGGNADLSPYESWNFNLSAEYYFAQQAVGAWSVFYKKIDNYIDTSASVERQYNALRDTAPQSWAQLVGSNGCTADGYCDYSIQRPRNAGDGKVKGFNISFQQPFGDSGFGLTANYTYAAGENNTGDALPYQSRNSLAFSPYYEKGPLNARLTYNWRDSYLAGGYVAGAAPASVDDYAELGASVGYAFSPNWSLQVDAQNLLDEQYLQYLGDKDHLAGRYKSGRRYMASLHLKF

SEQ ID NO: 19547 - protein, 642 aa, Bdellovibrio bacteriovorus
MKIFSAFGLVGWVVFGSFVYAGEQQTPKTLEPIVVTATRTPTPVQDVGSDMSVITAEDLVQRQRMPVLEVLRGLPGVDVVQSGGLGQQTSVFLRGANANHTLVLIDGVEANDPSNPSGSFDFANLLTDNIERIEILRGPQSTLYGSDVIGGVINIITKKGRGKPRVTARVEGGSFSTFKATGGVHGGNDLVNYSLTGTRLESAGISAADSRRGNPEKDGDRNTTLAGRFGLTPTPIFSLDTTLRYNGNHTDIDGYRGVVPIDDPNSTLDSQQLFLRGQGHLTLFDNLWEQILGVSFTHHDRENQNRPDPQNPFPFPGSFKGEKIQVDWQNNLQFSKKHTLTFGFAWEEASMEAQSPGSNLPRQSVDTEGYYLQAQLSFWDKLFLTGGVRLTHHSIFGSKITERVTAALVLDTLGLTLRSSYGTGFKAPTLSQLFDDRFNAPQDNRFNTPQLKFNNRDLKPEKSSSWDIGVEQSFWDEQGAVGVTYFDNELTDLIQFSQVAADKFQLINIDAAKIKGWEVFMNLTPLKGLTLRGNYTQMHTQDEKTGQPLVRRPEHKAGFNANYRFLSKGNLHLQVVYVGHRQDVGGIPLPSYTVVNAAISYEVTNYFQLFARANNLLDKQYQEVFGFGTPGISGFGGIEFSF

SEQ ID NO: 19548 - protein, 385 aa, Bdellovibrio bacteriovorus
MKRIITGIGALLATAAPVLAGGIERAPQSLAPLFEQGNYLELSFGGVNPTVRGRDVAGVSTGDVAQGYGFFGLAYKHQFNENLSGALIVEQPFGADVLYPTANSPVLGGTRVEVNSTTYTALLRYKFENNFSVHGGIRGSHADGNVRLQGAGYANSSGYNLDIDGAWGVGWVAGVAYEMPEIAARVSLTYNSPIEHDFEMTESGGLLAATGQGTVRGEHTVKTPRSWTLEGQTGIAADTLLFGSIRWVKWSEFKVENAHFPISPETFPGIVPPGTNIPLVELEDTTTYTIGVGRKFTDNWSGSVSFLYEPSEGNTVSPLAPVNGRKAVTVAAIYTMDNIKITTGINYTKLGDATLGVGQSGNKTEVARMDDGEAWAVAMRIGYSF

SEQ ID NO: 19549 - protein, 384 aa, Bdellovibrio bacteriovorus
MKKHVISAAALLAFAAPVFAQSSVTLYGVIDEGFNYTSNVNVNGVGKSNYQLASGFVQGSRWGLRGSEDLGGGLKAIFTLENGFDVNNGRLGQGGRMFGRQAFVGLSHAQYGSLTLGRQYDSLVDYLAPLTANGNWGGTLFSHPFDNDNTDNSFRVNNTVKYASPDWNGLQVGGTYSFSNATGFSNNRQYSIGAAYTLGGLQLAAAYLQANNPGKTAGGAIADNDANFTADRLRIFGGGVNYTFGPATVGFVYTKTDVKNPVSTVYLPTATFAGLGLSATKFQNFEINGKYQLTPALFIGAQYVYTDGKFDAAAGSVKPKYHTVGLMADYNLSKRTDVYLQGAYQKVAGDKTGTIADGGYVVGTDGPSASANQFAVRAAIRHKF

SEQ ID NO: 19550 - protein, 990 aa, Bdellovibrio bacteriovorus
MIIVTGTNIQGARINQALPVTIVTQDDLATIGGVDGEDLIRSLPAQGGVQFRTDNNTTNNNARGDVASINLRSIGSSGTLVLLNGRRVVNHPSTQAELSTPVTTTNVNSLPVAGIARVEVLNDGASAIYGTDAVAGVFNTILDDDFVGFDVRARHLYATGNGLNEQTLTIKAGQDFNDGRTNASLAVEYSRRDGLFANEVDRASSEDLRRFLVGTSFEGDVSFDNRATQTPWGQWTLNTTSSTRVRQNGNILTTTSGVFHFQPDSFPGCRADSLSTPGLCIDDGSQDRDLRYDGAYERSIISDRDRFNAFGFFNHDLDNGVHLYGELGVYYAETRSTNEPRNGITATGISVPASYYYNPFGPVTFSDGSINPNRLPGLTNVPAEGLPVFTDAGRYRFVDVGFRDIEVVNTQYRILGGARGEFGDSGWDWDSAALYNRGYAEDTANNSVSRTLLQQELFREGPDVYNLFNGGNPANPSVGDATPNPRNLIEPFLIDVVRKSTSELALIDFKVSNGDVFTLPGGPIGIAAGVEARYEAYDEDRDSRLDGTITFTDMVTGEVSETDVYGTSPTPDSSGSREVFGIFAEASVPIVSPEMNIPLVETFDVQLAARYEDYSDFGGSGVKPRVAAAWVPFDGLKLRGAYSEGFRAPNLIVVNEGVDRSNGREDSYACEAGVRNGTFASFADCTGFSEGRTERRSVADDIGPEDDTNITYGFVFEPRGLDGALRFLNGLTVTVDRWEIERTDVVGVFGAENHISLDYLLRLQGSSNPNVVRADPNQDQIDYFNAAGLTPAGDILFIRDTYDNNEDIDVEGIDYGVYYSLDDTPIGDFDFKVNASYLDTYFIALSPGAQQIADAVDSGLISDEITVSQEGDIILQDGQPEWRVAASLTWRHDSGWGAGIRADYTSEFIDTGAGLDPNGDPFIVDAWTQTNAYVQYDIDANGILDGMRVRVGANNIFDEDPPLADETNGYDAAYHSIRGRQVYFDVRKRF

SEQ ID NO: 19551 - protein, 218 aa, Rhodopseudomonas palustris
MSRILLNTKTWLLFVLLLGISLSAWAQSDDFNTWTKFKVNHKIDSRFSVSGDLELRMKDDVSKLDRWGLTVGGSYRPYSFLNLGVGYETHLRNLGDSDWKFRHRYHITATVSFRYQWLKVAVRERFQQTFDRGNSETRLRSRLKLSYAPTKGIVSPYFSVEIYQSLDDVSFWRADRMRYRPGVEIALAKRWSLDAFYCYQYASSQGRHIAGIEVGYSF

SEQ ID NO: 19552 - protein, 673 aa, Rhodopseudomonas palustris
MQSRPAAPRPCSALSRALLASTILVPALSLTTAAAAQDVLPEIVVSATATETPREQVASSVTVITADDLARYQQRTAADALSMVPGLNVVRTGGPGGSTSIFMRGTNSNHVKVLIDGIDAGDPSKPNGAYDFANLLTSDIERIEVLRGPQSGLYGSDAIGGVISVVTKRGSGPAKLTGSIEGGSFGTFNQTARAAGSQDNFDYAFNVAHYRTTSLPVTPLDLLAPGQQRNNDNYDNLTYSTRLGVRASDELAFNYVARYTDAHKGFTSDDYSNYPNSFPASLQSTMASRDFLTRSEAVWSPLGNFTSTFGVSYSNQWNRTFDPNPNFTTNLITGTVGISPPSSYTGERTKFDWKGVLDVGYGQKLVVGTERQDETIRTNSMGDYDFTGNYQQKTLHARTGNTAGFVELQSEFTKNFFLVSNVRYDDNDSFGGHSTWRVAPVFIVPTLETRLKATYGTGFKAPTLIQLYVNNPAYATVGNPALKPETSKGYDVGFEQPLFAKRVVFGSTYFNNEINDLINSTGYDVTLGGYSYKNIGMARTSGVESFVSWQATETLRFRVDHTYTHAIDQTTDQKLRRRPDNKVTMAAIWNPVERATVSATVLYTSSWVDYDRFGTTLLDAPSFTTVNLAASYEVDPHVTVFGRIDNLFDKKYEVPVGFLQPGFGAFAGVRVTN

SEQ ID NO: 19553 - protein, 131 aa, Rhodopseudomonas palustris
MGPRSHRPIRVGLGQAEDNYSKLGGAVKTRFLDTEIKVGDVFPVTPVVQYGDSRLLPESFRGVTAYNTSVEGLVLQGGRLHAMSQPSSSSMRDDFATFYAGEVGSPWIVGGDYTPNDNLGFSLYTSCLKDA

SEQ ID NO: 19554 - protein, 746 aa, Rhodopseudomonas palustris
MTKFLGGLLFLLFGFSVEGLAHDDYLICGTVFDTETKTPLPNVSIGISSHPFKNHTDPNGKFCIKTHADSLTLRFSLMGYQNKRISISCKNDSSLRVFLRSELLMMNEVVVSANKNAASSLEQTITSQVISNEAILESGAQNIPDLLVKQPSVSLAGQAYHAAPSIRGLARKRVLVMVDGEKTSSERNVGTPGTFINPFEIEQIEILKGPYSTLYGSDAIGGVVNILTKSFETPYYNQNIGGRFDISTRSVSNAKNGNLALNGMLGKWMFHVDAGYRDADDYTLADGTALMNTFYEEKHAGGKLTFMPNDHHAITFKSYYSDGGEIGKPAYDTLTNAVHDKDVHFIAGVNYKWTGISRTLTKAELNFSRHDHDLGVKIIKHKTETDPSDDKLVNNRKTLSSTDYVLQGDFYFTLNKRLKILTGFDSFLHQDIDISESKVVHGYYSGLFLKQEFTTLLSGAYQNSYGVFVQADFIATDKLFTSAGVRWNYISTNGAPNQNAEKTDDAFSANFGLSYILAKSFTLKANVGSAFRAPDVKELYITTNTPGGLNIGNPDLASEHSLNFDLALIYKGAASLVELSAFHNQIENMIVLDWDNSTASREGTFRNIGKGVLYGVELAYKQNLTQAISPYFNFSWIHGYDDSSDDELTDVPPIQINLGIKYKPVQKLLLHLSARYSAEQTEVADDDIPTDAFTVIDFNASVQLLENLALNASVTNLFNEDYREHYQFDWMRAPGRSFNTGLHFNF

SEQ ID NO: 19555 - protein, 474 aa, Rhodopseudomonas palustris
MRRAALCTAFAWASLTAGAAMAEANPDATPEAPEADLKIQATQTNQWTGFWNRQQMLGDIGGLRPWLGKYGVTFTLTETSEVLANLRGGLAHGADYDGLTTGTVQLDTQKAFGLPGGLFNVSALQIHGANLSANKLGTLNTASGIEADDTTRLWELWYQQSFLNKRIDVKIGQQSIDQEFITSTYSALFVNTMFGWPALPSYDMPSGGPAYPLSDLGVRVRGQITPSLTALAGVFDGDPLGNNPDNKSGTNFNLHNGTLFIGELQYAINQPADGEMVGAGGGGLPGTYKLGVWYNNGSFADQRYDNTGLSLANPATSGIAQNHHGDYSFYAVADQMIWRPDPDEPRSIGVFARVMGAPGDRNLVSLAANLGVVMKAPFAGRDNDSVGLALTYIKVGNHVNGLDLDSRAFSNGPYGVRTSETTLEATYQYQVNPWWQLQADAQYTFNAGAGQNPNDPTQPLRNTFVIGLRTNINF

SEQ ID NO: 19556 - protein, 518 aa, Rhodopseudomonas palustris
MPDRPGRTRILKAVLLASTTFVASGYAAIAQAPQAVQQERMVAFDLPAQPLAASLTGFARSTCIKLAYPAALTRGRSAPPQRGSYSPAEALDRLLAGSGLSWRFTGANAVAITAPAAAAGTGAAGGGILLDQITLTGESAWGPVSGYVARQTGTATKTDTPIVETPQTINVISADQIKAQGAASVDEALRYTPGVSTDFYGGATYNDYVRLRGFVAPIFAEGMRMPSGLRDYAQLRHEPYGLERVEVLKGPSSVLYGQAAPGGMVNALRKRPTAERLRELQLQAGSFGRNQGAFDLGGPLDAGKTLTYRLTGLLRDSGTQVEALRDDRAFLAPSLTWRPDADTALTLYGHYQHDVGGNSPLPALGTVYPTQFGHLPVDAFLGYPDFNRYKRDQFSLGYEFEHRFDDRFQLHHKLQYSNIEMDYRYSVLSGLQTDPATGRISLNRSIQHPHDTATALTMDNNLQADFDTGPLRHSLLVGLDYTRLDFDSHWGGDYTAGRVDVFAPHHDNRPADPVLYPD

SEQ ID NO: 19557 - protein, 996 aa, Rhodopseudomonas palustris
MFCCWIADLQAQQAVTGTITDANGLPIPYVNVVEQGTNNGAISDIDGRYEISIEDVENASLLFSSVGFKKQTIPLNGRNEIDIVMQDDVAALDEVVVVGYGTQQRSDLTGAVASANLEAFKESPNTNIVQSLQGTVPGLNIGQVTSAGATPSISIRGNNTLSGNTNVLIVLDGIQYNGSLSSINPNDIESIDILKDASSTAVYGAQAANGVILITTKSGKRDQKPRITITSSYATQRPSEGIRPAGRAEFIENIRRLSYNEIFTAPEFTTPDPSWPGFFQPGNGIGLIPQFEDPNNPGEFSPIDYDWYDAGTQTGFIQENQISVSGGSDRVSYLLSLGLTEQEGFILNDNFSRKSIRVNVNADATDWWKVGVQTFGSFTNQDGAEPSLYDLFIQPPILSPFDENGELIPSPTGTVRLNPFLSSNIDNYERHDFFFANIFSEIDVPFVEGLSYRINFGNNYRIDKNYQSSIYAAGENGQAYKNIGFYKDFTLDNILTYKRSFGKHNIEATALYGAIERKAEGTNARAEVFDRLTLGYDNLSLGGNQFTGSYANTERLNYQMLRLNYKFDNRYILTGTVRRDGFSGFADNEKTAYFPSGGASWIISNESFLDQSNVINNLKLRVSYGVSGNQTGRYTSLARLITRAAYVFGDGGNPSFGQELSSLANPNLRWERTKGLNIGLDFGLFENRLSGSIDVYNNITEDLLYAVRVPYLTGFDQIQTNLGRIDNNGVEVSLSGDIIRTTDFTWSATANFSLNRNKIVELTGKDEDGDGVEDDLIQDGLFIGRPQGEIYTYEVNGIYQIGEENILDGYLPGHYRVVDQNGDGSIEQMDDRVFIGNTSPNFRASLLNTFTYKNLSLNVFLNSIQGGNGWYMGANDNALYRDANSLRNNIISGVSYWSPTNPDGLNAMSYQTPEGPNGTRYEDRSFVRLQDVSLRYSFNKDLLDKLAIADLSVFVSGKNLATWTDWKGWDPETGQGLTLGGRPVLKGYSLGINLSF

SEQ ID NO: 19558 - protein, 464 aa, Rhodopseudomonas palustris
MPRQAERADAHRLRHALAALVLGLGLQGTALADTAAPKVPDTPDAPATQDLPEPQRWNLHGQFTNVTQWHPDFSTRYSGPNSLTPTSDSRETVDLTLFLGVRLWKGAELYANPEIDQGFGLDNTLGMAGFPSAEAYKVGKNEPYHKLPRFFLRQVIDLGGEQQAVESAPNQLAGTRSADNLTITIGKFSVVDIFDTNAYAHDPRGDFLNWSVVDAGAFDYAADAWGYTRGMAVEWTQSWWTVRGGFFLLSDVPNSVTIDTSFKQYAWIGELEARHQWLGRPGKVKFLAFANRGRMGGYGDAVSLAQQTGSTPDMSPVRRLAWRPGIALNVEQELAPDLGFFARASMNDGSKEAYEFTDINQSVSAGFSLKGDRWGRHNDTVGVAVVVNGLSRAARQYFAAGGLGVLIGDGALNYGTERIAEVYYNWAAMPHLTLGFNYQYVVHPAYNRDRGPVSILGLRVHADF

SEQ ID NO: 19559 - protein, 290 aa, Rhodopseudomonas palustris
MRSVKFLVAAGAASLLSSAAFAADMPIAPPPQYYAPPPVAEFGGWYLRGDIGFSNQRVKNIAMGDGRNASLTSLNQSTAFDTAGIFGVGLGYQFNNWFRGDITGQYRGNSNFKGTDLITFPAYGLVGQGVDNYNATKSEWLVMANGYVDLGTWWCITPFIGAGVGVARVNIANYTDNGSNNVNYSSATDSYYLGGPNPSYASAPAASKWNFAWAAHAGLAYRVNPGLTIELAYSYVNLGSGTTGAVSTYDGFTRGVAMKFHDITSHDVKLGVRWDLNSPPVYAPPLVTKG

SEQ ID NO: 19560 - protein, 308 aa, Rhodopseudomonas palustris
MQGGFVVGERFKFTYLLVLLTFSFRCLSYDDKINNLENVYIKANYFGAFFNAIGSLEGKEDAGDNITEGVFSFNKKERIEAGYSPKYVPGFAGSAAIGYLFKNMRVEFEGLYSQTNLYDEDYSDKKKARYIELRRHNDASTGAECNSPWRSGKVDIHIQENCSVEAEFRAAFKMKNEGFNNLAGMVNVYRDFNIAKMPFTPYVGIGAGVTRVKFLGKTRYALAYQAKLGINHQLTAQTQAFAGLRYFGILDNQFKDIVPGIKILAGEGYIPAGGGSKVDETARVESTTATITNRFGIYGLEFGLVYHF

SEQ ID NO: 19561 - protein, 194 aa, Rhodopseudomonas palustris
MSDFQRSLQFQGRNLQRQWQEKPLLRMAIWSLCLLLVVHLVMLSMDWREERGEEYRRLAGEWLKLQDVSRQTAWPERAMQAEQVLNLQRERFWQAPNASQARADVQAWLTERVRLAGVPDAEVSVLLPRGFEKQGTIARIEAQVRGQLQPASFSRLLQDIEAEQRQVSVEFLELNNMLSPMLNLQLSFLFVAAY

SEQ ID NO: 19562 - protein, 769 aa, Rhodopseudomonas palustris
MTTQPRSAELIASRQQALRRSRKYAASLPMSALLLIGAVADDARAQAAGTAPTSPAVSALPAVVVSAPKQSKPKRRATPPTVTAAPAALPRPTSRTTTARDADGPGFVARTSTTGTKTNTPLIETPQSISVINRQQMDAQNVQSVTDALRYSAGVVTTTPAISQRFDTFSIRGFDASSSGILRDGLRGTTAQAWPKSEPYGLERVEVLRGPSSVLYGQNAPGGLVNLITKRPLDKPFHEVMLQGGSFDRLQGQFDLSGPVDKDGQFLYRLTGLARDSNTQFKAIPDDKVFIAPAFTWRPDIDTTLTILTDYSHEKFGPPRPYIPIQGTLLPNKNGQLPRNQFLDQPGLDNDRTQYSAGYLFERHLDDTFTMRSNFRYGHVDLLTNTASGMSLAADQRTLNRALYQFRIVGDTYASDNQIQADWWMGSTQFVSLAGVDYRRSTEDYYLNSGRAPSIDIFNPVYNQPIGAATTASASTWQTSDQIGIYGQQQIKFDGRWVLSLGGRQDWSNTATDNRLKRSTATQDDKAFTYRAGLVYLSDVGLAPYIGYSTSFSPVLGTDFYGQPYKPTTGRQAEIGIKYQPAGATSFVTMSVFDLYQENVQTTDPNNSLNRLQVGEVRSRGFELQGVANPIAGLNLVASYTHAELTVTKSNIAAELGNRPTGLPADTASLWGDYTFQSGPLAGFGAGVGTRYVGESFADSANTIGVPSYVLFDAALHYDLGQLHRDLKGMRLAINATNLTNKQYYVSCSATSCNAGFDRSVIASLRYRW

SEQ ID NO: 19563 - protein, 341 aa, Rhodopseudomonas palustris
MRNSYYLKLVPALFSFYAMSANAEVIYPSFFVGGSLGYQLADDDNYSYSDPGAPSFGVSGGVQFNDDWRWDIGYQYSDTLEARQNNIELTPAWFETALRYDWELQKNYKAYARLGVAYWDVDKEIKGVETLSTQGISPLGEVGISYALTPNIDIEGGFKYINEIGDKYTGRYDNNSFVINLNYKFINEKKVIEKVVVKKEPKALPPKPVVVPVKPVKKIITTNEESYVTYFSFASSKVNTGSLELQKVLHILKKYPQSNLILTGNTDSIGSYASNQRLSQKRANSVARFFTDRGISISRITVRADGETNPVASNITAEGRSQNLRVDMNIPSFSYDIVVSK

SEQ ID NO: 19564 - protein, 425 aa, Rhodopseudomonas palustris
MQVMKWSVIALAVAAGTSQMAVASSQSESKGFIEDSSFNIFNRVLYLNRDFKNGASNGASDSANPAGYREETGLGIRLLYESGFTQGTVGVGFDAHSLSSIKLDSGRGRYGTGQFDKTSDGRGDDTQTEVGGAVKFRISDTVLKYGNQFVESPVFTTDDSRILPETATGTLLTSNEIEGLELTAGRLTALSSQVSTDRDTFRLKSANIIGANYSFTDNFSGGIHASDVEDHFKKQYINLNYNLPVAEDQALNFDLNAYRTKDDGQKLSGDIDNKIWSLAVAYAIGAHKFTVAHQRSSGDSAYAYGVDGNGTIWLANSVQYSDFDRKDERSWQVRYDLNMAQYGVPGLSFMTRYIYGDNIDTGVGEEGKEHEFNFETKYVVQEGAAKDLSFRLRSSIWRANSVQNDEYGADLNDFRLIIDYPLSVL

SEQ ID NO: 19565 - protein, 744 aa, Rhodopseudomonas palustris
MARPIPISIRTGLPLFRRDYIWPYIVIRNGTSRHKKGSLMQLKTILLATAAVAAMAPAHAETAGDSAGNAFSLGQIIVTGVRPAGVEVGGSTLTSEAIYAFNRTTLDEAANLIPGVASGNSGGSRNERLVFVRGFDRFQVPISIDGIRVYLPADNRLDYGRFLTPDIAEIQVAKGYASVLDGPGAMGGAINLVTRKPTKEIEAEVRGTLNLDRGVDYAGYNVFALLGTKHDRWYAQGSYARSFTDHWDLPGDYVPVAGSAEDGGAREYSRTRDWRVNAKLGFTPNDTDEYSISYTRQEGSKNAPLHVTDPVSNPLPPGAPNPRFWSWPYWNIESIYFLSTTQLGERATFKTRVYRNSFDNLLSSFDNATQATQTLGRSFNSYYEDKAYGGSAQLDLAITDANALSLAFHYRRDKHVEFQQGFPSGATEPPQTNEEDTYSAAAEYRAAFSPTLSLTAGISYDWRELRKAEEYATPPGELAPRIFEYPRADASAFNWQARLDWRPDQATSLHAGVSRRARFPTIFERFSTQFGTAASNPGLKPERAVNYEIGGSRRIGAFRVEAAAFYSDVQDAIVAVRPVGFPANTTQRRNLGDGKYYGGEIALSWQPASTLELGVNYTYIRREFDITPQAAETVPVFALTDVPTHKGFAYARWSPVERLSIYPNLDFASKRTTLDTFVPGAPVGTVRYYRTGGYVQANLRVDYEVFDNVEIGVGARNIFDKYYVLTDGFPEPGRSFFASIRARY

SEQ ID NO: 19566 - protein, 658 aa, Rhodopseudomonas palustris
MGSEMTFETCVRRLAIGALAAGFIGLAPARAQAPGSLYVFGDSLSDNGNIPRLTGVPYPGPPYVGFRFSNGPVWAEYLPGLTGLNFKPSNDYAVGGAFAGPLVVNGVTYNNLVNFPSTLLPGLPNELQEIQGFAASGGHFSPSDVVGIWIGGNNYFATETLVGADPANAQQIVSQNVSTVLAQTGQAIGQVAALGARQVVLQNLVPFGNVPTVNGTPQLVALGDQIIAAHNAGLATLAGQLHASLGINILLINQQQIFSEISANPAAYGFTNVTDACFASASSACAYAPASVQNQYLWWNVHPTTHGHQVIAEYVASALNGFQSLSVPARLLDAGAAAFAQTIGARMDALRHGAGGLTVDLAGGPMLADAAAGDTGPMEMPGNGHALSVFVAGGYGFGARAAAPGSLGFHDQIGTVTAGADYRFTRHLAAGLAFGYARESATVNGGERLDADAYQFAAYLAAHSRHLYLDAQLDYGLDRFGRISRPGVLAPITASPRGHTLGATIQAGYVLHRGVVAFGPTVGLDATEAHVDPYTEQGDPALTMAVGGQDFGRVLFGAGLAASARVRLGGVAIRPHGSIGMQASIAGAPGQFASVFTDEPLVGLTTTYPQLSTMWGVADAGVTARLAGRLSATVDLATTFARRAGEQRMVSAGLRWRF

SEQ ID NO: 19567 - protein, 240 aa, Rhodopseudomonas palustris
MKTMKNTLLGAAAVIALSAPAFAADLPPRPYTKAAPAYTAPEVVYNWTGFYVGGHVGGAWAGDNNITGNSGRFFGGVQGGADYQFATNWVIGIEAQYSWMSSNNTGVIFPGGSTATEDTRGLGSVTGRLGYAWGPTLVYAKGGYAWRDSDLSVASLGGVPSGYTASGSRNDGYTVGAGLEYMFAPSWSAKVEYQYYKFGDTTFTGGPADVVGTSFRNDEHTVKAGINYRFGWGGPAVAKY

SEQ ID NO: 19568 - protein, 660 aa, Rhodopseudomonas palustris
MGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 19569 - protein, 1053 aa, Rhodopseudomonas palustris
MAVGANAQVTTSAISGKVLDETKAPVIGATVVAIHEPSGTLYGAVTNVDGRYTIQGMRTGGPYKIEISYVGYNKTAFTGISLELGNTLSLNAEMKPSSELLDEVVVVADAKANAGAAHNFSTQKIENTPTVDRNVYDIVKNMPMAMTSKNGGITFAGSNNRYNSFQIDGTVSNDVFGLSASGTNGGQTGANPISMDAIQEIQVVVAPFDVRQSGFTGGGINAITKQGTNTTHGSAYTYFNNQNMYGKYSAVRDYEKSPLTQQYTRTYGGTLGGAIVKDKLFYFVSAESKKESYPSSIYPGYTTSYLTSEQAKQIADAYYDMTGFKEGYSQRNIDNKSFGLLARIDWNINQNHKLALRYQHNNSYDDNYGVGSTSYMFENSGYRMNNKTNSIVAELTSHLGQNLYNEFRASASFIRDHRDVAYQGPTVQISNIPAPDGTNITANIGTEYSSGANYLDQDIYTFEDNLSWYLGNHTLTFGTHNEIYKMTNLFIQASNGSWYYNSLEDFIADRPYKYTYKYTDPTLTGGDTKWAPAMKSGQFGFYAQDKWDVNNNFNLTYGLRIDIPVIFNNPTTNDAFNQFAESQNLNARVGQNPSAKVLFSPRVGFRWYTNDSHNTLLRGGIGIFTGRVPFVWLSNAFNNTGMESKGTTITPEDADGNYTYDAPKLGEYADNPLGAANSQSGASAKPDIVTVDKNFKYPQVFRANLALEQMLPGDVKMTLEGIYSKTMNNVFFENLALTQSGNKVYAVAGNEASAAPYYQFNSGNYYSIINLKNTNKGYTYALSALLEKRFNFGLDLSASYTFGHAKSVNDGTSSVAYSNWKYNYSVDTNSGNELGFSKFDIPHRVMVQASYNSPKYWNGWTSTTISVIYNGFSGSRYSLTMNEKSDYNGDKWSGNSLLYIPTDEELSKMNFVDITDKQGNVTMSAEESREAFKQWIENDSYAKNHRGQYAERNSNLSDWEHEIDLHLAQTIYNVQGVGKLEFTFDIINFANMLNKKWGASYSSAYNLSPLTMTGLSTDADGNKIASFSYNKAEIQKSDISSRWHCQVGVRLTF

SEQ ID NO: 19570 - protein, 478 aa, Rhodopseudomonas palustris
MRTSFLPALSAVATAALLAGCAVGPDYVAPPAPSADAFMGQPAVAARAAAPAPADAWWRGFNDPVLDRLVDRALAQNLDLAQAAARVTQARAGLGAATAALLPSASIQAQGVANHASTQTPTGRLLAATPGFDRDGSLYEGNLVAGWELDVFGGTRRDREAALARYDAAKAGVAAARLAVAAQTADTYILVRGLQERLAVARGQVETQARLVDTVRLQYDHGAAADLQLQQAQGALAQTRAGIPVLEEGLEAALNAMDVIQGAQPGTYRAELVTTTAIPVAPGLTEAGGPAGLLRRRPDLVVAEQRLRASNAEVGSALSQYFPKVSLSGLVGTATTSSATLFEGSATQAQGVLGLRWRLFDFGRVGAEVKAARGRKAEALAAYQQAVLRASEDVENAFVSLVKREVQARALSGGEASLAKARTASQVAYEAGAVSLVEVLDADARLLAVRDARAQARTEAARAAIRSFQALGGGWSAS

SEQ ID NO: 19571 - protein, 159 aa, Rhodopseudomonas palustris
MVVTPLSGTAEVPLAASRRHNFEIGYMHKVFGQAKGKRLDLEVWADGYFYGNTNVQTGVHLKTDPAAQFIVYAPYYFHPQTDAYVGLSFEKTFGGKISEVNPLGTFDTGSRNNFTRIGVIAGSFLSPTIFAQAQLATDVQARGGAKNDIFFQVQVGKVF

SEQ ID NO: 19572 - protein, 545 aa, Rhodopseudomonas palustris
MGMAMLSSCLANAAPDAGQALRDVESRRLNLPAPVELDAERPSPEDGVSRAAEEGGPTVLVKRFQLSGNRQFDDRRLLALLHDLPGQELNLSQLHAAAARIGDFYQEKGYVLARAFLPAQEIQDGTVRIEVLEGRYGRIELHNTSRTLDRVLLRPLSALERDTAVQGSELERALLLLSDIPGLQAKGTLLPGQAQGTTDLRVEARPGPLVGGRLEADNYGGRYMGEYRLGTTLDFNSPLRLGDQARLSLLGSDRHQRYYRAAYQLPLGSRGTRIGLAHAETTYRLVRDFSRLDAHGRAITDSLFVSQPLLRSRSLSLSTQLQYENKRLRDDQERTGRHSRKEIRLWTASISGNAQDRLFGGGQSGFSLAYAHGQLAIDSGEERLLDRYTIGTAGSFDKIMLNAVRLQHLGDRLQLFAQLNAQWSGGNLDSAEQFDMGGPYGVRAFPLGSYKGYGDEGWQASAELRYSLAPGWQLSSFVDQGAVKFLKHPNTTEGNRNRMAAVGSGATWYGTDHQVSLTAAWPLSQENNIEPERTPRLWLQATRYF

SEQ ID NO: 19573 - protein, 997 aa, Rhodopseudomonas palustris
MKNFPAWLSVWSVVAVACGSAHAADLQNGAVPSAVPAATNWTGFYIGTHVGAAASDSAWNSIAGSGAGLAAGPFPGHGVSGNAIAGIQGGYNAQFGNYVLGIEGDASFGSINGLARCLHGTFACTSRIDELWTLAARFGYAAGDLLVYGKAGAAWADVHRRMASGNFVNVLEASETRSGWLLGAGVEYAFLPGLSAKIEYNYADFGSRSLTMADQFGDVSDVSIGQTAHLVKVGLNYRLGAASVSAAPLPGVPLPQWSWTGIYLGVHAGGGFGSNDWDSATGALLAASTSGGFPGRGDSSGLFGGGQIGANYQFGRWVAGVEASAAAADIGGYAKCATDVGTRRNFTCHNELSSLGTITGRLGQTWGNLLIYGKAGAAWATGSSDAQRAGSASRFTESGTRWGWVTGTGLEYALSPNLSAFVEYNHVDFGTQDTAYVDQFGNASEVGFKQKFDLVKAGLNYRLGSGAPTLGAGGDVPLFVKAAALPLGWQVEAGTRYWGSSGRMQKDLNDNVSPSRLNSRLIYGDQTGHSLEAFVRVDHASGLFAKANLGLGHLVNGQLNDEDFPSEVNYSNTISEMRDGRLAFGSADIGYNFINDGGRKLGGFVGYRSLYQTGNGFGCRQIATDFDTCGVPFPTNFVGLSETESWRGVALGLNVRAPLTERLRLEVDAAYLPYVNRAGFDNHWFRADINPQSEVGHGWGTQFEAILSYAVTDRFSVGVGGRYWYFATDSASTIFPREATTSPMQFYSERYGVFLQTSYKFGDVDAAEASAHGITKAPPRIAPTNWTGLYVGASVGAGWGRTTYADPFPTPTTGDRADLGGALLGGQIGANYQFGHLVAGVEASANWANIRGTDTCFGAYPNPVVAGFNCGSRIDAIGAFTARGGYAIDRTLLYVKGGAAWDRQQDQFNTVGVGGTTLANTSTNWGWTVGGGLEYALAPSWSMALEYKYFDFGASPAFSTSVTPALDGVNLAPQSNKLQTASLGVNYKFGPSLFVRD

SEQ ID NO: 19574 - protein, 849 aa, Rhodopseudomonas palustris
MACVASLPAFAQEQPAPAQQQTPPQTDPSVSTLDEIKVVGYQASLGKALNVKRNADAIVDAISAEDIGKFPDTNVAESLSRLSGITVDRQFGEGEKVSILGTDPALNRVLLNGQTIASTSWGGDPNDPDSRSFNYSTLAPEVVGLMEVYKTPEARIDEGSIGGTVIVHTRKPLDLDRNTLTGTVSYGYNDRSDEGKPNASALYSWKNQDQTLGVLTSVMHSQRVLRRDGVEIFGYDNVQGAGFPPGVVGNNTGVFPTSINTALFQQTRKRDGVSAALQWKPDSDFELNLTGLYVKESFDNYNQSRYGYWGSTPGDAQALGFENGIATSGTFGDQSNTYLDGYLRNSQVSTGSIHLRTDWHGDGWNASSQVGYTSSQGGAERIYGIQFRNLAGYSYTIDGRRTAMDYSTDPTNAAAMQLNNASASHSPQYDKERYLQLDFDHAVEWGPFTQILTGIKLTNHAAGQSSYSRTWTPNDGSTLAAFSPGTTPSGYLDGLSTSADMQRWSTIDSGAISRYISGLEGDDGLPISYAGNYSIEEQNRAWFLQGNFSGERYRGNIGVRYVHSRDSTDGFSYAPGGGYTPVNFLSSYGKWLPSFNIAYDLRDDLMLRFAASKVIARPRYTNMTPYVATDDTTLTASTGNPGLSPYESTNLGASLEWYFSDSSLLSGEFFSRDISNYILTTVQDRVFFNNATGGSSTYQTSVPTNAGDARVRGVALNLQHNFGNGFGVVANYTYSDSKTDGDYSLPYNSRNAYNVSPYYEQGKWSARVNLGWRSEYFTQIGRLNGQQMTDAFTQVDASFGYQATERLRVALEATNLLDETYFSYIGNKNQPYYIYKNGRSFMLSLNFKL

SEQ ID NO: 19575 - protein, 424 aa, Rhodopseudomonas palustris
MRRFADCLPLFALGVPSLCMSTVVSAAFFEDSTVALTTRNYYLDRDYKGDSSVSAVREWAQGFIIKANSGYTDGPVGLGLDLTGMLGVKLDSSPERSGTQLLPIDPQTRRAQDAYSELGVAVKARFSQTNLSVGTQLPALPVITASPARLLPQTFRGSSITSSEVENLTLQAGRMDRVNLRDSTNNQLIAMASPNGRFKPGVFSDRFDYLGGEYRVSENFTARYYHANLENIYEQDFIGGIHSIAVGRGKLKTELRVFDSRESGRAEAGKVDNLNAGLTMSYQTGGHTFGMGYMYQTGDTAFAYLAGGEPVVLSDGTMSADFVNPKERTMLLRYDYNFVAMGIPGLTGMIRYLRGTNIDLPHLGGSDLTESSKDLELSYVVQSGPARDLAFRVRHAFYRNDLSSAATFRDDNETRVNVDYTVKF

SEQ ID NO: 19576 - protein, 369 aa, Rhodopseudomonas palustris
MMRITTLTKRRQTMKSRTWTMCAALLGAAASTSSFAQSSVTLYGDLDAALLYTNRSLDSATGGNAGRQFALTDTGMTPTNFGITGTEDLGGGLHARFKLESGFNITDGAFGHSNGNFFGRQAWVGIDGGFGQTKIGLQFSPFVLAILGSDPRNVSHFGAALVPYVDNVLVTGLFNPNAISYTSPTIAGLTASAMFGFGGKAGDFQAGRQYSGSLTYTNGGFMLNAALYDGNGGTSPTPVASTVAFVGRTIGAGYTFGPVTGKASFTSYKVAGSFSNNVYSAGLDYRVTPALDLNTGAWYTTDRNDSHNHSLLAAIGADYSLSKRTGLYAQVGVVNNHGAMNTGLGITGGALYGLPGTTVGVNAGIHHVF

SEQ ID NO: 19577 - protein, 775 aa, Rhodopseudomonas palustris
MIQRAFTRESARSRLLASTCGLSVALACVMTAGSSTATRAQTADSTTPRARHVLPEVRVESANPPKPQRAARSSDGRGARRAAAQAPKPAPAQQAAAATSDNSLKPMGGKLPQPGIPHAAQQSITVVDRAQIEQTSPTSLLDILQNVPGVSIARAGGIGGQIYLRGFSSNNWRSPMYIDGDRFRGRNTLQLNYFAPEEIERVEVVRGPASVVYGSEAMTGLVNVVTRRPQVDPFGPWRVTHGGFSAGYSSVDNGFSTYEWAQAAGMGFDVLGGVSYRKGGNYQTPSGPALNSDYESIGGNLRLGWSPTSNQRFELTLRDYWEEDGRAGGVGGAPGWPYMQVRQQPNQVHMAKLSYAGDFTDQLVQHVEGSFYANYFDTKLSTVNTATPGVVTSSVSHVGGPLVIGGRVQGVIPWDPAPWGLLKTTFGFDGFQEWRPGSTSWSVRQTATSSTITPEFKTGPDNTQANAGAFMLHEWKPIDLLTLSAGGRFDWFNTTSELSPVSSARALAVLRQNSDVTATAPTGSIGATVHVTPILDLLASVGTSYRYPTNSELFAFSGTSIPNPELKPETGLTYEGGFQLNFPTATFKVTAFDSHYANFLQSVFVNYNGASVTQSQNVGHATVNGVEAEWRWQATSSFNLHGNAAWLQATNTDTDAPLPFIAPWKGRVGVQYAPIGSGYAVGAAVDWASAKTRINTTQEYPTGAYAVPSIYASFDLGVLVSRRLGDTKLHLSLQNIFDTSYASASTYVNRSYSQSMYNPLLEPGRNFTARLTHTF

SEQ ID NO: 19578 - protein, 789 aa, Rhodopseudomonas palustris
MLRPLLPSLASLVTLGLSAAALASPVQLDLPAQALSRSLAQLSQASGMQISVDDKLIASKQAPAISGSLEPAQALNQLLLGSGLDTQVQGNAVRVFQPSSGGSMTLGNVDISAQAGIAGMATTEGSGSYTTGSMSSATGLPLSIRETPQSVSVITRQRIEDQGMNDLNDVVKYAPGVTLRKFGSDRQQFLARGFTIDNLMYDGLPTIVSTFTLDTISGADLALYDRVEVVRGATGLMTGAGSPSATLNLIRKRPTATPQVSVTTSAGSWDRYRTEVDASSRLNDSGTLRGRVVAAYETGNSFVDERDKERQTFYGVLEADLNESTTWTIGASKQRDDATSDWGSLPSGPNGENLHLPRSTFLSNDWAYWDRENVSVFTDLTHRFDNGWSSKLAATRIWAESDMYSNYLTASGTGYGQAAGEYDTTDVQTSLDGSLSGPFQLFGRQHELMLGVSRREEKFDQKGGFYGSTPVDIYTFNPNLIAKPDPTTRTAYVNQNTATEEGVYAAARFNPIDPLHVIVGSRVSWYDYQNRSASNGDYKVIREVTPYAGIVYDLNDTYSAYASYTEIFKPQNQLDVGGGVLDPMTGESYEIGLKGEYFDGGLNASLAVFDMTQENRAYAIVNPPVTCQQQNRVCYEAAGEVRSRGIDAEISGQLTPDWQASASYTLVLSQYVKDRTNDKGDLFAPNQPKHLFKAATSYHLPGNLNKWRVGADVLAQSETYNRVGTGHSEQDAYAVVGLMAGYRFDEHWDARVNLNNVFDEKYWQGIPLATGSGVYGDPRNLMVSLKWSL

SEQ ID NO: 19579 - protein, 160 aa, Rhodopseudomonas palustris
MVGLAPIKITPKPASDSSYTAFLWGAKGGYQFAFFKALALRGEFSYLMAIKPTALHTINTSLLSLNIDVLSDFYTYKKYSFGVYGGLGIGYFYQSNHLGMKNSSFMGYNGLFNVGLGSTIDRHHRIELGAKIPFSKTRNSFKNPYFLESVFIHATYSYMF

SEQ ID NO: 19580 - protein, 418 aa, Rhodopseudomonas palustris
MKDLKWISNFKVRFGWGIVGNDRISNYLSMDLYTDNKYGIGNSTVTVLTPKQLKNSNLKWEGSSSVNLGLDLGFFDNRLNVTADFFIKNTKDLLLAQSLAQATGFTSQWQNIGKIQNKGIELSITSTNIQTKEFTWNTNFNISFIRNELKALADGASHMYARSGFDSNFTSYDYIAKVGESLGLIYGYEFDGVYQYDDFYTDTNGNLVLKPGITQNSRYSKDKKVGARPGVTKYKDQDGDGDITTNDRTVIGNAMPKWFGGITNTFEYKGFDLSFMFQFNYGNDIYNATRLYATQSRSGRRNMLAEVADRWSPTNASNVVPAYDGYITNDVYSRFVEDGSFLRLKNLTLGYTLPKKWTNKFHASRLRVYATGQNLFCLSNYSGYDPEVNSLNNPMMPGLDWGAYPKSRVFTVGIDLQF

SEQ ID NO: 19581 - protein, 736 aa, Rhodopseudomonas palustris
MSTTTHRKMSTARALRPSRTALAITVLLAGTTSARGQEQETQAPSDTVAELPAVTVTARKREESAQSVPISMSVLDGQDSRRAASPSDGNGGLARSAPNVSFADSGGQFGNLFVIRGVGSFAPLSSDDTSVVMYLNEVPRSVYGAPPTLLDIDRVEVLRGPQGTLFGRNTQGGAINVIPNMPSFKREFSATAEAGSHGHQLGELVANGALSDTVAGRLAVRYSNLDGTVPNVAAGGKDGRTQVGAVRGSLLWLPGDNTSVTFTGFYDRRESDAPRFIWYQNPAFPQSAVNPNSDIRWRDAGASLKVEHDFDKARLTSLTSYQDDHSFQPMDMTDSLLYSAMTRRPRSLYDVPYADYVNMHFRERTMQQELRLSSLQDGPFTWTGGINIFHSRFTNDTWAVASPAAFNFQAQNGAQDNRIRATSMAAFGEGTRALTDKLKATLGLRYTYEHKKADYEFTGNGNPAVVGYSQHGMRLSDHFLTGCAGLSYEWTPEAMTYASVSRGAVGAGFPVTQTNGYAGKPETPYATSTSWTYEVGFKTLWLDKRLGLNGSVFYNNVKNGHLIVFDPSQALFTTASLDYRSQGAELEAIASLTPNLKLSTGVGYTQAELVHVPSGSSTGAQSGNRVPNMPRINGSVGLQYEAPMRIGSTSGRLTGSVAWQYVGKRAVDAKESFDLPGYGVVNARIGWQQGHWEIYAFAWNLLGNQYLVGGQAWTPTVSSVRVGQPRMVGLGATVRF

SEQ ID NO: 19582 - protein, 771 aa, Rhodopseudomonas palustris
MKLGLAGVNAGRSSMVNTLLLTSALIAPAVWPSSQAAAQDAKPQATQLPAVEVAAPEASRRQTQPARNRNRAAAGPSRRSAQRAAQAPQPAQPVQRPVFERGTDPVPGFVPSVSASGTKTDTKLIETPQSVSVISRDNLDARGIDTVAQALQYTAGVAVQTFGGDPRYDQARIRGFETNGFSNFRDGLRDTANGSAYFSVFRNEPYGVQRIDVVKGPSSVMYGQSPPGGLIDLISKRPTDHAFGEVVGLVGTADRLQGAFDVGGPIDKDKTVLYRLTGVLRDSDAQVAKFSDKVKDDRAYIAPAVTWRPTNDTTLTILSDYQHDVTGIASPLSVATVRGGKVVNMRALPLFLGDPSYNTFDQTQYRVGYQFEHRFSDDLIVRSRARYGHVDLEYRSITQAGTPLDTQTVFPRNARRVLENSDSFGIDNHVIAKTWTGPLQHTVLIGTDYQAFKLDGESFGGLAPSIDVLNPVYGQPVAMPTLRLQSYKQNLNQAGVYLQDQIKLQNWILTLGGRYDAAQQTILNRLTGVPQPNDDTAFTKRAGLTYLFDNGLAPYVSYSESFLPTGGVDFNSNAFKPTKGKQYEGGIKFQPNRDLLFTAAVFDLTQDNVLTADPNHLNYNIQTGQVNSRGLELEMLAKPMPGLNLLASYTLQNLKNTQSNNGDVGKMPVLIPRHMASAFADYTLQSGPLAGWGFGAGFRYIGESYMDILNTLTNDAYTVFDAGLHYRQPKGINLALNVKNIVNKDNAMCTATGGCQYISPRVITATASYRW

SEQ ID NO: 19583 - protein, 242 aa, Rhodopseudomonas palustris
MSNFKNMALAMVSICSTLTFSPMASAEMQWSDFSLSYLTSDQYEVGDNSRQFLTVEHASGHTWGDTFFFLDRSKYDDGTLENYAEFSPRLSLGYVTGNDLSFGIVSDVYVASTWEMGESFDNYLIGLGVSLNIPGFNYFTANVYQANNMLWDNDQMLTITWSKGFKLGSADFLYDGFIDWSTSSDSQASEMNFTSQLKYNVGQLFDLKSPVYVGIEYAYWNNKFGISGVDERSVSLLAKWHF

SEQ ID NO: 19584 - protein, 718 aa, Rhodopseudomonas palustris
MHRLLRNVCLILCWLMAVSVSAQRIISGTVFDENKEPLTGATVSVKEKVTLGTTTDTQGKYMLKLPDNREYTLQVSYMGYISQTHKVSVSKTGKVDFILKEDAVNMETVVVTGTRTPKLLKDVPIVTRVITADEIKKVDATHIGDLLQAELPGIEFSYSMDQQVSLNMQGFGGNAVLFLVDGERLAGETLDNIDYNRLNMSNVERIEIVKGAASSLYGSNAVGGVVNIISKVPAEPWTVNLNGRYGAYNEQRYGGTIGFNVGKFNSVTNVQHTQVDEKDLADGKTNEETEDWAFKKVYGDKTWNFKERLVYTANDHLKLTARAGYFFREREKSQTSKDRYRDFSGGVKGNYVLDKDKDLEIAYSFDQYDKSDYLPQDANDVRDYSNVQHSVHTFYNHTFVGKHILTVGGDYMRDYLMSYQFANNGSKHQYTVDGFAQFDWNPTKYFNVITGLRFDYYSDSDINHFSPKLGLMYKIGNCSLRGSYAGGFRAPTLKEMYMNFDMASIFMIYGNPDLKPETSHNFSLSAEYMKGRYNLTVTGFYNVVDNRITTAWSEALKGQVYTNISNIRISGAEANASVKYPCGLSARLSYAYTHENIKKGQPVISSTRPHTATVRLEYDKHWKNYAFNVALNGRFLSKVNTEEYTSNTSYEETEKVTYPAYTMWKLTLSQKVWKGVDMTLAVDNLFNYVPFRYYNNSPATKGTTFSAGLSLDIEQLFK

SEQ ID NO: 19585 - protein, 738 aa, Rhodopseudomonas palustris
MSSADRTRSLAGRMPAALLFSTGALALTTFPSAAQDRAETTTGPHAIALEELAVQGAGSGTRLLAQTPYTAAATGLNLTTPNRSGSRLDLSPLQTPASIEVISGQKIRERGQQTVQEAITQNAAGITTIGSPGNGFGAYTSRGFAGVNSVMQLYDGTRLFVGVNTTTYPLDTWNVDRIEVLRGPASVLYGDGAIGGVINVVPKKPVAVPVNAARAAIGSDGVKRLAVDSGGPVGENLFYRLNVSGNQVDGWLNQNGNFANLAVSGSLLYQATPDLAVTLSHDYGYQEPLRYFGTPLIGGRIDPRLRFQNYNIDGSRIAFEDNWTQLKVEWSPSDDIVIRNTAYRLLSDRHWRNLESYAFVPSTGLIRRTSPIEIFHHQEQIGNRFDATVKGTLFGLRNEFVAGFEVNHIDFGVRNNSPYRGENSVDPFFFNPGFFSSPDSVRPLYRSSTDQYSLFAEDRLILSDQLSLIAGLRYDAPTVRREDLVTPSQSFTKAFDALSYRFGAVFNPTPDSSLYASYATAVDPVTSLITIPITQKDFKLSAGEQVEIGYKQVFWDGRGEFTLAGYGINKRDLLTVDPLRPQVPVQVGRQSSHGVEAFLSLGLWENWRVEGNLALLHAQYDDFQQAVGGVAVNFAGNQPVNVPERIANLWLSWAFAPRWEARAGVQFVGETFSDFANTVRRPSYEVVNGSLDYRVSDTSRFSVRVYNLLDTIYPVTGSANTWLLGRPRSVEVAYNLTF

SEQ ID NO: 19586 - protein, 241 aa, Rhodopseudomonas palustris
MAYKKALAAAAGMILATAAHAQSAGSNIVSLGWFRVMPNSSSDPLQIDSVGGVPLNRSVPNTGAKIKDADTLGLAFTHFFTDNLAVELVGGIPPRHKIEGTDSFARYGQIGSAKQWSPTVLAKWYFGGADSKFRPYVGAGLNYTWFTDEKITNSAFQTQVLGNGFPSTSTVSTDSSLNPVVSAGATYAITKDWFLGLSVSYLPLKTTAKIDTTLANGQHAVTEAKIKINPIVTFLSVGYRF

SEQ ID NO: 19587 - protein, 241 aa, Rhodopseudomonas palustris
MTGPTNGCSELEFLENEMKKILLASVAFLGMAAIVPAQAADLAPRPYTKAPPYVPAPIYNWTGFYLGGHIGGAFGGPGNVLAPGFFNNNDGAFMGGGQVGYDTQFSPNWVFGIEANYSFLDTGSFFANRGLGSVTARLGYTWGPALLYVKGGYGWADSRFTNGFAGNGGRDGYTVGGGLEYLFTQNWSGKVEYQYYDLGNVNFFGPLGGIGNFRNDQHTVKVGLNYRFNFGAPAAPYAPGY

SEQ ID NO: 19588 - protein, 1025 aa, Rhodopseudomonas palustris
MTRRILPLSLVFIPLSCISASETDTLKLPNLTFGGREIEFIVTPPSSIAAQYITYANVSNYRGNFTISSCTQDQWFSRGLSTTNSSGAFVESMTSFTAIDNADLFFCNNYCTHQGGGGAINATGLISFKNNQNILFYNNTTIGTQFTGVALRTERNRGGALYGSSIELINNHSLNFINNTSGDMGGAVSTIQNLVIKNTSGIVAFENNHTTDHIPNTFATILARGGAVGCQGACEISHNTGPVVFNSNYGGYGGAISTGGQCIFRDNKDKLIFINNSALGWHNTSAQGNGAVISAGGEFGLLNNKGPIYFENNNASYIAGAISCNNLNFQENGPIYFLNNSALYGGAFHLFASPAANYIHTGSGDIIFNNNTELSTTGMSAGLRKLFYIPGTTNNNPITLSLGAKKDTRIYFYDLFQWGGLKKANTPPENSPHTVTINPSDEFSGAVVFSYKNISSDLQAHMIASKTHNQIKDSPTTLKFGTMSIENGAEFEFFNGPLTQESTSLLALGQDSILTVGKDASLTITHLGIILPGLLNDQGTTAPRIRVNPQDMTQNTNSNQAPVSTENVATQKIFFSGLVSLVDENYESVYDSCDLSRGKANQPILHIETTNDAQLSNDWKNTLNTSLYSLPHYGYQGLWTSNWMTTTRTVSLTNSTETQTANNSIQEQKNTSETFDSNSTTTAKIPSIRASTGGTTPLATTDVTVTRHSLVVSWTPIGYIADPARRGDLIANNLVSSGRNTTLYLRSLLPDDSWFALQGSAATLFTKQQKRLDYHGYSSASKGYAISSQASGAHGHKFLFSFSQSSDTMKEKRTNNKISSRYYLSALCFEQPMFDRIALIGAAAYNYGTHKTYNFYGTKKFSKGNFHSTTLGGSLRCELRDSMPFQSIMLTPFIQALISRTEPASIQEQGDLARLFSLKQPHTAVVSPIGIKGVYSSNKWPTVSCEMEVAYQPTLYWKRPILNTVLIKNNGSWETTNTPLAKHSFYGRGSSSLKFSYLKLFANYQAQVATSTVSHYMNAGGALVF

SEQ ID NO: 19589 - protein, 566 aa, Rhodopseudomonas palustris
MRLTKLIYSTLFFITAGALTLQAQETKTDKKDENKAVTEEIEVVRPYKPVLAEAVKLRRSPDLNTVKTYKAKFNYSLTDRKLGLNSDINKLQAQQVAEERAAELLNNYVKAGFGAPTTALLEGYVNIGRDEALQAGAFFRHFGQSGKLEGQDANQQQLSVFGRSIGETFTLSGRINYQRNGINFYGFNPSQPEFNLHPERQTLNFIEAEGEIVNKFTDDPDAFSYAAKINGYIWNDKYEAKEKSVVINGYVNKRISSFNLGLASSVELGNTQDQLTDVGNNIFKLNPYIKLQANGVKINAGINFVQEFGDFSSSRIFPAVTADFTLIPDYLQIFGELKGDVNRNSMKAFTDENPFLNANINIKNSIEKFSFSGGIKGTGGPGFGYKARIYHKKIADMPLFVNNFENPTRFDVIYDFGNMKQTGLEGEISIQVSNSLKWTGKLNFDDYQPAEESNSWFKPQMRLSSDLLFNITDKIAFNASVAIQDASKAKIYTAAPASPYLVPDPANETVVEVKGFVDLGAGASYKINNKFSAFARVNNLLGTKYSRFLYYPTIGGSVFGGLSYSF

SEQ ID NO: 19590 - protein, 2276 aa, Rhodopseudomonas palustris
MRAARLLWKFKNMQRAQSVRRGLSVNVPSMRQTALRMAIVSALGACGWAAATAAQAAQCWSTTDNNEVPAGNYSYAFTQCSGDDADDDNKTGETGPDVPMTVYGDFSADSTIYSEGAGYDGFTGSPGVVTAYSRGGQGYDEGSGGQSGYVTVTNYGNITYDGTAANTFNSLVQARSLGGSGATDNHNNDSNGGDGGLGQAVSVTNSGTLTMNSSALTSEEGLFGIYALAAGGNGGNQNDPTLDYGDQWGGNGGNASTVTVTDTGVINLGNSAARLLTNTAGAAIFAQSAGGQGGDNNGNAGTGGTVQVVHKGSTSSYWQAYADAQVFGINALSIGGDGTASSDNSDNGGNGGGDSSSWTQQVTVDAYGSIVLDVANSSSDVTVEGAGIAARAIGGKGGMGPPKDHSGGNGGTGGSAIVNMYSEASVTTHGDNILGVVAQSLGGQGGDGGDGTALAGQGGGGGFGGNASDVYISAQSGAAISTTGDFATGMLAHSIGGGGGTGGDFVAVLGGQGGNGGNGGDAGQAAISSLATLSTTGDHAYGMLAQSIAGSGGAGGVDTSAAVALGGDGAGGGAANQVNITNYGTITTGGYSAHGIVAQSIGGGGGAAGSANGALSVGGNAAGETPSSGGSVWINNQAAITTTGDAAVGMLAQSIGGGGGSGGDANGVVTVGGSGASAGDGGTVSIAQGFGNIQTFGNYSAGVLAQSVGGGGGNGGDTLSLSAGAALAIGGTGSSGGNGGSVCIANDSACDIPPYGFLTTVATHGNYAPGVIAQSVGGGGGNGGSTKTDAVESFLALQLGGKAGGGGVGGSSVVSLESLVAATGGAHSIGVLSQSIGGGGGTGGAANYTTEDLGFTAAVVVGGGGGAGGDGGASTVKLTKSFVGTGMDFASPDIDPETYAPNDAFGILAQSIGGGGGSGGSSVANELVAAVPTGEGASVAFTFSAAVGGNGGSGGDACPAGDATCATSVTLVQGTTVATLGDGSHGVVAQSIGGGGGNGGDASTLSALLGDENTLSLQAGMSLGGQGSAGGDGATVNVSLGDSGAAYAAAPPSLRLPPSASGVPASSIITYGNYANGVLAQSIGGGGGNGGVGSSNSYAHGGPATLKVNLALGGTGGSGGVGGDVNITLNPNFTIRTLGSGSRGIVAQSIGGGGGASQGGTMSVAAGLDEDSPSGRLQLGLGANGGSGNVAGKVAATLLGAIRTEGGDADGVLLQSIGGGGGLGGSIGADASSNPILDRIGIHSDNSARLDDTGATYVFGVDVGGTGGTGGHGGEVDLTFAGQIATSGDWADGLVAQSIGGGGGTGGSSTATGSKVSANATIGVGGNGGVAGDGGTITAYFDGSHNNKIATAGYSAYGVLLQSIGGGGGQGADGSDQAHGTITVGASFGGSGGIAGDGGTIQSPEGQDAGWLAVATQGDDAVGLAMQSIGGGGGIGGAGNSSSRYLEQDSHAMQLSVGGNGGLAGAGGTVDMTFGINASTQGDRAYGLLAQSIGGGGGLAGAGSANNLTSVTLGGRNGATGDGGAVSLALNAGSVISTTGAGAHALVAQSIGGGGGIAGDTAQAVQLDASHWQPSGTNSGGSAVTGGSGNGSAVTVDVNGSIVTSGAGAFGILAQSIGGGGGLGGGLVPDGAGDGGTISQGFAGSTGGSGSGAEVTVTQAGSIVVAGAGSTGIFAQSAGGDGAGAVTVNVNGSVTGGSGSSGYGVWVASPAQNVLNVGADGQIIAGQGGAAVRHDGAALSGAGAALAPAGAATLAINNAGSIRGNIECQNGGGVACDVDNARGGFLGDATLYQANIDNAGRVVIGKAGAFDTLTVTGDFTLQSGGILQADVDFERLKAPHMVVQGDTRLDGQLDVQPITLLPGREVTVATLEGGIQGVPQVLDSAVIDYDARLQGNSVRVRAASADFAAPSMGLGDNPRAVARHLQRAWDLGGNAAMAPLFAALDTASRGGADAYSDQLSDLSPGVAVAPAAQMQASMARFAGAMMSCPAFLAGDALTGEQDCLWGQVSGLSTNQDGDGGVSGFSLDGVTYQFGGQRQVSPGWFLGGSVAYENTHLRGDDGRVSGKGDSGYAGVVLKREAGPWTFSAGLGGGYGQYDVDRRIRIPGLQSTARSSPDIYGAALRLRIARTFASDQFYLKPYVDLDALYTHMPRYSESGNALHLDVESSNEFVLGLSPMLEVGGKVSLDNGAVMRPFAYGGVSFLSKDEYTARARLQGAPDGTGSFETSLPVDDVIGRLGAGLQVSNAGGVDFRLQYDGEFSSHIQSHRASLKLMVPF

SEQ ID NO: 19591 - protein, 134 aa, Rhodopseudomonas palustris
MALLNIFDIAGSALTAQSQRLNVAASNLANADSVTGPDGQPYRAKQVVFQVNAAPGAATGGVKVADVIESQAPDKLVYEPGNPLADAKGYVKMPNVDVVGEMVNTMSASRSYQANVEVLNTVKSMMLKTLTLGQ

SEQ ID NO: 19592 - protein, 1343 aa, Rhodopseudomonas palustris
  misc_feature (819)..(891): Xaa can be any naturally occurring amino acid
MTPAVATAQAAHQAFSIPAQDLGRALTAYSRATGLQVAARPALLQGRRSQAVEGRFSQADALARLVGGSGLTARIVGDAVLIEAAPSAPVRAAPARPAANAATRSAPPPLGTPGGVEALDEVIVTGTRQASRTAAETLSPVDVLSQEEIRESVSGDLQDTLTLLAPSFNVQRLHADPPAFVRPTTMRGMPGKYVLALVNGRRYHNSAQGQAPDLSTIPSASIRRTEILRDGASAQYGSDAIAGVINIILDDRPGLRAFSQFSRYYQGDGEEYRFGLGGGLALGENGSISGALEYNRQGRTGRQVQRPDALAFELAHPGVELRDPVQKWGQPEEERLKGSLNANYRLSGNHELYAFGLFNDSEGMTDFNWRNPDATSNVYKATAAFPGFSFLSIFPGGFTPQFGSKIEDYHLSGGVRGDLSDRLTYDLALTWGTSRVAFSLDDTVNASLGPKSPTSFFLGREYQDDFVANADFVYRLPVGGSEPLNIAFGAEARVVTYGVQVGDKASWEIGPGAAYGLAVGSNGMPGYSPARAGEWDARSYAAYVDLEWRPVEALTLGAAGRYEDHDSFGGNFDYRLAARYELPVGLAVRGTYSTGFRAPKPFDLYSSAFTQSLNLTNGSVNNSGRLNVNDPLAISLGAQPLKPETSKNSALGVVYNNHGLTLSIDVYRVDSKDRLTTRSMSVPAGTPNPQNFTSLSYFMNAYEARTQGVDIVAAYRRDIGPGRFNTSLSYNQNETEILDDRLAPLNPLNKELFARRSRPGAGVSAGFGYDLGSLSVSSRIRYYGTWIDMGTDPDDADRLWQEFDPMVLANLSVSYDFAXXXXXXXXXXXXXXXXXXXXXXXXXXXXXXXXXXXXXXXXXXXXXXXXXXXXXXXXXXXXXXXXXXXXXXXXXPSRSSRRCSSVRAIAEISMLELNRRALLAGGVVLPAGAALTPTPARAASDDDAFWRDIAAEYDVTRDVIQLENGNWGMMPRPVHAHYVEVLSRVNRETSYYARRGMGRDLMDVRSRLAETLGVPDDEIAFTRNATEALKALIGGYNRLTPGDAVLYADLDYDSMQHCMDRLALRERAEVVRIALPEPATRMRLIDAYAEAFDRHPHVRLVLLTHVSHRTGLVLPVREIAALARERGIDVIVDAAHSWRQLDFALPDLDCDFVGLNGHKWLAAPLGVGVLHIRKSALDRIDHDLATASDAPDVISERIHTGTLNAAAFLTVPSALAFETRIGLDRKSARLRALRDRWVEPARAIPGIEILTPDEPGLYGAITAFRITGQTSMRANEAIARQLLDRHRIFTVARGGVDRGGCVRVTPNLFNTMQEMDFLAGAIANVVRTLPDLPTPKASRDSRG

SEQ ID NO: 19593 - protein, 691 aa, Rhodopseudomonas palustris
MKRVMLKWMAVLIMLLLSTKGFAKDIQAETSYKLDTVVVTAKRTEERLRDVSQNMTVFTQNDIAQSGAVSVTDLLKKAGIQVYSDGGAGYGNEGVVIRGGRSSMHGFDIAGDILVLVDGHRTGSDFLGNIGLENTERIEVIRGPGAVQYGAAAMGGVINIITKRGREKPEGFVEAGAGSWGEQRYKAGISGKEGNLDFAGSMAYFSRDDYELGNGDTYENSDVEDRVRYNFNTGWNFNDNHRLGLIIQGSDTNDAGKGEDAARTYYYYTRQDRDNHTIDLSYKGRNEAGATTWLTRYFQGEVNYDLKRFTSSSTTRLPLSENSNRFRGSQAQVSHDFGRFSTVAGMDWMSYEFDQRQDGDAAGSSTRNTAQSDFDNISGFLMGDVHLLENRNLTLSAGIRYDVFDVSVNARKIKEDVTVSREVDKHSWNPSFGVAYSPTDFLKVRANYATAFKMPLPRQLTGYTVMMSTPFIGNPDLEPEKSDNYDLGFDLDWKSLFVSATWFYSDYQDMIGYETHNSADEHYSGKHYWYYNVDSAEIQGIELGMKLDLAHTLGWSFQLEPYVNWTHLLVFEDGNGYKLPDRSRDSLSAGLVFGSEEAGLTAGLDATYYGTQYAVDRESGSSTVGSQEKLENVGDAWVIDFSCTQRLFKFENSREVRLKASIHNLFDEFYSTDEDDWMPGRSFYLGVEFRL

SEQ ID NO: 19594 - protein, 180 aa, Wolbachia endosymbiont
SYYVRLQYNGEVLPFKTKIDGVTYKSGKENNSPLKASFLAGGGAFGYKMDDIRVDVEGLYSQLSKDADVVSDDKAADSVTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVLYSTVG

SEQ ID NO: 19595 - protein, 199 aa, Wolbachia endosymbiont
GPISDEETSYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVAFNF

SEQ ID NO: 19596 - protein, 203 aa, Wolbachia endosymbiont
GPISDEETSYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTVGAEAGVAFNF

SEQ ID NO: 19597 - protein, 199 aa, Wolbachia endosymbiont
GPISDEETSYYVRLQYNGEVLPPFTKIDGIKKASGQENNSPLKASFIAGSGAFGYKMDDIRVDIEGLYSQLTKDATVIDSTESNVAVNLTAFSGLVNVYYDIAIEDMPITPYVGVGVGAAYVSNPSKADAVKDQKGFGFAYQAKAGVSYDVTPEIKLFAGARYFGSYGAHFDKATTSDAGIKGVLYSTVGAEAGVAFNF

SEQ ID NO: 19598 - protein, 196 aa, Wolbachia endosymbiont
GPISDEETSYYVRLQYNGEILPLFTKIDGIVRKAGKDNDSPLKPSLMAGGGAFGYKMDDIRVDVEGLYSWLNKDAGVVDDTVADNLTAISGLVNVYYDIAIEDMPITPYVGVGVGAAYISTPLKTAVSSQNGKFAFAGQARAGVSYDITPEIKLYAGARYFGSYGANFDKTDKDGKGELKVLYSTVGAEAGVAFNF

SEQ ID NO: 19599 - protein, 147 aa, Wolbachia endosymbiont
GPISDEETSYYVRLQYNSEVLPFKTRIDGIEYKKGTEVHDPLKVSFMAGGAAFGYKMDDIRVDVEGLYSQLNKNDVSGATFTPTTVANSVAAFSGLVNVYYDIAIEDMPITPYVGVGVGAAYISNPSEASAVKGQKGFGFAYQAKAG

SEQ ID NO: 19600 - protein, 346 aa, Shigella boydii
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 19601 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCLGSYGANFGKTAKDDGGIKVLYSTVGAEAGVAFNF

SEQ ID NO: 19602 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEAGVAFNF

SEQ ID NO: 19603 - protein, 146 aa, Wolbachia endosymbiont
WSISDEETSYYVRLQYNGEVLPFKTKIDGVTYKSGKDNNSPLKPSFLAGGGAFGYKMDDIRVDVEGLYSQLSKDADVVDTSPAVVESLTAFSGLVNVYYDIAIEDMPITPYVGVGVGAAYVSNPLVTEITGDKKSGFGFAYQAKAG

SEQ ID NO: 19604 - protein, 198 aa, Wolbachia endosymbiont
WSNKDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEAGVAFNF

SEQ ID NO: 19605 - protein, 198 aa, Wolbachia endosymbiont
WSNKDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGSGFAYQAKAGVSYDVTPEIKLYAGARYIGSYGANFGKTAKDDGGIKVLYSTVGAEAGVAFNF

SEQ ID NO: 19606 - protein, 198 aa, Wolbachia endosymbiont
GPISDEETSYYVRLQYNGEVLPFKTKIDGVTYKSGKDNNSPLKPSFLAGGGAFGYKMDDIRVDVEGLYSQLSKDADVVDTSPAVVESLTAFSGLVNVYYDIAIEDMPITPYVGVGVGAAYVSNPLVTEITGDKKSGFGFAYQAKAGVSYDVTPEIKLYAGARYFGSYGANFGKTAKDDGGIKVLYSTVGAEAGVAFNF

SEQ ID NO: 19607 - protein, 364 aa, Pasteurella trehalosi
MKKSLVALAVAGFAVASANAAPEANSFYVGAKAGWATFHHGVNQFNSKYANDERYSDGPTAYGINRNSVTYGVFGGYQIIDNLAVELGYDYFGRVRGNVGDRRAFKDTKHGAHISLKPSYEVVSGLDLYGKVGAALVRNDYKDYYANGTKDKSHNLKTSLILGAGVEYAITPALAVRLEYQWLSRAGNYGKAEAKAGNVTDLRYSPDAHSVSAGLTYRFGQGAAPVVAEPEIVTKNFAFSSDVLFDFGKANLKPAAAASLDAAHAEIQNLGLAAPAIQVNGYTDRIGKDAPNLALSQRRAESVANYMVSKGVAPESITAVGYGKANPVTGNTCDAVKGRKALIACLAPDRRVELQVQGSKEVAM

SEQ ID NO: 19608 - protein, 364 aa, Pasteurella trehalosi
MKKSLVALAVAGFAVASANAAPEANSFYVGAKAGWATFHHGVNQFNSKYANDERYSDGPTAYGINRNSVTYGVFGGYQIIDNLAVELGYDYFGRVRGNVGDRRAFKDTKHGAHISLKPSYEVVSGLDLYGKVGAALVRNDYKDYYANGTKDKSHNLKTSLILGAGVEYAITPALAARLEYQWLSRAGNYGKAEAKAGNVTDLRYSPDAHSVSAGLTYRFGQGAAPVVAEPEIVTKNFAFSSDVLFDFGKANLKPAAAASLDAAHAEIQNLGLAAPAIQVNGYTDRIGKDAPNLALSQRRAESVANYMVSKGVAPESITAVGYGKANPVTGNTCDAVKGRKALIACLAPDRRVELQVQGSKEVAM

SEQ ID NO: 19609 - protein, 364 aa, Pasteurella trehalosi
MKKSLVALAVAGFAVASANAAPEANSFYVGAKAGWATFHNDVNQFNSKYALDERYAGGPTAYGINRNSVTYGVFGGYQIIDNLAVELGYDYFGRVRGNVQVDEQDSKAVKHTAHGTHLSLKPSYEVVSGLDVYGKVGAALVRNDYKNYVDQEKSHNLKTSLLLGAGLEYAITPALAARLEYQWLSNVGNFNKAESKENRLRNVTYRPDIHSVSAGLVYRFGQGAAPVAAPEIVSKNFAFSSDVLFDFGKANLKPAAAASLDAAHAEIQNLGLAAPAIQVNGYTDRIGKDAPNLALSQRRAESVANYMVSKGVAPESITAVGYGKANPVTGNTCDAVKGRKALIACLAPDRRVELQVQGSKEVAM

SEQ ID NO: 19610 - protein, 243 aa, Pasteurella trehalosi
MKKSLSLLAVLAVVGFASTPVQAADHYVSGMAGISWMQDSSIDLPLNLNEVFGVGIDLGYSSGFTAVGAVGCDYGSTRLEAEVGYQTNDIDSITGSFDGDSASLALSGNAKVLSLMANGFYDFDLGGVELYAMAGIGVAQVSINDLTLADTNDLGISADDIDDANEYLSRRLGAPVDLNALGLNVNETTLAYQVGAGLAVPIGDGIMLDARYRYFATTDFTMPLDLNTNISSHSALLGLRVNL

SEQ ID NO: 19611 - protein, 343 aa, Haemophilus influenzae
YVGAFAASAAPAAVVYNNEGTKVELGGRLSVIAEQSTSTEDDQKNQHGTLRNQGSRFHIKATHNLGDGFYAQGYLETRFVSDYLRDGADNFSEIITKYAYVTLGNNTFGEVKLGRAKTIADSITTAEDKEYGLLSSKKYIPTSGNTIGYTFNGIDGLVLGANYLLAQERDIDSQNYGASHTQAGEVAIGSISNGIQVGAKYDANNIIVGIAYGRTNYKESTNARQTNSKKQELNGALASLGYHFSDLGLLVSLDSGYAKTKNYQAKHEKRYFVSPGFQYELMEDTNFYGNFKYERTSVDQGKKTREQAVLFGIDHKLHKQVLTYIEGTYARTRTAPNNSKEKV

SEQ ID NO: 19612 - protein, 343 aa, Haemophilus influenzae
YVGAFAASAAPAAVVYNNEGTKVELGGRLSVIAEQSTSTEDDQKNQHGTLRNQGSRFHIKATHNLGDGFYAQGYLETRFVSDYLRDGADNFSEIITKYAYVTLGNNTFGEVKLGRAKTIADSITTAEDKEYGLLSSKKYIPTSGNTIGYTFNGIDGLVLGANYLLAQERDIDSQNYGVSHTQAGEVAIGSISNGIQVGAKYDANNIIVGIAYGRTNYKESTNARQTNSKKQELNGALASLGYHFSDLGLLVSLDSGYAKTKNYQAKHEKRYFVSPGFQYELMEDTNFYGNFKYERTSVDQGKKTREQAVLFGIDHKLHKQVLTYIEGTYARTRTAPNNSNEKV

SEQ ID NO: 19613 - protein, 159 aa, Haemophilus influenzae
YTKVEGITNVTGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDAGIK

SEQ ID NO: 19614 - protein, 266 aa, Yersinia ruckeri
LLVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASY

SEQ ID NO: 19615 - protein, 185 aa, Wolbachia sp. ZJ-NB
SYYVRLQYNGEILPFYTKVDGITNATGKEKDSPLTRSFIAGGGAFGYKMDDIRVDVEGLYSQLAKDTAVVNTSETNVADSLAAFSGLVNVYYDIAIEDMPITPYVGVGVGAAYISNPSKTDAVKDQKGFGFAYQAKAGVSYDVTPEIKLFAGARYFGSYGASFDKAAKDDTGIKNVVYSTVGAEA

SEQ ID NO: 19616 - protein, 234 aa, Haemophilus influenzae
ASKGNGRGPYVQADLAYAAERITHDYPEPTGAKKAQLSTVSDYFRNIRTHSIHPRVSVGYDFGGWRIAADYARYRKWKESNSSIKKVTEDIKDNYKETKTEHQENGTFHAVSSLGLSTIYDFQISDKIKPYIGVRVGYGHVRHQVRSVGQETITVTPKPKNGTQGGPVKSTSPIPAYHENRSSRRLGFGAMAGVGIDVAPGLTLDAGYRYHYWGRLENTRFKTHEASLGVRYRF

SEQ ID NO: 19617 - protein, 733 aa, Escherichia coli
MMISKKYTLWALNPLLLAMMAPAVAQQTDDETLVVSANRSNRTVAEMAQTTWVIENAELEQQIQGGKELKDALAQLIPGLDVSSQSRTNYGMNVRGRPLVVLVDGVRLNSSRTDSRQLDSIDPFNIDHIEVISGATALYGGGSTGGLINIVTKKGQPETQMEFEAGTKSGFNSSKDHDERIASAISGGNDHISGRVSVAYQKFGGWFDGNGDATLLDNTQTGLQYSDRLDIMGTGTLNIDETQQLQLITQYYKSQGDDDYGLNLGKDFSAISGASTPYVSKGLNSDRIPGTERHLISLQYSNSDFFGQELVGQVYYRDESLLFYPFPTVNANKQATAFSSSQQDTDQYGMKLTLNSKPLDGWQITYGLDADHERFTSNQMFFDLAQASASGGLNNQKIYTTGRYPSYDITNLAAFLQSSYDINDIFTLSGGVRYQYTENKIDDFIGYAQQQQIAAGKATSADAIPGGSVDYDNFLFNAGLLMHITERQQAWLNFSQGVELPDPGKYYGRGTYGAAVNGHLPLTNSVNVGDSKLEGVKVDSYELGWRFTGDNLRTQIAAYYSISDKSVVANKDLTISVVDDKRRIYGVEGAVDYLIPDTDWSTGANFNVLKTESKVNGSWQKYDVKVASPSKATAYIGWAPDPWSLRVQSTTSFDVSDAEGYSIDGYTTVDLLGSYQLPVGKLSFSVENLFDRDYTTVWGQRAPLYYSPGYGPASLYDYKGRGRTFGLNYSVLF

SEQ ID NO: 19618 - protein, 967 aa, Uncultured marine gamma proteobacterium EBAC20E09
MKNFRFAEKIIMKNYLLICFLFLGNLVFSQESKISGTVLDNLSQPMPGVSIAIKGTNKGTITNFDGEYAVEASLGQTLVFTFMGFDPREVVIDQTLIDIQMVAGTMLGEVVLIGSRSPSRTVIESAVPVDVLDIKKISTAVPQVNLNQMLNYVAPSFTSNTQTIADGTDHIDPASLRGLGPDQVLVLINGKRRHNSSLINVNGSFGRGSVGTDLNAIPVVAIQRIEVLRDGAAAQYGSDAIAGVINIVLNESVGELDLNITSGANFSKNANKQTGGIDGETINVAASYGIGLGDKGGFINFSGDFDYREPFNRMAEWEGSIFNAYNAIERVGLSNGIDISNLSNSQIQQLGQQVSYFDSNFKNEIASANDRSALQDLLSMDVTESELDARGQQRSDYNMRVGQSALRGGRFFANLSLPIDDAGTELYSFAGISSRRGESAGFYRLPNQSRTYTPVYINGFLPRINSKIKDQSLAVGIKGIVGDWNVDFSNTYGQNRFDYLISNTSNASLESASPTSFDAGGFSFAQNTTNLDISQYFVDIYKGLNVAFGAEHRLEKYDIVAGERASYEQYTENGDVINNATQIPAQDFFGNTRRGGSQVFPGFSPENEISRERTSIGGYFDVEVDFTDKFLLAFATRFENYSDFGSTINFKIASRYKLSENVNIRGSVNTGFRAPSLHQLNFNSTSTIFNDEGEPVQVGTFSNDSRAAQLLGIPELKEETSSSLSVGLTAKIPDANLSFTVDGYFVAIDDRVVYTGQFRGPGTGTELDQLLSQANATAAAFFANAINTESKGIDAVITHNTVFGKNLRLKSDLAATFSKTKQVGDILASPELERAGLVDTYFPEDSRIYLEEAVPRTKVNLSNSLAAGKFNFFLRNVYFGKVTEASSDPLRQQEFSGKVITDLSVSFKATEALTLTIGSNNIFDIYPEAADPAFGNRSSGRFDWSRSAQQFGFSGRFLFARVSINLK

SEQ ID NO: 19619 - protein, 198 aa, Uncultured marine gamma proteobacterium EBAC20E09
MKKFLMTAVLGMFALAGFSQVKWDARVGMNFSNITKDSEAKALPGFNLGVGMDYGFSENWSLQSGLIISSKGYKYDAEDAHDYSYKARPIYLDIPILAAYKFNISDNTKFVINAGPYLAFGLGGKYKYDEGEDVKIFKDYDKKKGWKRFDLGIQYGIGLELNDRYLINLTGQNGFISPADGGENPKNMTFSIGVGYRF

SEQ ID NO: 19620 - protein, 728 aa, Uncultured marine gamma proteobacterium EBAC20E09
MHTPSIPMRLTLLAFCCSIGSPAWTATAAASQQEGPMVLGETDISADKADPHALPPVYAGGQVARGGQLGVLGNADVMDVPFTMTSYTEQLIEDQQAEDIGDVLLNDASVRQSSGYANASKIFVIRGLKLTTDDISYNGLYGVLPRQIISTDALERVEVFKGPNAFINGVTPTGSGIGGGVNLQPKRAQDTPTRRFTTDISSDGRVGEHLDLGQRFGEGNRFGARLNLSQREGETGVEDEEHRSKLFALGLDYQGNNFRLSGDFAYQKQRINQNRNMVFVGSGLTRVPHAPDADTNYAPNWTWTETEDTFGMSRAEYDLNDDWTLYAAAGAKHTRENGIYGSPTINDAAGNITASPSSIPHDEDNKTAMAGINGKLQAGAVSHKVNFGLSGIWTEQRSAYLFGSPAGSNLYNPVETTRPALDSFSGGDLSDPGIIGKSRMRSVAFSDTLGFFDDRLLLTAGLRRQQLRVQGYDYGSGPRNALYDEAITTPVYGLVFKPWRYVSFYANRIEGLAQGPTAPSTVTINPGEVFAPARSKQIEAGVKLDMGTFGASLGVYRIEQPTDGYQIQDGSGTRYVRDGEQRNRGVEMNVFGEPVSGLRLLAGLTLMDTEVSGTSGGSNDGNRAIGVPTFQFNAGADWDVPGIAGAAINARMLRTGGQYVDAANNLSIPTWNRFDLGARYTFNVAQKDVTLRANVENLMNKDYWASANGGYLTQGEPRTLKLSGTIDF

SEQ ID NO: 19621 - protein, 197 aa, Wolbachia endosymbiont
GPISDEETSYYVRLQYNGEILPLYTKVDNITYTSGQENNSPLKASFIAGGGAFGYKMDDIRVDVEGLYSQLTKDTTVVNDSSAADGVTAFSGLVNVYYDIAIEDMPITPYIGVGVGAACLSNPSKATGVSDQRGFGFAGQVKAGVSYDVTPEIKLYAGARYFGSYGASFKKATTSTTNDINVLYSTVGAKAGVAFNF

SEQ ID NO: 19622 - protein, 443 aa, Pseudomonas aeruginosa
MKVMKWSAIALAVSAGSTQFAVADAFVSDQAEAKGFIEDSSLDLLLRNYYFNRDGKSGSGDRVDWTQGFLTTYESGFTQGTVGFGVDAFGYLGLKLDGTSDKSGTGNLPVMNDGTPRDDYSRAGGAVKVRISKTMLKWGEMQPTAPVFAAGGSRLFPQTATGFQLQSSELEGLDLEAGHFTEGKQGTTTKSRGELYATYAGETAKSADFIGGRYAITDNLSASLYGAELEDIYRQYYLNSNYTIPLASDQSLGFDFNIYRTNDEGKAKAGDISNTTWSLAAAYTLDAHTFTLAYQKVHGDQPFDYIGFGENGSGGGGDSIFLANSVQYSDFNGPGEKSWQARYDLNLASYGVPGLTFMVRYINGKDIDGTKMSDNNVGYKNYGYGEDGKHHETNLEAKYVVQSGPAKDLSFRIRQAWHRANADQAEGDQNEFRLIVDYPLSIL

SEQ ID NO: 19623 - protein, 144 aa, Salmonella gallinarum
GSNQENGAFPSLTVFFDPLGADSANGLVEKILRPRFHAGASVATSSTGVSEIYSGLSWTADVTERFFVEIGAGATVHDGNLNDDGSEGPKLGCRLLFREYAAAGYRFDDHWNLSATVEHASNANLCDGPNDGLTRAGLMLGYEF

SEQ ID NO: 19624 - protein, 998 aa, Ornithobacterium rhinotracheale
MLCITHAHAQSVSSLKQALQEFSKARKVRFAYEHQLIAGKTVSYDARQLNTGTTEVALKLLLQHTGLGFEQIGKDYFTILKVPVASEKSLETKPALTIIEENIAGTSAGATHISVSGKVSSASSGRPIDHATVGIAQLGISSMTDEKGEFNFADLLPGRATVKVQFLTMAMQERELQLEAGKSYRLNFLLEDNVLNLKEVVVVASESKAGSATASLISQKAIEHLQATSLNDVLQLLPGALASNPDFSNVNRAAIRQINANNMGSLGTAVLINGIPVSNNANLQVLNPATGGANASFSTSTGSGTDLRQISADNIESVEVIRGVPSVEYGDLTNGAILVKTKAGVSPLQLKARINPVLTQFWLGKGIDLGAEGGSLNVDFDYTKAYTDQRYSFDAYNRVTGSLLYSKRFFKEQPLMTTTGFSYAMNLDELKQDPDDLKTHTVRSAQDYAYRFNTSGRWNLNRRFARMLNYDVSVNYAIQKGFQQELLSNYIYPISTATKDTTMAGQYVPSEYLSKVWIDGKPMNLFAKLSNSFYLKTGAFGHRFLMGGEWRMDANFGAGKTFDTSRPPRMGNGAANRLFSYKDIPALNQLSLYAEDNISATILNRELRIQAGLRFDQMQPFGIAGGNMGNVLAPRVNFAYELAKKVNLRAGYGTTAKAPTLLYLYPQDAYFDLLNLNYYADNPAERLVIVTTRVFNTRNEQLKIATNKKMELGFDVTFMEDKRLAVTAYSERLKNGYSFNTTFESLRMVPLASYEVASAPVGQPPVLNPVPVSVSNFAVDYNMPTNELETRNKGLEFDLDLGRFEAIRTSFVLNGAWMNTDTRSTGYYIIKRQLSNSEPERIPVYAPGRGNEYSRTSTTLRMIHHIPQLRFIVTLAAQTIWSDKNKYIGYESLPVAYISNTDGQLTWLSEAERNNPAIVNNAELNLHVQPEYYKTESWKPLWLFNLRLTKEMGKAISFSFFANNVLMDRPLEESSRWTGQYSRRNPRLFFGTELSIKF

SEQ ID NO: 19625 - protein, 383 aa, Enterobacter aerogenes
MKRNILAVLIPALLAAGAANAAEIYNKDGNKLDLYGKVKAMRYLSDADSNASNNADKSYTRIGFKGQTLINDQLTGYGQWEYNFSLSNSESSSDAQSGNKTRLGFAGLKLKDYGSVDYGRNYGVIYDVEAFTDMMPEFGATGYTRTDTYMLTRGNSMLTWRNSDFFGLVDGLKIALQYQGKNEGSGTRATNVSNGDGYGASLSYKIVEGLTINGAMSSSNRLNANSASSTTSQKMAAYGSGGRAEAWATGLKYDANGVYLAGTYAETRNTNPFSGASYTFAGNSTATAVSGYANKVQNTELVAQYQFDSGLRPSLAYVQTKAKDIENGIGDADLSKFVDVAATYYFNKNMSAFVDYKVNLLSDSNKLHLNTDDIVAVGLVYQF

SEQ ID NO: 19626 - protein, 358 aa, Enterobacter aerogenes
MKRNILAVVIPALLVAGAANAAEIYNKNGNKLDFYGKMVGEHVWTTNGDTSSDDTTYARIGLKGETQINDQLIGYGQWEYNMDASNVEGSQTTKTRLAFAGLKAGEYGSFDYGRNYGAIYDVESATDMLVEWGGDGWNYTDNFMTGRTNGVATYRNSDFFGLVDGLSFALQYQGKNDHDRSIRKQNGDGFSTAATYAFDNGIALSAGYANSNRSVDQKRDGNGDKAEAWATSAKYDANNIYAAVMYSQTYNMTPEEDDHFAGKTQNFEAVVQYQFDFGLRPSLGYVQTKGKNLQARGGFGGGDTDLVKYVELGTWYYFNKNMNVYAAYKFNQLDDNAYTRAAGVATDDQAAVGIVYQF

SEQ ID NO: 19627 - protein, 358 aa, Enterobacter aerogenes
MKRNILAVVIPALLVAGAANAAEIYNKNGNKLDFYGKMVGEHVWTTNGDTSSDDTTYARIGLKGETQINDQLIGYGQWEYNMDASNVEGSQTTKTRLAFAGLKAGEYGSFDYGRNYGAIYDVESATDMLVEWGGDGWNYTDNFMTGRTNGVATYRNSDFFGLVDGLSFALQYQGKNDHDRSIRKQNGDGFSTAATYAFDNGIALSAGYANSNRSVDQKRDGNGDKAEAWATSAKYDANNIYAAVMYSQTYNMTPEEDDHFAGKTQNFEAVVQYQFDFGLRPSLGYVQTKGKNLQARGGFGGGDADLVKYVELGTWYYFNKNMNVYAAYKFNQLDDNAYTRAAGVATDDQAAVGIVYQF

SEQ ID NO: 19628 - protein, 387 aa, Neisseria meningitidis
MRKKLTALVLSALPLAAVANVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYKPAYVDEKKMVHAAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 19629 - protein, 141 aa, Yersinia pestis
TGQSGMTYRLGLSWDWDKSWWQTSTGRLTGYWDAGYTYWEGGDEGAGKHSLSFAPVFVYEFAGDSIKPFIEAGIGVAAFSGTRVGDQNLGSSLNFEDRIGAGLKFANGQSVGVRAIHYSNAGLKQPNDGIESYSLFYKIPI

SEQ ID NO: 19630 - protein, 743 aa, Uncultured marine bacterium 580
MNIKKSIALFIMSLGTGLGLVQAQQGSIKGKVVEKAQGKEQALVGASVYWANTTTGVSTNAQGTFTLAKVSTTQQLVVSYTGYRNDTIEVANRNEIKVVLQTLNELETVVVKSEKDIDFNPIKSELITAKDLRKAACCNLSESFETNPSIDVTNTDAVTGTRRIRMLGLDGVYSQILVENMPSVRGLASRTGLKFIPGTWIKSIAINKGAGSVVNGYESVTGQINVTLAQPNNSEPLLVNLYGNGAGRVEANINTAHTLGKDSRWSTALLLHGHNTSQGVDRNNDGFFDIPQGNMMTVMNRWKYKGDVLRAQFGVKAVYVDKFTGQATFNQSQERTTALPYGIGFNTRRLEGFAKFGILPPNHPNQSLGIIVSGIHHEDNSFWGVNDFNAVQDNLSVNAIFQTQVNPQNRFSLGASYLFDRYDQNYEQQHPTSQTFVWNRTESVPGIFAEYTFEPNDQWALVTGVRNDFHNLYGNVFTPRMHLKYSMTPTSIIRVSGGRGFRVANIIPENFGYMISSRNLQVANDLQPEVAWNYGISWTQEVQLGKTKGKITADFYRTDFENQIVADLDASASAISFYNLEGRAFANSFQLGLEYEPFKRFDVSVAYKYYDVQSTTNNTLQQQPFIAQNRFFLNLAYATRFEKWSFDFTTQWFGAKRLPNTTGKPEAFRLAQNTPSFFLLNAQVTRNFRNWSLYVGSENLTNFRQDTPIIDPSNPFGSQFDAGLVWAPVLGRMVYAGLRFFIK

SEQ ID NO: 19631 - protein, 719 aa, Uncultured marine bacterium 562
MRYQGGAWPGGLPRSNAIAVGMAIAFAQLPAAALAGQPDERTAEDGRPAGAPNGAEVELPAVTITASKRDQSLASINGAAAVVQQPALDDAQVASTQDLQRVLPGVEIAGGGSLLFPVISVRGVSSAQDFYNPALTLYVDGVPQLPTFTSQTLLSVDRVELLKGPQGTLYGKSAEGGVLNIVTLPPDDMLRVRLRTGLSSRGGNVEQAEVAGPLVKDLLYGSVSLAQVDAPGDLRNPVSGASHQGGSRALAGNVKLRLAPAGAPWEAGLSAGRDCTKATQDIYVPFDNIASRTANIDPRMPAQYAEPYLRRCGNSYALSGRYDFGQWRLSAVSAWQTVDIARRFPYLQYFLQQPEQWRQNVQELRLATRAPKRRWDAVFGLYRQDVHQSRFSTYDMVIPSVVNLTTTTSGNQSKSLAAYGDVTWHATDALDLSAGLRASRDQAWTAFAGTTMTSSGAYSTFSGANASAGNRVLGKVSAGYRLDPAWRVYANVSQGYKPGGFNLAPSSAADARGYGPERAISREIGARYEGRSLRGNVALYRIDIHDAQLFSGNALGYQTLSNVGDTRSTGAEFGLEWDVARGWTAGLDGFVNHATFRSYTDLYGCTACVGNDVPFAPRYGLTLNLAGKVPTAIGVVRPRVAVRWLGAQYFDTANRLRQGGYALVDASLGWRPRHDIEIALYVQNLTNRDYRTYAFAAPTGNLAMVGLGRTVGMTVSFDY

SEQ ID NO: 19632 - protein, 769 aa, Uncultured marine bacterium 562
MNKFFIFILCLCCALTVAQATGEDRLNDSDANVFGHVLDKKTGEHLPFINVLLKGTTIGTTTDNSGHYFLKNLPEGKFTLEYKALGYKTISKEVTLKKGKTLEINVELEEDQIALDGVVVSANRAETSRRLAPTLVNVLDAKVFTTTNAVNLAQGLNFQPGVRVETNCQNCGFQQVRINGLDGPYTQILIDSRPIFSALSGVYGLEQIPANMIERVEVMRGGGSALFGSSAIAGTINIITKEPLRNSGELSHTLTSIGGTSAFDNNTTLNASLVSENGKAGLYLFGQNRHRSGFDQDGDGFTELPKLKNQTVGFRSYLKTSTYSKLTFEYHHMNEYRRGGNLLDRPPHEADIAEQLEHSIDGGGLKFDLFSKDYKHKWSVFTSAQNTDRDSYYGTNQDPNAYGKTTDLTVMAGTQYAYSFDKFLFMPSDLTAGLEYSFDHLKDEMIGYNRFTNQKVHIESAFLQNEWKNKRWSFLIGGRLDKHNMMDHVIFSPRANIRFNPTEDINIRASYSSGFRAPQAFDEDMHISAVGGEVAMIQRAKDLSEEKSQSLSASVDFYHRFKNGIQLNFLVEGFYTSLSDVFVLEDIGKDEQGNLIKERRNGSGAKVMGLTLEGKSVLTSWLSLQAGATFQRSRYKEAEKWSDDENVPAETKMFRTPDIYGYFTATLTPFKRFTASLSGTYTGSMLVQHLAGYIPLDKAVETPDFFDMNIKLAYEFPLYKELKLEVNGGVQNLFNAYQSDFDQGKNRDSSYIYGPASPRSYFAGVKMSF

SEQ ID NO: 19633 - protein, 368 aa, Uncultured marine bacterium 562
MKIKIAFLATRVAGSAALVVSSTAFAQSSVTLYGSLDAGLGYVSNLHGSSAYIAEQGTLQADRFGLQGVEDIGAGRSVVFRLESGFVTTTGASASSTTFFNRQAYVGLSDPLFGTVTLGRQTDWNFDWLGSVSTGQLLGDFSAFHPGNLDGLGSTLPVQLSSTVKWKSASYSGLTLGALYGFPGAAASNTNGRTISFGANYTNGPLRLVAAYSEYRDRLLPLSNGLGLTSFEGQTLVPGGSFNAKQVRDMGIGGSYRFERVTLHALATDVRIASNGGSEHFRSFDGGANLRLTPAEEVAAGAWTATLDGHRWTQFTVANVYSLSKTTQLYADLMFETAGGGAVANTLGIGAASGGRQTVVLAGVHHLF

SEQ ID NO: 19634 - protein, 908 aa, Uncultured marine bacterium 442
MNRFNSLTTNASTRVIALALGLVSTVSFAQEENVDANLEEVIVVGKYQASLQSALERKRGSASVIEAISAEDIGQLPDVSITESLARLPGVAQDRDRGNGSQISIRGMGGQLGLTTLNGREVATVEEDRNIRYDQFPSELINAAQVYKTPQAKIAEGGVSGTVNLETISPLDYDERVIAVNLRGSSYSLGKDIDDAAGGGIGTRYSVSYIDKFVDDTLGVAIGIAGQNQPIATQRAELWNYGDTWHNTQWNDEEGKNFNAPWGGSALVRGGEDSRVGGMAVVQWEPTENFALSYDFFYSQLDISEEQRGFDFNIDPDYARQWDINDSVATQFTNSDENAEDVLSAHVGLSSLRSLNEKFTQTDDLMSHGLTADWYVGGWNLVGAVSHSATNRDRMWQSVRTVNTSENLGGTFGANSDDRMTFALDTGIDLTDPAQNRVDNLTVNPLSVGEDAITAIEFSAERELNGSFFSSFEVGARVSERVKKQDAQTWDQFVVNNWDVALTDEFIIDAGAKSYWSDLPDYLTIDREAVIDYYFGSIENPTPGDNDDLLASWEVSEDIQSAYVQLNIDTQLGSIPMRGNVGVRAVTTTTGTKGYQVLSASTWVEEPVGSGVWVEVLPSAEQVETEHSYDDFLPSVNLAFELRDDLVLRLGAAKTIARAPLDFLSPAVDIGQDQWAPNPGESASGNPYLEPFRATQGDTTLEWYFGDSNSIAATLYYKDMESYIARQAGAESITVDGTDYLLSLPVNGSGGYIKGYEISYQQAFDFLPRPFSGLGVYANYANTSSNIEQGTPLNATPFGLTGLSEDVGTFTLWHYLNGFESRLSYNYRSEFQRDISRVAGEEGVNAAEGYMDLAFSYELNENVKLMLQVQNLTDEPYKVYGLESNNPNHINKFEEFGQRYSFGISWKL

SEQ ID NO: 19635 - protein, 201 aa, Uncultured marine bacterium 159
MRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGNAGYSWAKKSKDGLEVKQGFEGSLRARVGYDLNPVMPYLTAGIAGSQIKLNNGLDDESKFRVGWTAGAGLEAKLTDNILGRVEYRYTQYGNKLDTQDIRVGIGYKF

SEQ ID NO: 19636 - protein, 433 aa, Pseudomonas putida
MFCASRALAPYREPRAMGGTAMAFDTGTAGMMSNPATLSLSDAGSRFSIGLDVIQPDISTKNLSSGETADSKNKSNNRGPYYAPQIAYTYRDERWAVGVGAFAQGGIGTEYGDHSFLSAGASGQSTGLDSSSRLIVLNIPFAVSYDVTDSLTLGASLDAMWMGMNLNMMLSSPQVGALIGDGRADGSLVPVIGGLPALEGAHISFSKNEPIASGADAWGYGGRIGLLWKASESTNVGIAYNLASQMGDLKGDATVTAVDGIAGQIPLKGKIKIRDFQMPASLTVGIAHAVNDRWLVAADVSRVFWRDVMKDINVTFNSDSGGNLNLALPQDYKDQTIFSVGTSYRIDKWILRAGYRQATEAAQSDLLFAAIPVTLTKHASAGVSYDMGFGSIDLAYTHAFEKTTTNRSQPNAPVPIRNTHSQDNLVLSYTHNF

SEQ ID NO: 19637 - protein, 1859 aa, Wolbachia pipientis
  misc_feature (974)..(974): Xaa can be any naturally occurring amino acid
TEQHLLKKSRFLKYSLLASISVGAAIPFEGMAMSKEAFRIDLSNKLLNHVSQLNGHKDTTNTPQQIGTVIVSEPEINTYTPSEIREMKISNKPKASNPLKDVPIEDHYKVVARSKSDVGKARKVRPITRCKTFAGIEKTEQSQNTYTPESTEQMPQKPEIIITASSPTVSPASNSFITAPNTPNTTLTSPEHYTTAPGTPSSTPATPYQSTSDSKPNDSLGANTPPNINTNSKAVRRLSFSSSDPQQQAVQSSSQVKSEVPPKPAFVPLPIKKSSTEIVAGMVSNISRVNEMIGIKLAEVTQAIKDTTDKKDKERLQKLYTQLTSTQTTTETLKSRAEEIETKIKIGENKDKIKKLEKELTSKNNKADRLFQKIEKIDILANKVSIKSQETVPVTTVSTEVSAFQAQQARINEARQGVFNKNKSSGGNARKSSAGTKREKKKQEAQKQLSEIKKQEKAIKTASDKVKEVAASAKKETSRTALRAMQDKMNGDSEQLNKIEENLKLLTPDVYNSSIGPTYKQSPKAKPTIPLSHGVQRILGEQPEDEQGYLVPIKVQQQPYQEIEDPIPSHSKDIYEAKVSQYINYLNSIQPNQSNQAQIDSVIDGLATEMRKFSADQFSQKLGEIAHLASIKAYEGLFEKLYEIQQARILETQKVYEQAKISQSYAEYEENSRKSSTPVLSRSSSAKSVISSNFEEKSALLQTTTTDESLRSDNNWKNSAPYSSSPKLDKRGLEYLDLAGDAFVQNLKQPDTLTIETLSLITPTQNTTVAKSDSSRKNNVSGSISEMQQLQSEKMRTETLGVQDDLGLDLHYTPQETLTEESTYLVSSKKKQGNIIKRAVSKVGSILQTNYAENRRRKRDGETSKQRTVDQEGEFGHAWGNENHKESSLSVVSGCMKKATQLISLLDATRTAILQTTSPSQRRSVSLVLQEIENDYREAIKISQKLQQVLIRKPENIKAYNAKAEKKLDAIKSXADKHFNNIETDVDVGFNPNGGNSHSMPTANMDSLPKNLAVTPPINVGSLYNSPQAQQFREDHKNIIINDRSQGRLNLVDSTIVRELTDVDASYNTAPPEVLKEAEALLDRSQGRLNLVDSTIVRELTDVDASYNTAPPEVLKEAEALLDRSQGRLNLVDRIVKEKEAIAKLNQYQDPENLEFKRLAMEALDLSSKESQLKQKRKAIEAEFSLNEKSSSTDVSILRSYSIDDISGVLSDAESNLSRSPSVSGLEDLNNSNVMQLGELKSKHEKIANDYNKELELDTLNKEKIWLEGEIKHLDTESKPKVTESKPVFSCSSSVGSINSFSNDDDLSSRDVVTPVDTLNIEINKDYVDTYIRVLSNKIQKIEEIQKIEELSGSSSRSEELNHIKEAMAYISNRIQDVEELDEKMLLAINAQLQEHDEKISSLLREEATDILAQLLLQEMLVSDGKSESTLPAGDEEQEDTEVSRQLSSLPALASSYESALALSDDREKECLALGDSSEDEESYDSGFEEEEETIGQLSDSDGGNLKITEVDTVIPLEQEAKKEMQTQISENAPTLNQAKVVNTIVNNMIRNRLDASMNMSNNMVAVGAGDEEESHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQSKLVITPNIGLRYGKSRDGVYNETGVNVQEIALTMKENNILSGIVGTKVTVPLKDALKFNNLGLTFQGAVEHNFKEKTQRINRVVKIFDNTFKHNYLIPKQPKTSYNLGTGIIGSIKNTTISLDYNYYLNKHYRSHQGSVKLKVNNE

SEQ ID NO: 19638 - protein, 164 aa, Wolbachia pipientis
  misc_feature (4)..(4): Xaa can be any naturally occurring amino acid
YVYXYNMAQILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 19639 - protein, 179 aa, Wolbachia pipientis
YVRSQYNGEILPFYTKVDGITNATGKEKDSPLTRSFIAGGGAFGYKMDDIRVDVEGLYSKLAKDTDVVNTSETNVADSLTAFSGLVNVYYDIAIEDMPITPYVGVGIGAAYISNPSKADVVKDQKGFGFAYQAKAGVSYDVTPEIKLFAGARYFGSYGASFDKAAKDDTGIKNVVYSTV

SEQ ID NO: 19640 - protein, 1061 aa, Wolbachia pipientis
ITLQVGGSLDANNIDFGAGSTLEFNGPLDGDGNAIPYYFKGAIANGNNAILNVNTKLLTAYQLTIGTVAKINIGAGNFFAIDASAGDVTILNNAQDIHFRALDSALVLSNLTGVGVNNILLAADLVAPGADEGTVVFDGGANGLNIGSNVAGTARNIGDGGGNKFKTLLIYNAVTITDDVNLEGIQNVLINNNADFTSSTAFNAGAIQINDATYTIDANNGNLNIPAGNIKFAHADAQLILQNSSGNDRTITLGANIDPDNDDEGIVVLNSVTAGKKLTIAGGKTFGGAHKLQTIFFKGGGDFGTAGTTFNTTNIVLDITGQLELGATTANVVLLKDAVQLTQTGNIGGFLDFNAKNGTVTLNNNVNVAGTVKNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAILGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVNFTFDASTLTLFAEDIAADVIDEDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMSENINLTPLAGLRYSTIKDKSYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 19641 - protein, 164 aa, Wolbachia pipientis
RSICYTMAEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 19642 - protein, 677 aa, Wolbachia pipientis
DWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPLGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGG

SEQ ID NO: 19643 - protein, 278 aa, Wolbachia pipientis
RQFGHSLWLRLRLFGSLSKTYPLPFGGATQWGNRESFIGLAGEFRTLRAGRVANQFDDASQAIDPWDSNNDVASQLGIFKRHDNMPVSVLYDSPDFSGFSGSVQFVPAQNSKSAYTPATYTVDSSGVVTAVVGKPGSDVYYAGLNYKNGGFAGNYAFKYAKHANVGRDAFNLFLLGRIGEDDENQGTDPVKNHHAHRQTGGYEEGGLNVLWGAQKDMSENGDKTKDSTTEIAATASYGFPNARAASAMQRFCSLSNAVIRRTTIYDHIIAIDKKKKKK

SEQ ID NO: 19644 - protein, 174 aa, Wolbachia pipientis
NGEFLLLFTKIDGITNATGKEKDSPLKASFIAGGGAFGYKMDDIRVDVEGLYSWLNKDADVAGGTVADNLTAISGLVNVYYDIAIEDMPITPYVGVGVGAARISTPLKTAVDSQTYKFGFAGQVKAGVSYDVTPEVKLYAGARYFGSFGAHFDKDATTGKGQGELKVLYSTVGA

SEQ ID NO: 19645 - protein, 162 aa, Wolbachia pipientis
TKIEGIEYKKATDIHNPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTV

SEQ ID NO: 19646 - protein, 134 aa, Wolbachia pipientis
EILPLFTKIDGIDYKKGTDIYSPLKASFIAGGGAFGYKMDDTRVDVEGVYSYLNKNDVKDVVFTPADTIANSLTAISGLVNVYYDIAIEDMPITPYVGVGVGAAYISTPLATAVSSQNGKIAFAVKQELASAMT

SEQ ID NO: 19647 - protein, 177 aa, Wolbachia pipientis
YVRLQYNGEILPIYTEVDGITKLTGKEQYSPLKRSFMAVSGAFGYKMDDIRVDVEGLYSQLATDSTVVDVSKLASSVTAFSGLVNVYYDVAIEDIPITPYVGIGVGASCLSNPSGITAVKDQKGFGFAYQAKAGVSYDVTPEIKLFAGARYFGSYGASFNKETTSVDKQMKVLYSTV

SEQ ID NO: 19648 - protein, 161 aa, Wolbachia pipientis
VRLQYNGQILPLFTKIDGIKNAAGKEKDSPLKASFIASGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFD

SEQ ID NO: 19649 - protein, 656 aa, Wolbachia pipientis
VRGRASTENLSMKTRSIRRYAGFLACVAPVAASAQQATPTELAPVVVTGSLTQQKQQDMLGDVSVIKRAAIERAGQSSVAELLQRQPGVEINHTGGPQTATSVFLRGANANQTLLLIDGRRMNTATLGSGNFQGMPLDNIERIEILRGAASSLYGADAIGGVINIITRQGGGDRPLNIRADVGYGTHDTSRSSIGLDGAADGWRYALNAGYGRSRGYNATAKTVGGQYNKGYNGDRDGYEQNDVSGSLGYAWKPGQEIAFDFYHSKMKGQYDGGFDKPFNEYNDRLYQTINLYTLSSSNQLTDWWRSTVRLSQSTDTQRNQQAPGTWGFPEDGETRFRTRQEQYTWQNTFDLAANQTVTLGYEHLKQRVSGDLFESIWPAPDRIIDYGVDSRITNSFFGEYRTRIDRHHVQVNLRSDHNTLYGNKVTGGAEYGFDITQQLRAGIGANTGFRAPTFNDLYWGNDGGTVGNPNLKPESSRNIELSLHYVDDSTTAGIVAYRSHVKDLIVWADRNDGSYLWSPENVGRAELRGITLTGSQRLGQTTLRASADFQDPHDRDNGNTLALRARQIYRASAEHRFGPATAGVEYLWSGPRYANAANTQELGGYGLVNLTASYDVSKNLTAYLRWNNLFNKDYTLARGYNTPGSTVFLNLAWRM

SEQ ID NO: 19650 - protein, 187 aa, Wolbachia pipientis
VRLQYNGEVLPLFTKVDNMKIKKGTDDVDPFKASFIGGGAAFGYKMDDIRVDIEGLYSQLNKNVNNDEVLTPDTVAGSLTAISGLVNVYYDIAIEDMPITPYVGVGVGAAYISTPLKDAVNDQKSKFGFAGQVKAGVSYDVAPEVKLYAGARYFGSYGANFDKSGGEKDKGGHTVLYSTVGAEAGVA

SEQ ID NO: 19651 - protein, 199 aa, Wolbachia pipientis
VRLQYNGEFLPLFTKVNGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPEDSTRQVTDAGAYKVLYSTVGAEAGVAFNF

SEQ ID NO: 19652 - protein, 247 aa, Wolbachia pipientis
NLSASYLHSKIKNFSLDDSRDPSGGRSDTVIVKDAASAANCVVQPTGAITAQALFAAAPALGALQPVTGTNTSGVFSSCAAILQMIAEPPPAISTLLGVAPGGPLPFAFNRDLTGAPLSLPSGVAVPLSGNRLPQAPTWKFSAGAQHVSEFDNGMSLVLRVDLTYTGEYFSRSFNRPVDRIKGYEVVNAQAQLNGQDDKWFVRAFVQNLTANNAITGQYVSDPASGLYTNSFTLEPRRYGIAAGFEF

SEQ ID NO: 19653 - protein, 242 aa, Wolbachia pipientis
LFSSLLFSSLLFSSAAQAASEDNGRGPYVQADLTYASELISRDYPEATDTKFDKNIHTHSIHPRVSVGYDFGGWRIAADYARYRKWYNNKNSVQIKEINNVPPNRKDLKTENQENGTFHAISSLGLSAVYDFDTGSRFKPYAGVRVSYGHVRHSIDSTKKTTEVVTTAGSNGAADTVLPGASTQNAYHESHSIRRVGFGAVAGVGIDITPNLTLDTGYRYHYWGHLENTRFKTHEASLGMRY

SEQ ID NO: 19654 - protein, 356 aa, Aeromonas hydrophila
AVVYNNEGTNVELGGRLSVIAEQSTNTLDDQEQQHGALRNQGSRFHIKATHNLGDGFYAQGYLETRFVTDITKDKSDHFGDITTEYAYVTLGNKAFGEVKLGRAETIAGGITSAEDKEYGVLNNSKYIPTNGNTAGYTFKGIDGLVLGANYLLAQQRDVYHTVGKPGEVYPQSISNGVQVGAKYDANNIVAGIAYGRTNYRENIRLTVLSPSRKEQVEGVLSTLGYHFSDLGLLVSLDSGYAKTKNHMKPAITTTAATTAAEPAYDEKRYFVSPGFQYELMEDTNVYGNFKYERTYVNQGKKTHEQAVLFGVDHKLHKQVLTYIEGAYARTKTNDKGKAEKTGKEKSMGVGLRVYF

SEQ ID NO: 19655 - protein, 94 aa, Wolbachia endosymbiont
NGESYHVGLNYRNNGFFAQYAGLFQRYGEGTKKMEGYTYNIPSLFVEKLQVHRLVGGYDNNALYASVAAQQQDAKLYGTWRANSHNSQTEVAAT

SEQ ID NO: 19656 - protein, 706 aa, Helicobacter pylori
MKKTLLLSLSLSFLLHAEDDGFYTSVGYQIGEAAQMVTNTKGIQQLSDNYEKLNNLLNNYSTLNTLIKLSADPSAINDARDNLGSSAKNLLDVKTNSPAYQAVLLALNAAVGLWQVTSYAFTACGPGSNESANGGIQTFNNVPGQKTTTITCNSYYQPGHGGPISTANYAKINQAYQIIQKALTANEANGDGVPVLSDTTTKLDFTIQGDKRTGGRPNTPKKFPWSDGKYIHTQWIDTTPQSTETKINTENNAQELLKQASIIITTLNEACPNFQNGGSGYWQGISGNGTMCGMFKNEISAIQGMIANAQEAVAQSKIVSENAQNQNNLDTGKPFNPFTDASFAQSMLKNAQAQAEILNQAEQVVKNFEKIPKNFVSDSLGVCYEEQGGERRGTNPGQVTSNTFASGCAYVEQTITNLNNSIAHFGTQEQQIQQAENIADTLVNFKSRYSELGNTYNSITTALSKVPNAQSLQNVVGKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 19657 - protein, 731 aa, Helicobacter pylori
MKKTLLLSLSLSFLLHAEDDGFYTSVGYQIGEAAQMVTNTKGIQDLSDNYENLSKLLTRYSTLNTLIKLSADPSAINAARENLGASAKNLIGDTKNSPAYQAVLLAINAAVGFWNVLGYATQCGGNANGQESTSSTTIFNNEPGYRSTSITCSLNRYKPGYYGPMSIENFKKLNEAYQILQTALNKGLPALKENNGTVSVTYTYTCSGEGNDNCSKKATGVSDQNGGTKTKTQTIDGKTVTTTISSKVVDSQAKGNTTRVSYTEITNKLDGVPDSAQALLAQASTLINTVNTACPYFSATNKSGGPQMEPTRGKLCGFTEEISAIQKMITDAQELVNQTSVINEHEQSTPVGGNNGKPFNPFTDASFAQGMLANASAQAKMLNLAHQVGQTINPDNLTGTFKNFVTGFLATCNNKSTAGTSGTQGSPPGTVTTQTFASGCAYVEQTITNLNNSIAHFGTQEQQIQQAENIADTLVNFKSRYSELGNTYNSIPTALSKVPNAQSLQNVVGKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGRNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVY

SEQ ID NO: 19658 - protein, 1446 aa, Symbiont bacterium of Paederus fuscipes
MPLAKSETDMAGVISVIQKYSDVENTTGSCDPSTGAGGGTRRRGAVRLGLLVGSSLATLALALGPVAAQTVPARSPSTSGLTAADIASWPAYRGDWGLAAINAANAYARGYTGSGVLVAVIDSGIDPTHPKFAGRLSDASRNFWITNPPNLLSSAIVADVNGHGTHVSGTIGASPIGGQMMGVAFDSTILSLNAIMSADDAVAIKNKFGFQPAFTDINAAVDFAAERGARVLNGSYGPSFSPKYLFDEIQKRYVRNPNYVLERTQEIEISSATNEYNSLRNAALKDMLLVFAAGNDRFDQEIIAANPTGAAIYPYIKPSNSTSGVYQFVDRSGQAVDQSQTNFSDLSGSIVAVVNVDINGKVRFDSNFCGVTANWCISAPGTDIYSTWPQDLRPENQKNVGYNAISGTSMAAPHVAGAAAVLRQAFPFLTAPQIAQTMFTTARHLGDGPTDRPNATFGWGLLDLGKAIDGPGQFTSDWTVNTTYNGQAYYGRFANDISGIGGLTKTGLGTLELAGRDTYAGPTTVAGGTLFLSATGSLTSPVSIQGAGTYINAGWTQSGVSNAGLLINTGTVTGGVANAGLALNSGAIAGGVTNGGVLSNSGTISGGLANAGQVLNAGAIGGGVTNTGTLSNSGTISGGVANSGLALNAGAIGGGVTNTGTLATSGTVSGGLTNAGTVLASAGRIDGAIANNAGLLAVSGTVTSAGTFANAAGATLAVTGGGSYSLAGPLANAGLVAVAQTASLTASGGLSNAGLVASDGTLTTDLTNTGVARLSGQFNGTLTNAGLLQITGPLAGLTSLTNTGALDLGGTAFTLTDLAGPASAVLGNGALTVSNAAASTYAGAILETASPTSLTKAGPGTLTLTGLGLFSGPTTVQAGTLSLNGLWASPVTVAAAGTLRGIGTIAAPVTVAGALRPGNSPGTLTVLGPVAFNPGSSLGLDIDGPGTGTGAGSYARLLALGPTGTVSASGTLVPELRGITGNAGNSFTPALGQRFGVLTAQAGLSGSFTGLAQPAAGLPAGTRFDALYAATGLDLVVTPAAYGNLAGLGLAQTGNARAVGAALDLARPAAGTRPDAARARVYDPLYAADPATLPGGLASLSGQSYGDAVMTDLAARRLLSDTIDRHQRGLGGGAGAFSAGDPGPGPNRTALQVRGGAGAAAAPLAVGEGRVWADALYGFGARAGDRAAAGAGFDAGGLLMGVDRQVGADTQVGAAFSYLREGGTSRGAGLGRFTTDSYGGTLYASTRLGAVVLRGTAGVSYADGRVDRTVALGTAVSQASGLSSGWNGGVSGFAGYTLALGLPVDLVPEVGFSYDRLTRGRVSERGGLVNQGFGGQGFAVADLDAARSLVGGRLTSWALAGVPDLRLEGRAYWAHELADTAALVRSNLFGAGFLSRTSALGRDGAVLGVSLTGAVAEGVQLSVGYTGELRPNATAQVFTAGLQAAW

SEQ ID NO: 19659 - protein, 323 aa, Neisseria meningitidis serogroup C
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDVDKYKHTKSSRESYHAGLKYENAGFFGQYAGSFAKYADLNKDAERVAVNTPNAHAVKDYQVHRVVAGYDANDLYVSVAGQHEAAKNNMVGSTDIGKKHEQTQVAATAAYRFGNVTPRVSYAHGFKAKVNGKKAARYQYDQVIVGVDYDFSKRTSALVSAGWLKQGKGAGKVEQTASM

SEQ ID NO: 19660 - protein, 322 aa, Neisseria meningitidis serogroup C
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNKVGSTKGKKHEQTQVAATAAYRFGNVTPRVSYAHGFKAKVNGVKDANYQYDQVIVGADYDFSKRTSALVSAGWLKQGKGAGKVEQTASM

SEQ ID NO: 19661 - protein, 323 aa, Neisseria meningitidis serogroup C
VKNQGVKNQGVKNQGVKTKTATQIADFGSKIGFKGQEDLGNGMKAIWQLEQKASIAGTNSGWGNRQSFIGLKGGFGTVRAGNLNTVLKDSGDNVNAWESGSNTENILGLGTIGRVESREISVRYDSPVFAGFSGSVQYVPRDNANDKDKYTHMKSSRESYHAGLKYENAGFFGQYAGSFAKYADLNTDAERVAVNTANAHPVKDYQVHRVVAGYDANDLYVSVAGQYEAAKNNEVGSTAIGKKHEQTQVAATAAYRFGNVTPRVSYAHGFKAKVNGVKKASYQYDQVIVGADYDFSKRTSALVSAGWLKEGKGVNKTEKTASM

SEQ ID NO: 19662 - protein, 361 aa, Neisseria meningitidis serogroup C
VKKTLLGMTCVMGILSGTAQAQSSVTLYGTIDTGVGFQSWKNRSLGVKESQVGTYNGVWESSIWGLKGSEDLGGGNSANFQLEGGFNAYDGKSSSDRLFKKATVGLANTQWGSIKFGRVGNVVQEYASFIAGPDDEENLADITNTFSAAGSNKADNTVVYKSPKIHGMDFAIGYSFNTNGPQSWKNKENVKLITTAMGYSQGPLTLGVGYDRLQSGSWDKDVHSWVAVGAYDFEAVLLGMAVGQDINGRQSALSSYVPNSAFKTWNSGYTRDFKTSSFTINATVPVGAVSSAMVGWSISRASSGFSNAYNLEKRQQNIYSAGYSYNLSKRTSLYAIGAYSTGFAFQNVRGQQVIVGLDHSF

SEQ ID NO: 19663 - protein, 323 aa, Neisseria meningitidis serogroup C
EVSRVKHAGTYKAQGGKSKTATQIADFGSKIGFKGQEDLGNGMKAIWQIEQKASIAGTNSGWGNRQSFIGLKGGFGTVRAGNLNTVLKDSGDNVNAWEFGSNTEDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTSPATNGKKHEQTQVAATAAYRFGNVTPRVSYAHGFKAKVNGVKKASYQYDQVIVGADYDFSKRTSALVSAGWLKQGKGAGKVEQTASM

SEQ ID NO: 19664 - protein, 466 aa, Wolbachia endosymbiont
RLIVGTEVDDTELVTLRRLIEEFEAELATLGARVDNLEGRVAFLEDHQFSTTTKLNGEVIFSLVGATSDEEDANIILADRVRLNLNTSFTGQDLLITGLQAYNFGGDITGAGSVQGALFPGRDAFLSEGSTKLSFEPQFPEFNPQDLSESAGSNDVELYKLLYIFPSGVNNLTLFAGTAAEASDAFPAIIPFSSEGQGAISRFATLNPVLRVSGGTSQTGLASAVGFIWGISDAIDLRALYGSVNAAIPEQGDNNILGSGFFGGSTVASAQLTLKPSSQFDIGLNYAYSYHDLNIMGLGLTRFSSNPLNIPGRTVDGDGNPIVGGILDTPVHVNSLGATATWRISPKISLTGYGAYFFVDAVAGADASSDFTTWMAGLHFQDLFKEGNTAGLIFGQPLHRVEADGAADLTEPGVDRETPYHLEAFYNFKVSDNVSITPGAFVLFNPESDGNNDTALVGVLRTTFTF

SEQ ID NO: 19665 - protein, 184 aa, Wolbachia endosymbiont
YNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVALFF

SEQ ID NO: 19666 - protein, 183 aa, Wolbachia endosymbiont
SYYVRLQYNGEFLPLFTKIADKSDLYKPSFMAGGGAFGYKMDDIRVDIEGLYSQLNKDAGVADTAVADNLTAISGLVNVYYDIAIEDMPITPYVGVGVGAAYVSTPLKEAINEQKNKFAFAGQVKAGVSYDVTPEIKLYAGARYFGSYGAHFDGEKADPQDANKKVADKGAYKVLYSTVGAEA

SEQ ID NO: 19667 - protein, 345 aa, Haemophilus gallinarum
MKKTAIALAIAGLTAASVAQAAPQANTFYAGAKAGWASFHDGLNQFENSQNAYGTLRNSVTYGVFGGYQITDNFAVELGYDDFGRAKLRKGGETVIKHTNHGAHLSLKASYPVLEGLDVYARVGAALIRSDYKSTKRAESDYVMHEHSLKVSPVFAGGLEYNLPSLPELALRVEYQWVNKVGRGEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDAVKGRKALIACLADDRRVEISVKGNE

SEQ ID NO: 19668 - protein, 784 aa, Haemophilus somnus
MFEDRAVSARPAPRAGWLSRLLASTILSGTALCGLAGPGLAQGAADAVELSELSVTGEGRGATLGGALYGPGGAQGAVPGYVASRSTVATKTDTPILETAQSISVIGRKQIEDQNALSINQALRYTPSVTTEQRGGAGSTRLEQFLIRGFTAPVFLDGMALIGGRDANATIEPYRLERIDVIKGPASVLYGQSGPGGIVNLVSKVPQFVRHGEVFVQGGGFSEVRGGVDVGGPIASDVPWLADQFAYRIVGFGWNGDGPVDTTRVERALINPSLTWRPSTDTQLTIIGNYQRDPFSGFYGGFPAVGTVFPRNFGNGIIGRLPVNFYDGDRGIERSDRTQASIEYLFDHRFSENLRFHSAGRYLRTQGDYRSVYSAFNPRNGPFATGPLIPRAVIGTNVAAEAYTMDSNFVANFDTGFIAHTALLGVDHRTFSTRTTGSPFPDAPDLNALAPNYTMNIAFPAFNTVSRVDAQQTGVYFQDQMKFDRLVLTLGGRYDVARQTGPTRSFAANGTSTLTLQNAPADAFTGRASLLYLFDSGVAPYVSYSQAFEPIVAGRVFDPAFGTVGRVPDPQLSDQYEAGIKYQPPGTDILLTAAFFDIRQSNRTTADPARQGFVVQTGQVGVQGVEFEARANLTEGLTLIGGFSLLDIRNVRDDGRTANDLTPGQTVPLQGRSPVLVPDSTASLLATYRFNEGPLLGLEVGGGVRYLGPSWGDAANTFKVPASVLVDATLNYDLKYLDATLQGFSMQVNATNLLDEQYVSGCNGYTSCYYGLPQTVYATLRYRW

SEQ ID NO: 19669 - protein, 513 aa, Klebsiella pneumoniae
MLGPLLLLNPVAGARAADFNLEAIQRYSASSSRQDQVTSITQFSDVQPSEWAYQALSNLIERYGCVAGYPDGTFRGRTPLSRWEAAALLNACLDRITEVTDELRRLLKEFEKELAILRGRLDNLEAKVGELEANQFSTTTKLSGLATFVVGANAFNGSARNQLNSARAEVGATTFSYDLQLSLDTSFTGKDLLRTILRAGNFGDSAFGGAGPTGGLSALEVAFQEASGADSLGIDKLYYQTPIGGGFTATIGARVGQEDMLALWPSVYPTDTILNVLTLNGAPAAYNKNLGPGAGLWWQSGGFSVSGNYVAANGSLGHPNEGGLGTAASAGTGTVQIGYAGEQWALAAIYSSIQSGVEVPGATAFTASAFGSPGRHTHAFGLSGYWQPAASGWWPSISAGWGINSTSSDGQAVDGELTTSQSWMVGLQWSDVLLKGNAAGMAVGQPVFATALQGGATAQDQNVVWEWWYRFQVSDSISITPALFYLSRPLGQGTPSGESFSQLGGLVKTSFQF

SEQ ID NO: 19670 - protein, 726 aa, Klebsiella pneumoniae
MGMRIIKIFWPLTALLAGLNSQVSLAKSSDDNDETLVVEATAEQVLKQQPGVSIITSEDIKKNPPVNDLSDIIRKMPGVNLTGNSASGTRGNNRQIDIRGMGPENTLILIDGVPVTSRNAVRYSWRGERDTRGDTNWVPPEQVERIEVIRGPAAARYGSGAAGGVVNIITKRPTNDWHGSLSLYTNQPESSDEGATRRANFSLSGPLAGDALTMRLYGNLNKTDADSWDINSLAGTKNAAGHEGVRNKDINGVVSWKLNPQQIIDFEAGYSRQGNIYAGDTQNSSSSAVTESLAKSGEETNRLYRQNYGVTHNGIWDWGQSRFGVYYEKTNNTRMNEGLSGGGEGRISADEKFTTNRLSSWRTSGEVNIPLNALVDQTLTVGAEWSRDELDDPSSTSLTGADSNIGGISGSAADRSSKNHSQISALYLEDNIEPVPGTNIIPGLRFDYLNESGGNFSPSLNLSQELGDYFKVKAGIARTFKAPNLYQSSEGYLLYSKGNGCPKDITSGGCYLIGNKDLDPEISINKEIGLEFAWEDYHASVTYFRNDYQNKIVAGDNVIGQTASGAYILQWQNGGKALVDGIEASMAFPLVKDRLNWNTNATWMITSEQKDTGNPLSIIPKYTINNSLDWTITQAFSASVNWTLYGRQKPRTHAETRSEDTGGLSGKELGAYSLVGTNFNYDINKNLRLNVGVSNIFDKQIYRSSEGANTYNEPGRAYYAGVTASF

SEQ ID NO: 19671 - protein, 733 aa, Klebsiella pneumoniae
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 19672 - protein, 702 aa, Bordetella bronchiseptica
MSLSPYRPTPSLLFLAVSLGLSSIAAAAPQATTLDAVQVTAADASAQARDALKRVPGASNVIDVAKADSRLSSSADVLAHQPGISAHSPGNEGTKVSIRGSGINRGPGAHASGIAVSIDGLPLTGPGGTPYELLEPLWLSRVEVLRGANGFERGALALGGAIDYVSRSGRDSAGVQLHYEAGSRGYQKRGISWGGVNGDVDYFLAYTDTEFDGYQRHARGDGKGAMANIGWQITPDLQTRFFVRYRETNHETPGRLTRDQIRNDPRAANAANLAIDARRPQPGSTWVGNVTTLQIDENSSLQAGLVYHTYPMDLNESLYRQQLDYANLNATLDYRRRHQLFGLDSETTVGLRVTHDLDADVRESLRFASNGYAAGTRTRAFRHHGTDSTLHVGNTLTFNDRLRMQTGLALINTRRDVQVTWPSSGGRLRDHDWDYAPRLGFTWQHSAQTQWFGNLSRSVEAPHPWSMIWGSNQYFGPGNGPSSGRQRAPVPMQNQTATTLELGARGDAALGRWELTGYYAHVNHELLSVELQPVPNLFIAENNASPTVHRGIEAGLDSTLWQAAPGRLSLRQAYTFNDFRYRHDARFGSNRLPGLPQHAYQAELRFDHASGLYAALNTEYASRIAVDYANSYWADSHVIFGSRIGYDAPNGRWQAWAEMRNIGNRHYAATVTPGYDDAGKDVARSTPGEGRGIYAGVRLRFD

SEQ ID NO: 19673 - protein, 647 aa, Bordetella pertussis
MHIYGNMNRATPCRGAVRALALALLGAGMWTLSPPSAWALKLPSLLTDDELKLVLPTGMSLEDFKRSLQESAPSALATPPSSSPPVAKPGPGSVAEAPSGSGHKDNPSPPVVGVGPGMAESSGGHNPGVGGGTHENGLPGIGKVGGSAPGPDTSTGSGPDAGMASGAGSTSPGASDGAGKDAMPPSEGERPDSGMSDSGRGGESSAGGLNPDGAGKPPREEGEPGSKSPADGGQDGPPPPRDGGDADPQPPRDDGNGEQQPPKGGGDEGQRPPPAAGNGGNGGNGNAQLPERGDDAGPKPPEGEGGDEGPQPPQGGGEQDAPEVPPVAPAPPAGNGVYDPGTHTLTTPASAAVSLASSSHGVWQAEMNALSKRMGELRLTPVAGGVWGRAFGRRQDVDNRVSREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRTELAVGVASQLGKHGSLFGSYEYAKGSRQTMPWTFHVGYRYAW

SEQ ID NO: 19674 - protein, 744 aa, Uncultured marine proteobacterium ANT32C12
MKTNYLLAAILCCLTPLLHAQTALSGKVVSADTNEPLAGVNIRVDNSLTGCTTNRKGEFTIDNLPDGQHTLRFSYIGFTPKKYTADGQEENILVKLEESYSNLSQVVVTGTGTHRRMTDSPVPVSVITAKEIGSANISTLEEALVKLTPNISSYTNGMGTTMSLNGINEDYILILENGRRLAGEDRYTRINVANIKRIEILNGAASALYGSDAIGGVINIITDDARNTVNVSSYTHYSGEGRLTESVNADVNAGKFSSYTSYQRRQAGSWQNNNIDENGYETGRPTSVGFYSNTVNQRFVFNATDKLSFYARGTYYDNKTRRPQDATYYAKSKGQFVQKDAYTYNLKHETYTYGAGMKYMINRSAYIDAEFYSDNYSSDYMYFKKSGSYLPGDRVTRKQVRYYNGNIKGIFRLGSRNKLSAGVEYVNEGLESESDNIDSRHMYTLAFYAQDEIKLPLNLQAVLGIRYIYNENFKNYATPNVSLMYKLGGLNLRAAYAAGFRTPTLSQLYATDESKTSNRYTTGNADLKPEKNNFYSLNAEYNYRRISVSVTGFINDIHDMINYRTLSDQEIHDMGLDDKHAAFDEIRQRDNVDKAKTKGLSLNASLNLGAGFRAGGGYTYMNTEAKQLQADGSYKVSPIDKSVRHMGNINGQWEHTWSFYRLNVNVHGHLQGERYSQTYGYAPKFQQWDLNTRHTFNLQSVVLEPGVGIENIFDKKDDRPWNNNFSTLSPGRSVYVSLSVRFKK

SEQ ID NO: 19675 - protein, 753 aa, Uncultured marine proteobacterium ANT32C12
MNIIKLAIGSGILLLNCGAYAQSISEKTGTDKKGAAEFSPLNVSIGKTTSEQEALEKTGATSSRTTDKNLQSLDATLRSMPGTYTQIDLGQGAVSVNIRGMSGFGRVNTMVDGITQSFYGSSTSGTTAHGSTNNMAGVLIDPNFLVAVDVTRGDSSGPAGVNALAGSANMRTIGVDDVIFNGNTYGLRSRFSVGSNGLGRSGMIAVGGKTDAFTDTGSVGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTIADNDLEFMLGSKLMRTRYDRTIHSAAGDPKANQEAIENNPFAPSGQQDISALYTGLKVTRGIWEADFNLNYTRNRITGYKPACDSRVICVPQGSYDIDDKEDGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMAEVIGNDWEGMSDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 19676 - protein, 961 aa, Klebsiella sp. 910
TNQPTNQPTNQPTNQPTNQPTNQDSNLSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDVLVVTTSRNGHELENYGYKNYNDKIQGKKREKADPYKIEQDSTLLKLSFNPTENHRFTLAADLYEHRSRGQDLSYTLKYQKTNSDLPEVESRHTNDKTKRRNISFSYENFSQTPFWDTLKLTYSDQRIKTRARTDEYCDAGVRYCEGTANPAGLKLTNGKITRRDGSPLEFKKTKKNGEYDFNTFIDTNDQEIEGKLKLGRTSETWYDCSIFNCEKGTKINVFEGNNSYGHKGKWKEVDLEIKELNGKKFAKIKNESNSSRIKSILPSSPGYLDRLWQERDLDTNTQQLNLDLTKDFKTWRVEHNLQYGSSYNTTMKRMVNRAGNDATDVQWWTTPTLGENFRGVPYTCATTSEWNANLCPRVDPEFSYLLPIKTKEKSVYLFDNVVITDYLSFDLGYRYDNIHYQPKYKHGVTPKLPDDIVKGLFIPLPDGSNSNQVKENVKQNIDYIAKQNKKYKAHSYSFASTIDPTSFLRLQLKYSKGFRAPTSDEMYFTFKHPDFTILPNTNLKPEIAKTKEIAFTLHNDDWGFISTSLFKTNYKNFIDLIFKGEKKFNVGDRGGSLLPFSLYQNINRDSAVVKGIEINSKVFLSKMAKFMDGFNLSYKYTYQKGRMDGNIPMNAIQPKTMVYGLGYDHPSQKFGFNFYATHVSTKNPEDTYDIYAKERGKRDTTIKWRSKSYTILDLIGYVQPIKNLTIRAGVYNLTNRKYITWDSARSIRSFGTSNVIDQSTGLGINRFYAPGRNYKMSVQFEF

SEQ ID NO: 19677 - protein, 430 aa, Klebsiella variicola
FTRSRTWVSLAVFAACAPAYAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTN

SEQ ID NO: 19678 - protein, 1630 aa, Klebsiella variicola
STATIVASFAGSAMGAATQQNRTTNGAATTVDGAGFDQTAAPANVAVALNAVITANANNGINLNTPAGSFNGLFLDTAHNLAVTVSADTTLGFITKAANNGNSFDLTLGAGKTLTITGQGITNAQAAVTKNAQNVVAQFNGGAAIANNDLSGVGTIDLGAAASTLVFNLANPTTQKAPLILGNNAVIANGVNGTLNVTNGFIQVSDKSFATVKAINIDDGQGFIFNTDATVGNALNLQAGGATINFNGTDGTGRLVLLSKNGAATDFNVTGSLGGNLKGIIAFNTVAVAGQLIANAGPANAVIGTNNGAGRAAGFVVSVDNGNAATIAGQVYAKDMVIQSANAGGQVNFGHIVDVGTDGTTAFKTAASKVAITQNSNFGTTDFGNLAAQITVPDTMTLTGNFTGDANNPGNTAGVITFAANGTLASASADANVAVTNNITAIEASGIGVVQLSGTHTAELRLGNAGSVFKLADGTVINGTVNQTAVVGGAFAAGAITLDGSATMTGDIGNGGGAAALQSITLANDATKTLTLGGANIIGANVGGTIDFQANGGTIKLTSTQNNILVDFDLAITTDQTGVVDASSLTNAQTLTISGTIGTIGANNKTLGQFNIGSSKTALNGGNVAINELVIGNNSSVQFAHNTYLITRTTNAAGQGKIIFNPVVNNNTTLAAGTNLGSAANPLAEINFGSKGAHADTILNVGEGVNLYATNITTTDANVGSFVFNAGGTNIVSGTVGGQQGNKLNTVALDNGTTVKFLGNATFNGETTIEANSTLQIGGNYTADFVASADGTGIVEFVNTGPITVTLNKQAAPVNNLKQITVSGPGNVVINEIGNAVNDHGATTGTIAFENSSLGAVLFLPSGIPFNDAGNTMPLTIKSTVGNKTATGFDVPGVIVLGVDSVIADGQVIGDQNNIVSLGLGSDNGIIVNATTLYAGIGTINNNQGTVTLSGGVPNTPGTVYGLGTGIGTVQLKQVTFTTDYNNLGNIIATNATINDGVTVTTGGIAGTDFDGKITLGSVNGNANVRFADGILSNSTSMIVTTKANNGTVTYLGNAFVGNIGDSDTPVASVRFTGSDKGAGLQGNIYSQVIDFGTYDLDILNSNVILGGGTTAINGAINLLTNTLTFASGTSTWGNNTSIETTLTVANGNIGHIVIAEGAQVNATTTGTTTINVQDNANANFSGTQTYTLIQGGARFNGTLGGPNFAVTGSNRFVNYGLIRAANQDYVITRTNNAENVVTNDIANSLFGGAPGVGQNVTTFVNATNTAAYNNLLLAQNSAAAANFVGAIVTDTSAAVTNAQLDVAKDIQAQLGNRLGALRYLGTPETAEMAGPEVGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGKYDNMTFGGNLTVGYDYNAMQGVLVTPMVGLSYLKSSDENYKETGTTVANKQVNSKFSDRTDLIVGAKVAGGTMNITNLAVYPEAHAFVVHKVNGRLSKTQSVLDGQVTPCISQPDRTAKTSYNLGLSASIRPDAKMEYGIGYDAQIASKYTAHQGTL

SEQ ID NO: 19679 - protein, 251 aa, Klebsiella variicola
TQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDLTLQYQGKNEGREAKKQNGDGVGTSLSYDFGGSDFAVSAAYTSSDRTNDQNLLARGQGSKAEAWATGLKYDANNIYLATMYSETRKMTPISGGLPTKRRTLKR

SEQ ID NO: 19680 - protein, 375 aa, Klebsiella variicola
TASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 19681 - protein, 305 aa, Helicobacter pylori
MKKALLLTLSLSFWLHAERNGFYLGLNFLEGSYIKGQGSIGKKASAENALNEAINNAKNSLFPNTKAIRDAQNALNAVKDSNKIASRFAGNGGSGGLFNELSFGYKYFLGKKRIIGFRHSLFFGYQLGGVGSVPGSGLIVFLPYGFNTDLLINWTNDKRASQKYVERRVKGLSIFYKDMTGRTLDANTLKKASRHVFRKSSGLVIGMELGGSTWFASNNLTPFNQVKSRTIFQLQGKFGVRWNNDEYDIDRYGDEIYLGGSSVELGVKVPAFKVNYYSDDYGDKLDYKRVVSVYLNYTYNFKNKH

SEQ ID NO: 19682 - protein, 830 aa, Pseudomonas fluorescens
MTPSPFTHPRRPRPFRFGSAVILGWLLLLAAGLHAATAPHKHYEIPAGDAAQTLKQFVEQSGEQVIFLVDKVRGVTTRAVRGEFDARAALDRMLEGTELYVIQDEPSRALVVNRGARKPRPPPHPPPQPGPGARHERTPPGSTANAPPDEVVRLPTFTIASARDDSYVGKEALSTTRTGVELLDLPQSVKVINRAFLDDLSPGLLIDTLKYVGGGQAGNINFADDRFTLRGFASPADIGDFVDGFRGKTDSNTESAIIERLEIIKGPSAIFVANGPVGGVINKVIKGPVSYHLGSLRLQTGLFDAHRAELDLGGPITADGKWLYRFVAAGQYSNGWYDRTYAHRLALAPSLAYVFSATSRLTVKYNYLLYRFSSYNGLPFDERTGRMLALERQQHFGEAAPLNGRKDVVHRVFAEYTNRLNEHLALRLAGFANYNNAARIESVNGSSIPVTFAPGQLIPRSTTAQDRRHYRYQLQLDTVSTFSTGPLAHRLLVGGELADAPDIVASFAGTSSPIDPDHLHFPGIVAVDTAAPSSYLKTNNRQAKAFVLETVSLAEGRLQLSAGASHVRAGTWSENRLAHTTTPKLRLNQALHQYGVVLKPRPGLAVFYGYNENFAPNFLNGRVLPSQLGQQHEVGLKTDLFTGRLQMNLAWFDISQANVPVLSFPQTTPPTFVLVPGQTSRGFDGDITFQAARNLDLIFTFADLNADARSQANSAAPVLINPVNNVAERTLGLWARYKFTNDRLDGLSLGLGLSHLSRRAITSNNNAVVYGWLDPFTLVDLALAYERGAFRYALNIDNVFNTEYEASVRNPSILVPGMDTNLKASVTWKF

SEQ ID NO: 19683 - protein, 282 aa, Ehrlichia ruminantium
MNKNKSIIIGTALTFLLAFSPIESFSANQTDETIPITAPISGIYFTGQYKPGISNFSNFSAKETNYNTQKLVRLKKDAKESNLLGTTTNFEDTYSVKFQNNIISFSGIIGYATSKGIRLEIEGAYESFDVKSPVGYSKDNAYYRYFALARSMTKENPKEFTVMKNNGLSVASIMINGCYDFALDDFALSPYICAGIGEDFIEFFDALHIKIAYQGKLGISYRVSPKISLFVDGYYHHIIGNQFKNLSVHHAVELSEFPKNSSAVATLDIGYLGGEVGARFIF

SEQ ID NO: 19684 - protein, 179 aa, Enterobacteria phage mep503
AEFFDGRLNASLAYFEVKETNRSVPDDAYNNLTPTPSNYAFKGSKATTKGYELEVSGELAPGWQVQGGYTHKVVRDSNEREAVETFEPEDGFSLYTTYKLTGDLDKITLGGGGTLAEQAWQQIWNNPKGVNEDITQESYWVVDLMTRYQITQNLSATLNVNNLFDKYYYTNVGFYNSAI

SEQ ID NO: 19685 - protein, 316 aa, Neisseria meningitidis
MKKSLIALTLAALPVAAMADVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADLHQRLRPSGCRCGIRLLQTHFCLGFCRLVARRQRRKQI

SEQ ID NO: 19686 - protein, 382 aa, Pseudomonas paucimobilis
LSALPLAAVADVSLYGEIKAGVEGRNYQLQLTEAQAANGGASGQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASIGLRHKF

SEQ ID NO: 19687 - protein, 315 aa, Neisseria meningitidis
MKKSLIALTLAALPVAAMADVTLYGTIKAGVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDNVKIEKYQIHRLVSGYDNDALYASVAVQQQDAKLVEDNSHNSQTEVAATLAYRFGNVTPRVSYAHGFKGSFDDADLSNDYDQVVVGAEYDFSKRTSALVSAGWLQEGKGENK

SEQ ID NO: 19688 - protein, 316 aa, Neisseria meningitidis
MKKSLIALTLAALPVAAMADVTLYGTIKAGVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNYSHNSQTEVAATLAYRFGNVTPRVSYAHGFKGSFDDADLSNDYDQVVVGAEYDFSKRTSALVSAGWLQEGKGENK

SEQ ID NO: 19689 - protein, 327 aa, Neisseria meningitidis
MKKSLIALTLAALPVAAMADVTLYGTIKAGVETSRSVTHHGAQAYRVKTATEIADLGSKIGFKGQEDLGNGLKAIWQLEQKAYVSGTDTGWGNRQSFIGLKGGFGKVRVGRLNNILKDTGGFNPWEGKSYYSGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWRDDNSHNSQTEVATTVAYRFGNVTPRVSYAHGFKGSVYDADHDNTYDQVVVGAEYDFSKRTSALVSAGWLQRGKGTEKFVATVGGVGLRHKF

SEQ ID NO: 19690 - protein, 200 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGISYDVTPEVKPYAGARYFGSYGANFDKTDEDGKGELKVLYSTVGAEAGVAFNF

SEQ ID NO: 19691 - protein, 1629 aa, Rickettsia sp. BJ-90
STATIVASFAGSAMGAAIQQNRTTNADATTVDGAGFDQTAVPANVAVPLNAVITANVHKGINLNTPAGSFNGLFLNTANNLAVTVSEDTTLGFITHVVNNANFFNLTLNAGKTLTITGQGITNVQAAATKNAQNVVVQVNNGAAIENNDLQGVGTIDFGAAASTLVFNLTNPTTQKAPLILGDNAVIVNGANGTLNVTNGFIKVSSKSFATVNAINIGDGQGIIFNTDANNANALNLQAGGTAINFNGTDGTGRLVLVSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGTIDFQANGGTIKFTSTQDNIVVHFDLAIITDQTGVVDASSLTNAQTLTINGKIGTIGANNKTLGQFNIGSSKTALSDGDVAINELVIGNNGAVQFAHNTYLITSTTNAAGQGKIIFNPVVNNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIAANSTLQIGGNYTADFVASADGTGIVEFVNTDPITVTLNKQAAPINALKQITVSGPGNVVINEIGNAGNYHGAVTDTIAFENSSLGTVVFLPRGIPFNDAGNIMPLTIKSTVGNKTATGFDVPSVIVLGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSDTPVASVRFTGSDGGAGLQGNIYSQVIDFGTYNLGILNSNVILGGGTTAINGKINLLTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIASGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 19692 - protein, 314 aa, Pseudomonas sp. MFY338
TLGLAIGSLIAATSFGALAQGQGAVEIEGYAKKQYFDSDRNFKNDGILPGGSIGYFLTDDVELRLAYDEVHNAVTDDGQNVKGANTALDALYHFNNPGDLVRPYVSAGFSDQSIDQNGSNGRNRSTFANAGGGAKLYFTENFYARAGVEAQYNIDQGNTEWAPSVGIGVNFGGGSKPAAPAPAPEVCSDSDNDGVCDNVDKCPDTPANVTVDADGCPAVAEVVRVELDVKFDFDKSVVKENSYGDIKNLADFMKQYPSTTTTVEGHTDSVGPDAYNQKLSERRANAVKQVLTNQYGVESSRVQSVGYGESRPVA

SEQ ID NO: 19693 - protein, 316 aa, Pseudomonas sp. MFY315
TLGLAIGSLIAATSFGALAQGQGAVEIEGFAKKEQFDSARNFKNNGNLFGGSIGYFLTDDVELRLGYDEVHNVRSDDGRNIKGANTALDALYHFNNPGDMLRPYVSAGFSDQSIGQNGSGGRNRSTFANVGGGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESSRVQSVGYGESRPVA

SEQ ID NO: 19694 - protein, 316 aa, Pseudomonas sp. MFY314
TLGLAIGSLIAATSFGALAQGQGAVEIEGFAKKEQFDSARNFKNNGNLFGGSIGYFLTDDVELRLGYDEVHNVRSDDGKNVKGANTALDALYHFNNPGDMLRPYVSAGFSDQSIDQNGSNSRDRSTFANVGGGAKLYFTDNFYARAGVEAQYNIDKGDTEWAPSVGIGVNFGGGSKPAAAPVPAPAEVCSDSDNDGVCDNVDKCPDTPANVTVDADGCPAVAEVVRVELDVKFDFDKSVVKTNSYGDIKNLADFMKQYPSTTTTVEGHTDSVGPDAYNQKLSERRANAVKQVLTNQYGVESARVQSVGYGESRPVA

SEQ ID NO: 19695 - protein, 316 aa, Pseudomonas sp. MFY245
TLGLAIGSLIAATSFGALAQGQGAVEIEGFAKKEYFDSTRNFKNDGNLFGASVGYFVTDDVELRLGYDEVHNVRSDSGQNIKGANTALDALYHFNNPGDMLRPYVSAGFSDQSIDQNGSNGRDRSTFANVGGGAKLYFTDNFYARAGVEAQYNIDQGNTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESSRVQSVGYGESRPVA

SEQ ID NO: 19696 - protein, 314 aa, Pseudomonas sp. MFY234
TLGLAIGTLIAATSFGALAQGQGAVEIEGYAKKQYFDSDRNFKNDGILPGGSIGYFLTDDVELRLAYDEVHNAVTNDGKNVKGANTALDALYHFNNPGDMLRPYVSGGFSDQSIDQFGSNSRDRSTFANVGGGAKLYFTDNFYARAGVEAQYNIDQGNTEWAPSVGVGVNFGGGSKPVAPAPVPEVCSDSDNDGVCDNVDKCPDTPANVTVDADGCPAVAEVVRVELDVKFDFDKSVVKPNSYGDIKNLADFMTQYPSTTTTVEGHTDSVGPDAYNQKLSERRANAVKQVLTNQYGVESSRVQSVGYGESRPVA

SEQ ID NO: 19697 - protein, 296 aa, Pseudomonas sp. MFY222
TLGLAIGSLIAATSFGVLAQGQGAVEGELFYKKQYNDSVKHIEDGFNPGARIGYFLTDDVSIDLNYDQTHHTRSNDGTGNQKIKGDTGFLLGTYHFGQAGVDCLRPYVSGGFGHQSRTSVKADGHSGRDQSTLAIVGTGVKYYFTDNLFARAGVEADYAMDNGKWDYSALVGLGVNFGGNAGAVAPAPVPAPAPEPEPEAPVAEVVRVELDVKFDFDKSVVKPNSYADVKNLADFMKQYPQTTTVVEGHTDSVGPDAYNQKLSQRRADAVKQVLVKDGIDAGRVSSVGYGESRPVA

SEQ ID NO: 19698 - protein, 315 aa, Pseudomonas sp. MFY162
TLGLAIGSLIAATSFGALAQGQGAVEIEGYAKKQYFDSDRNFKNDGILPGGSIGYFLTDDVELRLSYDEVHNAVTDDGQDVKGSNAALDGLYHFNNPGDMVRPYLSGGFSHQSIDQNGSGGRNHSTFANVGGGAKLYFTENFYARAGVEAQYNIDQGNTEWAPSVGIGVNFGGGSKPAPAPVPASEVCSDSDNDGVCDNVDKCPDTPANVTVDADGCPAVAEVVRVELDVKFDFDKSVVKPNSYGDIKNLADFMKQYPSTSTTVEGHTDSVGPDAYNQKLSERRANAVKQVLTNQYGVESSRVQSVGYGESRPVA

SEQ ID NO: 19699 - protein, 316 aa, Pseudomonas sp. MFY161
TLGLAIGSLVAATSFGALAQGQGAVETELFYKKEFFDSQRDFKNDGNLFGGSIGYFLTDDVELRLGYDEVHNARGEDGKNIKGSNTALDAVYHFNNPYDAIRPYVSAGFSHQSLGQTGRGGRNHSTFANVGAGAKWYITDMFYARAGVEAQYNIDQGDTEWAPSVGIGMNFGGSPKQAEAAPAPVAEVCSDSDNDGVCDNVDKCPDTPANVTVDADGCPAVAEVVRVELDVKFDFDKSVVKPNSYGDIKNLADFMKQYPQTTTTVEGHTDSVGPDAYNQKLSERRANAVKQVLTQQYGVESSRIDSVGYGETRPVA

SEQ ID NO: 19700 - protein, 316 aa, Pseudomonas sp. MFY160
TLGLAIGSLIAATSFGALAQGQGAVEIEGFAKKEQFDSARNFKNNGNLFGGSIGYFLTDDVELRLGYDEVHNVRADDGKNVKGANTALDALYHFNNPGDMIRPYVSAGFSDQSIDQNGSNGRNRSTFANVGGGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESSRVQSVGYGESRPVA

SEQ ID NO: 19701 - protein, 297 aa, Pseudomonas sp. MFY146
TLGIAIGSFVAATSFGALAQGQGAVEGELFYKKQYNDSVNHVEDGYNPGASIGYFITDDVSINFAYDKTNHTRSNDGTGHQKLQGDNFGLNAQYHFGTVGDALRPYVSGGVAHKSMTNVEADGHSGRDKSTFLTAGAGVKWYITDNLFARAGVEADYKLDNGRWDYAPTVGLGVNFGGSGGKVAPAPVPAPAPIAEPEPEAPIAEVVKVELDVKFDFDKAVVKSQYLPDIKNVAQFMQQYPATSTTVNGYTDSVGTDAYNLKLSQRRADSVRQALVQQGVSACRVDAVGHGKADPVA

SEQ ID NO: 19702 - protein, 316 aa, Pseudomonas sp. MFY143
TLGFAIGSLIAATSFGALAQGQGAVEIEGFAKKEMFDSARDFKNNGNLFGGSVGYFLTDDVELRLAYDEVHNARTEDGTNVKGANTALDALYHFNNPGDMLRPYVSAGFSDQSIDQNGSNGRNRSTFANVGGGAKLYFTDNFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKENSYGDIKNLADFMKQYPSTSTTVEGHTDSVGPDAYNQKLSERRANAVKQVLTNQYGVESTRVQSVGYGESRPVA

SEQ ID NO: 19703 - protein, 318 aa, Pseudomonas sp. MFY140
TLGLAIGSLVAVTSLGALAQGQGAVEIEGNVTKQFYDSERNFKNDGTNPGVRLGYFLTDDVSLDLGYNETHNARGEVFNKDIKGSKTKLDATYHFGTVGDALRPYVSAGFAHESLGQATRSGRDHSTFANVGAGAKWYITDMFFARAGVEAMYNIDNGNTEWGPTVGLGLNFGGSGGQKAAPAPAPVAEVCSDSDNDGVCDNVDKCPDTPANVTVDADGCPAVAEVVRVELDVKFDFDKSVVKPNSYGDIKNLADFMKQYPQTTTTVEGHTDSVGPDAYNQKLSERRANAVKQVLTQQYGVESSRVDSVGYGETRPVA

SEQ ID NO: 19704 - protein, 320 aa, Pseudomonas sp. MFY138
TLGLAIGTLIAATSFGALAQGQGAVEGELNYGKKYNDSVKNVEDGYTPGASIGYFLTDDVSLNLTYNADDYTRSNNGTGHQKIEGDQFGLNAQYHFNNAGDALRPYVQGGVKHGSMSNVEADGHGGRDQSTFLTAGAGVKYYFVENVYARAGVEADYKLDNGKWDYIPSIGLGVNFGGGNKPVAAAPAPAEVCSDSDNDGVCDNVDKCPNTPANVTVDADGCPAVAEVVRVELDVKFDFDKSVVKPNSYGDIKNLADFMKQYPSTTTTVEGHTDSVGPDAYNQKLSERLANAVKQVLTNQYGVEASRVQSVGYGESRPVA

SEQ ID NO: 19705 - protein, 316 aa, Pseudomonas sp. MFY122
TLGLAIGSLIAATSFGALAQGQGAVEIEGFAKKEQFDSARNFKNNGNLFGGSIGYFLTDDVELRLGYDEVHNVRSDDGRNIKGANTALDALYHFNNPGDMLRPYVSAGFSDQSIGQNGSGGRNRSTFANVGGGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESARVQSVGYGESRPVA

SEQ ID NO: 19706 - protein, 316 aa, Pseudomonas sp. MFY107
TLGLAIGSLIAATSFGALAQGQGAVEIEGFAKKEQFDSARNFKNNGNLFGGSIGYFLTDDVELRLGYDEVHNVRSDDGRNIKGANTALDALYHFNNPGDMLRPYVSAGFSDQSIGQNGSGGRDRSTFANLGAGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESSRVQSVGYGESRPVA

SEQ ID NO: 19707 - protein, 316 aa, Pseudomonas sp. MFY82
TLGLAIGSLIAATSFGALAQGQGAVEIEGFAKKEQFDSARNFKNNGNLFGGSIGYFLTDDVELRLGYDEVHNVRADDGKNVKGANTALDALYHFNNPGDMIRPYVSAGFSDQSIDQNGSNGRNRSTFANVGGGAKLYFTENFYARAGVEAQYNIDQGDTEWAPSVGIGVNFGGGSKPAAAPVPAPAEVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESARVQSVGYGESRPVA

SEQ ID NO: 19708 - protein, 298 aa, Pseudomonas sp. MFY79
TLGLAIGSLIAATSFGVLAQGQGAVEGELFYKKQYNDSVKHIEDGFNPGARIGYFLTDDLSLNLSYDKTNHTRSNDGTGNQKIKGDTGSLVAQYHFGQAGVDSLRPYVEGGFGHQSRTNVQADGHSGRDQTTFATIGTGVKYYFTNNLYARAGVEADYGLDNGKWDYSALVGLGVNFGGNAGAAAPAPTPAPAPEPVPEPEAPVAQVVRVELDVKFDFDKAVVKPNSYGDVKNLADFMAQYPATNVEVAGHTDSVGPDAYNQKLSQRRADAVKQVLVKDGVAPSRVTAVGYGESRPVA

SEQ ID NO: 19709 - protein, 316 aa, Pseudomonas sp. MFY78
TLGLAIGSLVAATSIGAMAQGQGAVETEIFYKKEFFDSQRDFKNDGNLFGGSIGYFLTDDVELRLGYDEVHNARGEDGKNIKGSNTALDAVYHFNNPYDAIRPYVSAGFSHQSLGQTGRGGRDHSTFANVGAGAKWYITDMFYARAGVEAQYNIDQGDTEWAPSVGVGLNFGGSPKQAEAAPAPVAEVCSDSDNDGVCDNVDKCPDTPANVTVDADGCPAVAEVVRVELDVKFDFDKSVVKPNSYGDIKNLADFMKQYPQTTTVVEGHTDSVGPDAYNQKLSERRANAVKQVLTQQYGVESSRVDSVGYGETRPVA

SEQ ID NO: 19710 - protein, 315 aa, Pseudomonas sp. MFY76
TLGLAIGSLIAATSIGALAQGQGAVEIEGYAKKQYFDSDRNFKNDGILPGGSIGYFLTDDVELRLSYDEVHNAVTDDGQNVKGANTALDALYHFNNPGDMLRPYVSGGFSDQSIDQNGSNGRNRSTFANVGGGAKLYFTDNFYARAGVEAQYNIDQGNTEWAPSVGIGVNFGGGSKPAAAPVPAPEVCSDSDNDGVCDNVDKCPDTPANVTVDADGCPAVAEVVRVELDVKFDFDKSVVKPNSYGDIKNLADFMKQYPSTSTTVEGHTDSVGPDAYNQKLSERRANAVKQVLTNQYGVESSRVQSVGYGESRPVA

SEQ ID NO: 19711 - protein, 314 aa, Pseudomonas sp. MFY72
TLGLAIGTLIAATSFGALAQGQGAVEIEGYAKKQYFDSDRNFKNDGVNPGGSIGYFLTDDVELRLAYDEVHNAVTNDGKNVKGANTALDALYHFNNPGDMLRPYVSGGFSDQSIDQFGSNSRDRSTFANVGGGAKLYFTDNFYARAGVEAQYNIDQGNTEWAPSVGVGVNFGGGSKPVAPAPVPEVCSDSDNDGVCDNVDKCPDTPANVTVDADGCPAVAEVVRVELDVKFDFDKSVVKPNSYGDIKNLADFMTQYPSTTTTVEGHTDSVGPDAYNQKLSERRANAVKQVLTNQYGVESSRVQSVGYGESRPVA

SEQ ID NO: 19712 - protein, 297 aa, Pseudomonas sp. MFY71
TLGIAIGSIVAVTSFGVLAQGQGAVEGELFYKKQYNDSVKHIEDGFNPGARIGYFLTDDLSLDLNYDKTNHTRSNDGTGNQKIKGDTGSLLATYHFGQAGVDSLRPYVSGGFGHQSRTNVQADGHSGRDQSTLAIVGTGVKYYFTDNLFARAGVEADYAMDNGKWDYSALVGLGVNFGGNAGKVAPAPAPVPEPTPEPEAPVAEVVRVELDVKFDFDKSVVKPNSYADIKNLADFMKQYPQTTTVVEGHTDSVGPDAYNQKLSERRANAVKQVLTSQYGVESSRVQSVGYGESRPVA

SEQ ID NO: 19713 - protein, 317 aa, Pseudomonas sp. MFY69
TLGLAIGSLVAATSLGALAQGQGAVEVEGFYKKEYFDSQRDFKNDGNLFGGSIGYFLTDDVELRLGYDEVHNARGEDGKNIKGSNTALDALYHFNNPGDLVRPYVSAGFSDQSIGQTGRGGRNGSTFANLGAGAKLYFTDNFYARAGVEAQYNIDQGDTEWAPSVGVGLNFGGGSKPAAAPAPAPVADVCSDSDNDGVCDNVDKCPDTPANVTVDADGCPAVAEVVRVELDVKFDFDKSVVKPNSYGDIKNLADFMKQYPSTTTTVEGHTDSVGPDAYNQKLSERRASAVKQVLTGQYGVESSRVQSVGYGESRPVA

SEQ ID NO: 19714 - protein, 318 aa, Pseudomonas sp. MFY65
TLGLAIGSLVAATSFGVLAQGQGAVEIEGNVTKQYYDSERNFKNDGTNPGVRLGYFLTDDVSLDLGYNETHNARGEVFNKDIKGSKTKLDATYHFGTVGDALRPYVSAGFAHESLGQATRNGRDHSTFANVGAGAKWYITDMFFARAGVEAMYNIDNGNTEWGPTVGLGLNFGGSGGQKAAPAPAPVAEVCSDSDNDGVCDNVDKCPDTPANVTVDADGCPAVAEVVRVELDVKFDFDKSVVKPNSYGDIKNLADFMKQYPQTTTTVEGHTDSVGPDAYNQKLSERRANAVKQVLTQQYGIESSRVDSVGYGETRPVA

SEQ ID NO: 19715 - protein, 297 aa, Pseudomonas sp. MFY63
TLGIAIGSFVAATSFGALAQGQGAVEGELFYKKQYNDSVNHVQDGYNPGASIGYFITDDVSINFAYDKTNYTRSSTNTGNQKLQGDNFGLNAQYHFGTVGDALRPYVSGGVAHKSLSNVVADGHSGRDKSTFLTAGAGVKWYITDNLFARAGVEADYKLDNGRWDYAPTVGLGVNFGGSGGKVAPAPVPAPAPIAEPEPEAPIAEVVKVELDVKFDFDKAVVKSQYLPDIKNVAQFMQQYPATSTTVNGYTDSVGTDAYNLKLSQRRADSVRQALVQQGVSPSRVDAVGHGKSDPVA

SEQ ID NO: 19716 - protein, 316 aa, Pseudomonas sp. MFY61
TLGLAIGSLIAATSVGALAQGQGAVEIEGFAKKEYYDSQRDFKNDGNLFGGSVGYFLTDDVELRLGYDEVHNVRSDSGKNIKGSNTALDALYHFNNPGDMLRPYVSAGFSDQSIGQNDRGGRDGSTFANVGGGAKLYFTDNFYARAGVEAQYNIDKGDTEWAPSVGIGVNFGGGSKPAAAPVPAPAEVCSDSDNDGVCDNVDKCPDTPANVTVDADGCPAVAEVVRVELDVKFDFDKSVVKTNSYGDIKNLADFMKQYPSTTTTVEGHTDSVGPDAYNQKLSERRANAVKQVLTNQYGVESSRVQSVGYGESRPVA

SEQ ID NO: 19717 - protein, 317 aa, Pseudomonas sp. MFY57
TLGLAIGSLVAATSFGVLAQGQGAVEIEGNVTKQYYDSERNFQNDGTNPGVRLGYFLTDDVSLDLGYNETHNARGEVFNKDIKGSKAKLDATYHFGTVGDALRPYVSAGFAHESLGQATRSGRDHSTFANVGAGAKWYITDMFFARAGVEAMYNIDNGNTEWGPTVGVGLNFGGSGGKVAPAPAPVAEVCSDSDNDGVCDNVDKCPDTPANVTVDADGCPAVAEVVRVELDVKFDFDKSVVKPNSYGDIKNLADFMKQYPQTTTVVEGHTDSVGPDAYNQKLSERRANAVKDVLTQQYGVESTRVDSVGYGETRPVA

SEQ ID NO: 19718 - protein, 159 aa, Pseudomonas sp. MFY33
TKVGNMKIKKGTDDVDPFKASFIGGGAAFGYKMDDIRVDIEGLYSQLNKNVNNDEVLTPDTVAGSLTAISGLVNVYYDIAIEDMSITPYVGVGVGAAYISAPLKDAVNGQKSKFGFAGQVKAGVSYDVTPEVKLYAGARYFGSYGANFDKSSDEKNNTV

SEQ ID NO: 19719 - protein, 321 aa, Pseudomonas sp. MFY32
TLGLAIGSLIAATSFGALAQGQGAVEGEINYKKQYNDSIDHVEDGFNPGAKIGYFLTDDVSINFGWDRNNHTRSNDGTGSQKLRGDNFGLTAQYHFNNAGDALRPYVEGGVKHGNLTNVAADGHTGRDQSTFLTAGAGVKYYFAENFFARAGVEADYKLDNGRWDYAPSVGLGVNFGGGGKPAAAPVPAPAEVCSDSDNDGVCDNVDKCPDTPANVTVDADGCPAVAEVVRVELDVKFDFDKSVVKPNSYADIKNLADFMKQYPATHTTVEGHTDSVGPDAYNQKLSERRANAVKQVLTQQYGVETARVQSIGYGESRPVA

SEQ ID NO: 19720 - protein, 316 aa, Pseudomonas sp. MFY31
TLGLAIGSLIAATSFGALAQGQGAVEIEGFAKKEMFDSARDFKNNGNLFGGSVGYFLTDDVELRLAYDEVHNARAEDGRNIKGSNTALDALYHFNNPGDMLRPYVSAGFSDQSIGQNGKSGRNGSTFANVGGGAKLYFTDNFYARAGVEAQYNIDQGDTEWAPSVGIGVNFGGGSKPAAAPVPAPAEVCADSDNDGVCDNVDKCPDTPANVTVDADGCPAVAEVVRVELDVKFDFDKSVVKPNSYGDIKNLADFMKQYPSTTTTVEGHTDSVGPDAYNQKLSERRANAVKQVLTNQYGVESARVQSVGYGESRPVA

SEQ ID NO: 19721 - protein, 359 aa, Pseudomonas paucimobilis
MFYRLSLILIMALLAGQLSAQEWSFDSSQLEGNVSADTVAMFNQGEQLPGNYRVEIYLNGEKVDVGEFPFHRPESPEEKELVPCLTVDDLIHYGIKIDKSSSDTDNKKNQCFKWNSIEGLKVNYDFDSQRVQITVPQLYLQDKKSSLAPVSLWNEGVAAFRMVYQTNIDISKQNDNQSTTRNSRYGRFTPGFNLGAWRFRSSVTWSKELGQSERWQRGYMWFERGINAIKSRLTLGESYTSSEVFDSIPFRGGMLATDDAMTPPEDSYYTPVVHGIAQSEAQVIIKQNGQIIFTRSVPPGPFALDNLPTLAVGGELDVTVRESNGEEQYFSVPFQTPAIALHEGYFKYSVMGGNIKKKV

SEQ ID NO: 19722 - protein, 396 aa, Pseudomonas paucimobilis
MVMIKKTVVLGLVSIGSVSAQAQSSVTLYGVVDAGIAYTNNQGGASNIQQTSGKLSGSRWGLKGAEDLGGGLQAVFTLESGFRPSDGGLGQGGRLFGRSAYVGLGQKGVGTLTFGRQYEPITDLVAQYSGAGFWSPATHVGDNDNLNQSFRLNNAVKFRSDTIAGFTADLLYAFSNQANGGTGTGFSNNNAWGASANYVNGPLSIGGGYVRFNHPNAASNTSGAVGGATSTTGNDYSGAFFYGLNGGVLKQQIGAVGANYALGPATLGFAWSHTQLNYLDGSSRKFNNYDVNARYQITPAATLIGVYTFTDGRASGLPGTSGQTLKPRWHQFTLGFDYALSKRTDIYVSGIYQLAAGDASTATSGGYRKIAAISNIGSASSTNRQLAFVSGLRVKF

SEQ ID NO: 19723 - protein, 144 aa, Wolbachia endosymbiont
GPISDEETSYYVRLQYNGEILPLFTKIDGITNATGKEKDSPLKASFIAGGGAFGYKMDDIRVDVEGLYSWLNKDANVVGDTVADNLTAISGLVNVYYDIAIEDMPITPYVGVGVGAAYVSNPLATKVTDDKASGFGVAYQAKAG

SEQ ID NO: 19724 - protein, 201 aa, Wolbachia endosymbiont
GPISDEETSYYVRLQYNGEILPLFTKVDGITYKKDNSDYSPLKASFIAGGGAFGYKMDDIRVDVEGVYSYLNKNDVTDAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFN

SEQ ID NO: 19725 - protein, 201 aa, Wolbachia endosymbiont
GPISDEETSYYVRLQYNGEILPLFTKVDGITYKKDSSDYSPLKASFIAGGGAFGYKMDDIRVDVEGVYSYLNKNDVTDAKFTPDNIIADSLTAISGLVNVYYDVAIEDMPITPYIGVGVGAAYISTPLATAVSSQNGKFAFAGQARAGVSYDVTPEIKLYAGARYFGSYGANFDKTDKDGKGEFKVLYSAVGAEAGVAFNF

SEQ ID NO: 19726 - protein, 196 aa, Wolbachia endosymbiont
GPISDEETSYYVRLQYNGEILPLFTKTDGITNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVAFNF

SEQ ID NO: 19727 - protein, 199 aa, Wolbachia endosymbiont
GPISDEETSYYVRLQYNGEILPLFTKIDGITNATGKEKDSPLKASFIAGGGAFGYKMDDIRVDVEGLYSQLSKDATIINTSETNVADSLTAFSGLVNVYYDIAIEDMPITPYIGVGVGAAYISNPSKVDLVKDQRGFGFAYQAKAGVSYDVTPEIKLYAGARYFGSYGANFDKTVKDDAGIKGVLYSTVGAEAGVAFNF

SEQ ID NO: 19728 - protein, 197 aa, Wolbachia endosymbiont
GPISDEETSYYVRLQYNGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTVG

SEQ ID NO: 19729 - protein, 201 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFN

SEQ ID NO: 19730 - protein, 196 aa, Wolbachia endosymbiont
GPISDEETSYYVRLQYNGEILPLFTKIDGITNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKVTKEAAVIKVLYSTVGAEAGVAFNF

SEQ ID NO: 19731 - protein, 197 aa, Wolbachia endosymbiont
GPISDEETSYYVRLQYNGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYVGVGVGAAYISTPLATAVSSQNGNFAFAGQARAGVSYDITPEIKLYAGARYFGSFGAHFDKDTAAASKDKGELKVLYSTVG

SEQ ID NO: 19732 - protein, 181 aa, Wolbachia endosymbiont
GPISDEETSYYVRLQYNGEILPLFTKIDGITNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKV

SEQ ID NO: 19733 - protein, 189 aa, Wolbachia endosymbiont
GPISDEETSYYVRLQYNGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGEL

SEQ ID NO: 19734 - protein, 197 aa, Wolbachia endosymbiont
GPISDEETSYYVRLQYNGEILPLFTKVDGITNVTGKEKDSPLKASFIAGGGAFGYKMDNIRVDVEGLYSQLNKNAVTGAAFNPDTVADSLTAFSGLVNVYYDIAIEDMPITPYIGVGVGAAYISNPSKVDAVKDQRGFGFAYQAKAGVSYDVTPEIKLYAGARYFGSYGANFDKTAKDDAGIKGVLYSTVGAEAGVA

SEQ ID NO: 19735 - protein, 195 aa, Wolbachia endosymbiont
GPISDEETSYYVRLQYNGEILPLFTKIDGITNATGKEKDSPLKASFIAGGGAFGYKMDDIRVDVEGLYSWLNKDANVVGDTVADNLTAISGLVNVYYDIAIEDMPITPYVGVGVGAAYVSNPLATKVTDDKASGFGVAYQAKAGNHYDGTPEVKHFAGTRYRGSHGASFGKVTKDKGELKVLYSTVGAEAGVAFN

SEQ ID NO: 19736 - protein, 197 aa, Wolbachia endosymbiont
GPISDEETSYYVRLQYNGEILPLFTKIDGITNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVESLVR

SEQ ID NO: 19737 - protein, 196 aa, Wolbachia endosymbiont
GPISDEETSYYVRLQYNGEILPLFTKIDGIENTAGKEKDSPLKASFIAGGGAFGYKMDDIRVDVEGLYSWLNKDADVVGDTVADNLTAISGLVNVYYDVAIEDMPITPYIGVGVGAAYISTPLATAVSSQNGKFAFAGQARAGVSYDVTPEIKLYAGARYFGSYGANFDKTDKDGKGELKVLYSTVGAEAGVAFNF

SEQ ID NO: 19738 - protein, 206 aa, Wolbachia endosymbiont
GPISDEETSYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTVGAEAGVAFNF

SEQ ID NO: 19739 - protein, 197 aa, Wolbachia endosymbiont
GPISDEETSYYVRLQYNGEILPLFTKVDGATGAKKKTADTDTTTDLYKASFMAVGGAFGYKMDDIRVDAEGLYSQLSKDTLDVAPTPALADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTVG

SEQ ID NO: 19740 - protein, 200 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVCYDIAIEDMPITPYIGVGVGAAYISTPLATAVSSQNGKFAFAGQARAGVSYDVTPEVKLYAGARYFGSYGANFDKTDEDGKGELKVLYSTVGAEAGVAFNF

SEQ ID NO: 19741 - protein, 201 aa, Wolbachia endosymbiont
GPISDEETSYYVRLQYNGEILPLFTKIEGIEYKKATDIHNPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 19742 - protein, 196 aa, Wolbachia endosymbiont
GPISDEETSYYVRLQYNGEILPLFTKVDGITYKKDNSDYSPLKASFIAGGGAFGYEMDDIRVDVEGVYSYLNKNDVTDAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 19743 - protein, 202 aa, Wolbachia endosymbiont
GPISDEETSYYVRLQYNGEILPLFTKVDGITYKKDNSDYSPLKASFIAGGGAFGYKMDDIRVDVEGVYSYLNKNDVTDAKFTPDTIADSLTAISGLVNVYYDIVIEDMPITPYIGVGVGAAYISTPLKDAVNDQKSKFGFAGQAKAGVSYDVTPEVKLYAGARYFGSFGAHFDKDAAAGKDKGELKVLYSTVGAEAGVAFNF

SEQ ID NO: 19744 - protein, 203 aa, Wolbachia endosymbiont
GPISDEETSYYVRLQYNSGILPLFTKIEGIEYKRPTDIHNPFKASSIAGGGAFGYKMDDIRVDVEGLYSQLNKNDVTGAAFNPDTVADSLTAISGLVNVYYDIAIEDMPITPYVGAGVGAAYISTPLKDAVNDQKSKFGFAGQVKAGVSYDVTPAVKLYAGARYFGSFGAHFDKDTAAASKDKGEFKVLYSTVGAEAGVAFNF

SEQ ID NO: 19745 - protein, 202 aa, Wolbachia endosymbiont
GPISDEETSYYVRLQYNGEILPLFTKVDGITYKKDNSDYSPLKASFIAGGGAFGYKMDDIRVDVEGVYSYLNKNDVTDAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 19746 - protein, 196 aa, Wolbachia endosymbiont
GPISDEETSYYVRLQYNGEILPLFTKVDGATGAKKKTADTDTTTDLYKASFMAVGGAFGYKMDDIRVDAEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTV

SEQ ID NO: 19747 - protein, 201 aa, Wolbachia endosymbiont
GPISDEETSYYVRLQYNGEILPLFTKVDGITYKKDNSDYSPLKASFIAGGGAFGYEMDDIRVDVEGVYSYLNKNDVTDAKFTPDTIADSLTAISGLVNVYYDIVIEDMPITPYIGVGVGAAYISTPLKDAVNDQKSKFGFAGQVKAGVSYDVTPEVKLYAGARYFGSFGAHFDKDAAAGKDKGELKVLYSTVGAEAGVAFN

SEQ ID NO: 19748 - protein, 196 aa, Wolbachia endosymbiont
GPISDEETSYYVRLQYNGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTV

SEQ ID NO: 19749 - protein, 196 aa, Wolbachia endosymbiont
GPISDEETSYYVRLQYSGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYIGVGVGAAYISTPLATAVSSQNGKFAFAGQARAGVSYDVTPEVKLYAGARYFGSYGANFDKTDEDGKGELKVLYSTVGAE

SEQ ID NO: 19750 - protein, 202 aa, Wolbachia endosymbiont
GPISDEETSYYVRLQYNGEILPLFTKVDGITYKKDNSDYSPLKASFIAGGGAFGYKMDDIRVGVEGVYSYLNKNDVTDAKFTPDTIAVSLTAISGLVNVYYDIVIEGMPITPYIGVGVGAAYISTPLKDAVNDQKSKFGFAGQVKAGVSYDVTPEVKLYAGARYFGSFGAHFDKDAAAGKDKGELKVLYSTVGAEAGVAFNF

SEQ ID NO: 19751 - protein, 200 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEAGVAFNF

SEQ ID NO: 19752 - protein, 196 aa, Wolbachia endosymbiont
GPISDEETSYYVRLQYNGEILPLFTKIDGITNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVAFNF

SEQ ID NO: 19753 - protein, 144 aa, Wolbachia endosymbiont
GPISDEETSYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQA

SEQ ID NO: 19754 - protein, 1060 aa, Rickettsia rickettsii
ITLQAGGSLDANNIDFGARSTLEFNGPLDGGGNAIPYYFKGAIANGNNAILNVNTKLLTAYHLTIGTVAEINIGAGNLFAIDASAGDVTILNAQDIHFRALDSALVLSNLTGVGVNNILLAADLVAPGADEGTVVFNGGVNGLNIGSNVAGTARNIGDGGGNKFNTLLIYNAVTITDDVNLEGIQNVLINNNADFTSSTAFNAGAIQINDATYTIDANNGNLNIPAGNIQFAHADAQLILQNSSGNDRTITLGANIDPDNDDEGIVILNSVTAGKKLTIAGGKTFGGAHKLQTIVFKGAGDCGAAGTTFNTTNIELNITGQLELGATTANVVLFNDAVQLTQTGNIGGSLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTATLGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVDFTFDASTLTLFAEDIAADVIDEDFAPGGPLANIPNAANIKKSLELMADAPNGSDARQAFNNFGLMTPLQEADATTHLMQDVVKPSDTIAAVNNQVVASNISSNITALNARMDKVQAGNKGPVSSGDEDMDAKFGAWISSFVGNATQKMCNSISGYKSDTTGGTIGFDGFVSDDLALGLAYTRADTDIKLKNNKTGDKNKVESNIYSLYGLYSVPYENLFVEAIASYSDNKIRSKSRRVIATTLENVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 19755 - protein, 998 aa, Rhizobium sp.
MELRTFRKTRLATSLSLVLGVGSIMPAYAADTDKKEENIEVIQVTGIRGSLVRSMDVKRGSEGIVDAINAEDIGKFPDSNLAESLQRISGVSIDRQNGEGSRVSVRGFGADQNLVLLNGRQMPVTTGSRSFDFANIASEAISAVEVEKTAKAENPTGGIGATINVLTHRPLSSPGMKATFGAKAVDDSSTDKGSTTPELSGLYSNTFADDKFGISISGSYQERESGNQQAQVGTGWRSFPGIVDQDYSGPNAEWGGVPKNDNQVNRPGDDDVYSVPQTTIYRFEEQQRKRTNGQLVLQYEPIDSLRATLDYTYMRNDIDTQTHDVSAWFNFVPSQENIWSDGPVSSPLVYSETYDAPADLSMAAGDFGTRDQSGSLGFNLAWEASDNLTLNLDYHNSYAERTPNNVNGSTSNLSTAAFIRTSAATDFSGDVPVLAVGGGNAVRPEDMRVTGSTFTNAVNRSEIEQLQMSGKYDLAEAGSIDFGIAMSDVNNHSQQVDIQRNDWGGVGAAGDLDAAWFPTSSVIDKFDGSKGNFAGYNGNASTDPLNTMFLWDFAAVRARAAELYATSIVGDCGNGFCPSTDYSKGTDRFTEEKSQSAYIQYNFASEIANMPYDVHFGLRYEKTDVESTSVVSSYDTATWIAESEIALTSSVDNNRVYQTQKGDYDYLLPSFNFNIEMLEDVFVRAAFSQTIGRPDYTSIQGGTTVGTLAYRNGGSGSAGNPSLLPLESTNYDLSTEWYYNDASYVSIGYFRKDVSNFISSNPENSDIYNIPDPAHGKYVDEAIAAGATTAIQQRQWIYDKYGATDPNVKINPDNGNIEITGNPGDPSLNFLITNPTNSDLSNVIDGWEFSIQHFFGESGFGIQANYTMVDAGDSYDNTNLGRPGDATQNVILGISDTANLVGIYENYGFSARIAYNWRDEFLNSTGQDTGSNPKYTEAYSQVDFNIGYDVEAVEGLTIFIEGLNITNEATRVHGRATEQVLNYTQTGARYSIGARYTF

SEQ ID NO: 19756 - protein, 471 aa, Alvinella pompejana epibiont 7G3
MKKASQVLFFGAFLSSSLQGFEAKLNGFVDQSSTIGFNQHKINKERGIYPMQQFATIAGYLGLGFSLLPKKVSDHVLKGKIGGMVGSIFYDGTKKFEDSSVAYNLFGYYDGFMGGYTNILQSDDLATQNMKYNKNVRNYVFSDAYLEYAYKNYFEIKAGRYLSTMPYKSGQTQGFQISGQYKKARLTWFSSFGRAFAYGSFLMDWFAARTTYSGGFTKNDKGGYDSHGRKVLYGTHAVQLTYKPHRFLIEGFYYLSPQIFNAPGVKIGWDSNPNFSGTGFRSDTAIIGFFPIYYPWMIVKSNGSPVYKYDTPATQNGQNLIILQRFDINNYNVSIAFYKVFQNANGWIGNMGNPSGVIMGSNSVYAGFTGTALKRDAATIFLSCGGTHFAKKFTWKFATQYSNSVVSWEARAMISLGYKFTEYLSGSVDLAYYGVYTNKGFKPGENGPVPKDFPALYSDRSALYTALVASF

SEQ ID NO: 19757 - protein, 788 aa, Alvinella pompejana epibiont 6C6
MKYRMLSASLGASALLVAAPALHAQQQPAVTAAPIAASAAAAAPITPAASAAAAASTNAAAASGATHANSGAPVAEAQLKDVIVTAQRRRQSAQRVGTSMSVISGSDLKTLNVETVNDLQHATASVEVEPAFGGGQPQFRIRGVGFNDYTSNNASTVGINVDDVAYALPIQTQGQLFDIARVEVLRGPQGTLYGRNTTGGTVNFITNQPTRDFEAGASVEYGTHNLLTTEGYVSGPLSDRVRGRFAFTTQDFGAWQNNRATNQTLGNHDSAAARAQLDWDVARDFKLHFGAHGGFDKSDNTGLYLFTPYTSTKTGEGTPADADHTKTGWGVSPAFSRVTGLSTDAKPGRNNVNGGVDLTATWDLGPVELKSITAYNYLHRREYSDWDATRYHDSDEYFDDTVNEVTQELRASSRGDTRLRWVTGLFYSHDDLDEKFYSDFSDRLGFIALTRYRQSVDTLGVYGQATYDITKRLRGIVGVRQEHEKRELRGFASGMLTPSFVPFAGFQGGDANQSLTSNGTSGKVGLEFDLAPATMLYATVSRGYKSGGFTAHNTGNSSALAPFKPESLTAYEVGFKADLTRSLRWNASAFHYDYRDQQVLSATFDPNSQSLIGTFVNAPKSRIDGFETDLKWQPVRGLEISQYVGYKSGKYTSPFVTYNTQASAASGHNVFTDYNGSALSFPRLSYGGQVAYSWLAGGYRLRAETNYSYRDAYSQLLLLGPNYTVDSYWLVNASLTVTSPDRHWDVALWARNLFNRQYDLTKNFFLPGTNVAAAGEPRTVGVRVTYTY

SEQ ID NO: 19758 - protein, 207 aa, Alvinella pompejana epibiont 6C6
MKKIYLAAFVFGVFSVSSSAEMMPYVGGNIGIGGITSPDADIDNMNYSQESGKLAWSLNTGLLFNSEMNNKFQYGAEVSYSTYATNENRFENLKFDYDGYNIAALGVAKYNFNKKWSIFGKAGAAYTVQELTSNVNVFNKKESKVLPKIGLGASYNITDNFAINASFEHIFGDDLAEFTNKANNHQLSDYTNVGSVSTMYIGMGYSF

SEQ ID NO: 19759 - protein, 162 aa, Serratia plymuthica
DDLDIYTRLGGMVWRADGSANSATKGRYIHSNDTGVSPLAAIGVEYALNKDWATRLDYQFVSNIGDANETAARPHNTLLSVGVTYRFGQDEAAPAPAPAPAPAPVVETKRFTLKSDVLFNFNKATLKPQGQQALDQMYAQLSNLDPKDGSVVVLGYTDRIGS

SEQ ID NO: 19760 - protein, 162 aa, Serratia plymuthica
DDLDIYTRLGGMVWRADSKGNYASTGVSRSEHDTGVSPVFAGGVEWAVTRDIATRLEYQWVNNIGDAGTVGTRPDNGMLSLGVSYRFGQEDAAPVVAPAPAPAPEVATKHFTLKSDVLFNFNKATLKPEGQQALDQLYTQLSNMDPKDGSAVVMGFTDRIGS

SEQ ID NO: 19761 - protein, 157 aa, Klebsiella pneumoniae
DDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGS

SEQ ID NO: 19762 - protein, 162 aa, Klebsiella pneumoniae
DDLDIYTRLGGMVWRADSKGNYASTGVSRSEHDTGVSPVFAGGVEWAVTRDIATRLEYQWVNNIGDAGTVGTRPDNGMLSLGVSYRFGQEDAAPVVAPAPAPAPEVATKHFTLKSDVLFNFNKATLKPEGQQALDQLYTQLSNMDPKDGSAVVLGYTDRIGS

SEQ ID NO: 19763 - protein, 162 aa, Klebsiella pneumoniae
DDLDIYTRLGGMVWRADSKGNYASTGVSRSEHDTGVSPVFAGGLEWAVTRDIATRLEYQWVNNIGDAGTVGTRPDNGMLSLGVSYRFGQEDVAPVVAPAPAPAPEVTTKHFTLKSDVLFNFNKSTLKPEGQQALDQLYTQLSNMDPKDGSAVVLGYTDRIGS

SEQ ID NO: 19764 - protein, 162 aa, Klebsiella oxytoca
DDLDIYTRLGGMVWRADSKANYGNGTRLSDHDTGVSPLAAVGVEYALTKNWATRLDYQFVSNIGDAGTVGARPDNTMLSLGVSYRFGQDDVVAPVAPAPAPAPVVETKRFTLKSDVLFNFNKATLKPQGQQALDQLYTQLSSMDPKDGSVVVLGYTDAEVPL

SEQ ID NO: 19765 - protein, 162 aa, Hafnia alvei
DDLDIYTRLGGMVWRADGSANSATKGRYIDSNDTGVSPLAAIGVEYALNKDWATRLDYQFVSNIGDANETAARPDNTLLSVGVTYRFGQDEAAPAPAPAPAPAPSVETKRFTLKSDVLFNFNKATLKPQGQQALDQMYAQLSNLDPKDGSVVVLGYTDRIGS

SEQ ID NO: 19766 - protein, 161 aa, Hafnia alvei
DDLDVYTRLGGMVWRADTKANVPGGASFKDHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGS

SEQ ID NO: 19767 - protein, 162 aa, Hafnia alvei
DDLDIYTRLGGMVWRADGSANSATKGRYIDSNDTGVSPLAAIGVEYALNKDWATRLDYQFVSNIGDANETAARPDNTLLSVGVTYRFSQDEAAPAPAPAPAPAPSVETKRFTLKSDVLFNFNKATLKPQGQQALDQMYAQLSNLDPKDGSVVVLGYTDRIGS

SEQ ID NO: 19768 - protein, 620 aa, Hafnia alvei
DDADISIEVIGEKDPLPESTPVYVIDQEEIQKQGATSVADVLKRMPGFTINNVGPGADIHTGTYYRGASIEQSVFLINGRPINNNINTYHGGTDLNSIPVEAIERVELYSGVTSALYGSSAFGGVVNIITKASYSQPKLTGSTEFGSLNLNNQQLSYSGSVGDVRYNFSFERYFIDNRYRVPVGAANRDAEGFLSNADTATSTYFGSIALDLDSKNSLNFDVKTLSSRRGLVYFGFPLQRDRLDHDGLNVGLSWKTRLGEGESSNLTTTLGYNQDYFSTYGPTVFAGSEFNRTGVLDTQQLTARVDHTWKLTPSHQLRWGLDLKNTNLNGDTFSTRPDRIALNETENRNVLNTALFAVNTLNISDNFLIDLGLRQSFDGEFGNYFNPSAGLRYALTPTVAMRGSWAGGQRNPGLDQLYLYDTVHNWESNPDLIPETGSSWTAGVDIKLTNNLIGQFTYFGSSLDNRLGIIAGRWENIGLVNTNGLEAALRLQIANNWSTFVNYTYTDAQIKTGTEAGLQLGFIPYSVAQAGVGYQNSGWNANLYVTYNSGTRRAFFNVPGETNRDFAPGFLNLDLSGRIPLTRNLGLTVYVENLLGEQYERVNRIYSPGLTFRVGLSSNL

SEQ ID NO: 19769 - protein, 162 aa, Hafnia alvei
DDLDIYTRLGGMVWRADGSANSATKGRYIDSNDTGVSPLAAIGVEYALNKDWATRLDYQFVSNIGDANETAARPDNTLLSVGVTYRFGQDEAAPAPAPAPAPAPVVETKRFTLKSDVLFNFNKATLKPQGQQALDQMYAQLSNLDPKDGSVVVLGYTDRIGS

SEQ ID NO: 19770 - protein, 162 aa, Escherichia coli
DDLDIYTRLGGMVWRADSKVNYGNGTRLSDHDTGVSPLAAVGVEYALTKNWATRLDYQFVSNIGDAGTVGARPDNTMLSLGVSYRFGQDDVVAPVAPAPAPAPVVETKRFTLKSDVLFNFNKATLKPQGQQALDQLYTQLSSMDPKDGSVVVLGYTDAEVPL

SEQ ID NO: 19771 - protein, 161 aa, Escherichia coli
DDLDIYTRLGGMVWRADTKANVPGGASYKDHDTGVSPVFAGGVEYAITPEIATRLEYQWTNNIGDAHTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGS

SEQ ID NO: 19772 - protein, 158 aa, Escherichia coli
DDLDVYTRLGGMVWRADSSNSIAGDDHDTGVSPVFAGGVEWAMTRDIATRLEYQWVNNIGDGNTVGVRPDNGMLSVGVSYRFGQQEDAAPIVAPAPAPAPEVQTKHFTLKSDVLFNFNKATLKPEGQQALDQLYTQLSNLDPKDGSVVVLGFTDRIGS

SEQ ID NO: 19773 - protein, 157 aa, Enterobacter cloacae
DDLDVYTRLGGMVWRADAKNNTGFKDHDTGVSPVFAGGVEYAITPEIATRLEYQWTNNIGDANTVGGRPDNGLLSVGVSYRFGQQEEAAPVVVAPAPAPEVQTKHFTLKSDVLFNFNKATLKPEGQQALDQMYSQLSNLDPKDGSVVVLGFTDRIGS

SEQ ID NO: 19774 - protein, 162 aa, Enterobacter cloacae
DDLEVYTRLGGLVWHADGSANSATKGRYIDSNDTGVSPLAAIGVEYALNKDWATRLDYQFVSNIGDANETAARPDNTLLSVGVTYRFGQDEAAPAPAPAPAPAPVVETKRFTLKSDVLFNFNKATLKPQGQQALDQMYAQLSNLDPKDGSVVVLGYTDRIGS

SEQ ID NO: 19775 - protein, 157 aa, Citrobacter freundii
DDLDVYTRLGGMVWRADAKNNEGFKDHDTGVSPVFAGGVEYAITPEIATRLEYQWTNNIGDANTVGGRPDNGLLSVGVSYRFGQQEEAAPVVVAPAPAPEVQTKHFTLKSDVLFNFNKATLKPEGQQALDQMYSQLSNLDPKDGSVVVLGFTDRIGS

SEQ ID NO: 19776 - protein, 163 aa, Citrobacter freundii
DDLDIYTRLGGTSWRAAWNGAHTLATASAGDNHDTGVSPVFAGGVEWAVTRDIATRLEYQWVNNIGDAGTVGVRPDNGMLSVGVSYRFGQEDAAPVVAPAPAPAPEVTTKHFTLKSDVLFNFNKATLKPEGQQALDQLYTQLSNMDPKDGSAVVMGFTDRIGS

SEQ ID NO: 19777 - protein, 737 aa, Pseudomonas filiscindens
MVLGLWGFIAQGFAQISDTSNTRLYKLSVSDILSTKSTLASGVKETVLDAPASMVVLTAKDIADRGYTSLHEVVADLPDFDLIPVSGGNSYVNAYQRGYRTVNTQRTLFMIDGIIVNDLWSHIAALGEQFPMSSIERIEVLSGPASVVYGPNAFLGIINVVTKREKFRRNKGNINFIGGSNQTGAIDASVRGNVAGLRYSVSGRIFRSEAEDISDRWHFLSDDLYGNQDIWGPLLGLKIRGERLGRYRSLNEEFGLVANVAYRGFEAGIIKWTRYNGYGNEFVADRAQNNAGWNNGSNQYYLRHSFDQGNISNNATLLYRNSRTWGDWAEAEPDWNPGREAYSYVSYTNWNTFSSSVLFRDNLNVKLSKHVQLLTGVKYERKILAKNYDVPGYWTGSYSSLTLENPDGPYGQGGGITLSTDPSFIISPTPNRDVPSENEVITHDVGGYFLGVFDIGKFRFNTGVRYDRNSVYGQSINPRVSLIFKPDSRSAIKLLYGEAFQEPSPRSLWGGWNGRSANPDMKPEKVQNMEVNLLRKTGRLLHEIIGYYALYNNVIKEEAENAGQRKILGVGYKLSYNLPNPLPNSGDIKGYLYYNYTDVKSGITYDHQAGEWIDGEANLGDIATHKLNVGVHIPIQRFHINLRSNMVGERELYLRNPLRDQDYRLAPYAIFNGNVAYNVGMVRLMLKVNNIFNHLYMLPGVRSANSGNDFTQRSQGYYNSLIPAPGRSFLLNAMVRF

SEQ ID NO: 19778 - protein, 177 aa, Escherichia coli
MSGSRLADNHTLSAGYAQSKVQDFKNIKGVNLQYRYEWDSPVSVVGSFSYMKGDWADSHRDEADDFYRHQADIKYYSFLAGPAYRLNDYISFYGLVGISHTKAKGDYEWRNSVGADESDGYLSESVSKKSTDFAYAAGVIINPWGNMSVNVGYEGTKADIYGKHSVNGFTVGVGYRF

SEQ ID NO: 19779 - protein, 372 aa, Mannheimia glucosida
MKKTLVALAVLSAAAVAQAAPQANTFYAGAKAGWASFHDGLTQFDHEGDGGGFNLKYGINRNSVTYGVFGGYQILNQNNFGLATELGYDYFGRVRGNTTFADDKERTAAKHSAHGAHLSLKPSYEVVPNLDVYGKVGVALVRNDYYVQQHVDKDSRIKAHNLKPSLLLGAGLEYAITPELAARVEYQYLNRVGNVDKAVRKTVSIPTGTNFQYSPDIHSVSAGLSYRFGQGAAPVEAPEVVTKNFAFSSDVLFDFGKSSLKPAAATSLDAAHAEISNLGLANLSIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19780 - protein, 367 aa, Mannheimia glucosida
MKKTLVALAVLSAAAVAQAAPQANTFYAGAKAGWASFHDGLTQFDHKDGGEFGINRNSVTYGVFGGYQILNQNNFGLATELGYDYFGRVRGNTTFAGDDKEKTAAKHSAHGAHLSLKPSYEVVPNLDVYGKVGVALVRNDYYVQQNVAKDSRIKAHNLKPSLLLGAGLEYAITPELAARVEYQYLNRVGNLDKAARKTANIEGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19781 - protein, 374 aa, Pasteurella haemolytica
MKKTLVALAVLSAAAVAQAAPQANTFYAGAKAGWASFHDGLTQFDNTYDYGSGINLGINRNSVTYGVFGGYQILNQNNFGLATELGYDYFGRVRGNTTFSGDDKEKTAAKHSAHGAHLSLKPSYEVVPNLDVYGKVGVALVRNDYYVQQHVDKDSRIKVHNLKPSLLLGAGLEYAITPELAARVEYQYLNRVGNLDKAVRTTVGYLIPRGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19782 - protein, 367 aa, Pasteurella haemolytica
MKKTLVALAVLSAAAVAQAAPQANTFYAGAKAGWASFHDGLTQFDHKDGGEFGINRNSVTYGVFGGYQILNQNNFGLATELGYDYFGRVRGNKTFEGENSDKRAAKHSAHGAHLSLKPSYEVVPNLDVYGKVGVALVRNDYYVQQNVAKDSRIKAHNLKPSLLLGAGLEYAITPELAARVEYQYLNRVGNLDKAARKTANIEGTNFQYSPDIHSVSAGLSYRFGQGAAPVEAPEVVTKNFAFSSDVLFDFGKSSLKPAAATSLDAAHAEISNLGLANPAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19783 - protein, 367 aa, Pasteurella haemolytica
MKKTLVALAVLSAAAVAQAAPQANTFYAGAKAGWASFHDGLTQFDHKDGGEFGINRNSVTYGVFGGYQILNQNNFGLATELGYDYFGRVRGNTTFAGDDKEKTAAKHSAHGAHLSLKPSYEVVPNLDVYGKVGVALVRNDYYVQQNVAKDSRIKAHNLKPSLLLGAGLEYAITPELAARVEYQYLNRVGNLDKAARKTANIEGTNFQYSPDIHSVSAGLSYRFGQGAAPVEAPEVVTKNFAFSSDVLFDFGKSSLKPAAATSLDAAHAEISNLGLANPAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19784 - protein, 335 aa, Pasteurella haemolytica
MKKTLVALAVAGISTSALAAGNIYDNGTTSFNVKGEIDTYVTTLKSKYKNVEKSSDLDIDVWAKIQIDSQHKVNEDITVFGSFEMQNGEGFGFDGDGFAGDDKNVQTDDLYFGAYLGDNWGVALGEIGDFGDSLDAITIDNTNEGLGYVDDFVISQESRGHAASVKGNFNNLTVIADAYLNQEENIDTAFGLSAQYAINDMFTVGASYQDQGENEVKKLDYKVMGVAARLNIENFAAAVNYVAEEKKEANVKNDADTWSVAASYQINEARLYTSFGFTSYEDNKDGNYYTLGADYALTGNILTFIEYTAIDEDEGVGKTKLDEGEVVVAGLYYTF

SEQ ID NO: 19785 - protein, 372 aa, Pasteurella haemolytica
MKKTLVALAVLSAAAVAQAAPQANTFYAGAKAGWASFHDGLTQFDHEGDGGGFNLKYGINRNSVTYGVFGGYQILNQNNFGLATELGYDYFGRVRGNTTFADDKERTAAKHSAHGAHLSLKPSYEVVPNLDVYGKVGVALVRNDYYVQQHVDKDSRIKAHNLKPSLLLGAGLEYAITPELAARVEYQYLNRVGNVDKAVRKTVSIPTGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19786 - protein, 372 aa, Pasteurella haemolytica
MKKTLVALAVLSAAAVAQAAPQANTFYAGAKAGWASFHDGLTQFDHEGDGGGFDLKYGINRNSVTYGVFGGYQILNQNNFGLATELGYDYFGRVRGNTTFADDKERTAAKHSAHGAHLSLKPSYEVVPNLDVYGKVGVALVRNDYYVQQRVDKDSRIKAHNLKPSLLLGAGLEYAITPELAARVEYQYLNRVGNVDKAVRKTVSIPTGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19787 - protein, 378 aa, Pasteurella haemolytica
MKKTLVALAVLSAAAVAQAAPQANTFYAGAKAGWASFHDGLTQFDNTYDYGSGINLGINLGINRNSVTYGVFGGYQILNQNNFGLATELGYDYFGRVRGNTTFSGDDKEKTAAKHSAHGAHLSLKPSYEVVPNLDVYGKVGVALVRNDYYVQQHVDKDSRIKVHNLKPSLLLGAGLEYAITPELAARVEYQYLNRVGNLDKAVRTTVGYLIPRGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19788 - protein, 373 aa, Pasteurella haemolytica
MKKTLVALAVLSAAAVAQAAPQANTFYAGAKAGWASFHDGLTQFDHKKDGGEFSIQYGINRNSVTYGVFGGYQILNQNNFGLATELGYDYFGRVRGNTTFAGDDKEKTAAKHSAHGAHLSLKPSYEVVPNLDVYGKVGVALVRNDYYVQQRVAKDSRIKAHNLKPSLLLGAGLEYAITPELAARVEYQYLNRVGNLDKAVRKTVSLPTGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19789 - protein, 378 aa, Pasteurella haemolytica
MKKTLVALAVLSAAAVAQAAPQANTFYAGAKAGWASFHDGLTQFDNTYDYGSGINFGINFGINRNSVTYGVFGGYQILNQNNFGLATELGYDYFGRVRGNTTFSGDDKEKTAAKHSAHGAHLSLKPSYEVVPNLDVYGKVGVALVRNDYYVQQHVDKDSRIKVHNLKPSLLLGAGLEYAITPELAARVEYQYLNRVGNLDKAVRTTVGYLIPRGTNFQYSPDIHSVSAGLSYRFGQGAAPVEAPEVVTKNFAFSSDVLFDFGKSSLKPAAATSLDAAHAEISNLGLANLAIQVNGYTDRIGKEASNLKLSQRRAETVANYIVSKGTNPANVTAVGYGEANPVTGHTCDAVKGRKALIACLAPDRRVEIQVQGSKEVTM

SEQ ID NO: 19790 - protein, 200 aa, Pseudomonas sp. ND6
MWKVTADFGVNFKEAEFYSFIESNVLNHAVAGRNHTVSAMTHVRLFDSDYTFFGKIYGQWDNSWGDDLDMFYGAGYLGWSGSWGFFKPYIGLHNQSGDYVSQKYGQTSGWNGYVIGWTAAYNFNLFGEDFVLSDWNEIELDRNDAYTEQQFGRNGLNGGLTLAWKFYPRWKATVTYRYFANKLGYDGYGDQMIYMVGYSF

SEQ ID NO: 19791 - protein, 767 aa, Pseudomonas sp. ND6
MKIILSAFIYLFSSVILIAQTKSIEVKDAQTKETLSGVYAIDQNNNNNNKYHITNNKILQLKIGKIYKISHIGYGYKILKVETTTTDILYLEAENTELAEVLVTGRVFEDPVMNITTPDLTERVTQPKNVADLFRDINGFGLIKRGNYAIDPSFRASQYEQLNIQYDGGTKVMHACPNRMDPITTHVMPEDISKIEVVRGPYTMRYGATFGGLINMVSKRPELGNYGFSGSASTGYETNGNSLVNMVRLQYAEEKFDVVGMYGYRDFGNYEDGAGREIPSSFRSIDYSLRMGYNFTSLERLQLHWRQSFGRDVLHASLPMDSDYDDSSMLSLDYFKKRPGKTLQKIQAKAYFSYVDHLMSNSRRSNFETVEAVSPVEATTAGGRFELEWKLAEFWTLFTGTDALLISRDGVRNRLIKQNMMGMPFNPPLQLTDKIWQDSFINDYGIFAESRYRINNSMVVNAGVRYDLVNSDIQDPEADFLAYYPGLGSRTEHNFSATVSLKKLLDANNQLEFAIGRGVRSANMIERFINHFQVGQDPFEYIGNPNLDAEVNNQFEVAYTGKKEMNGFIDELNWGASVYFSHFENYIVAVIDPTKTRKFMPNQEPINPKVFRNLDDAYKTGFEASVGVNFLTHFQLDADMAYVYTRNEDLSESLPLTPPLRSKISLQYSKNKFWAATDLRMVSQQDELATSFGENEATPGYELVDFRLGYELFPGLDLGAAVLNAFDQQYYDHLNFAFRNQANASLSGLERLTDPGQNFTVFVKYGF

SEQ ID NO: 19792 - protein, 185 aa, Wolbachia endosymbiont
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIENVVYSTFGAEA

SEQ ID NO: 19793 - protein, 186 aa, Wolbachia endosymbiont
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAKA

SEQ ID NO: 19794 - protein, 1376 aa, Escherichia coli
MNKIYALKYCYITNTVKVVSELARRVCKGSTRRGKRLSVLTSLALSALLPTVAGASTVGGNNPYQTYRDFAENKGQFQAGATNIPIFNNKGELVGHLDKAPMVDFSSVNVSSNPGVATLINPQYIASVKHNKGYQSVSFGDGQNSYHIVDRNEHSSSDLHTPRLDKLVTEVAPATVTSSSTADILTPSKYSAFYRAGSGSQYIQDSQGKRHWVTGGYGYLTGGILPTSFFYHGSDGIQLYMGGNIHDHSILPSFGEAGDSGSPLFGWNTAKGQWELVGVYSGVGGGTNLIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGVLDVNGNDLTFHKLNAADYGATLGNSSDKTANITLDYQTHPADVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINDIFNGGIQANNSTVNISSDSAILGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDGRMLYGVGLNARFGDNTRLGLEVERSAFGKYNTDDAINANIRYSF

SEQ ID NO: 19795 - protein, 221 aa, Pasteurella piscicida
MYRLVVASAGLLAVLSVPALAADPTVDVPMTAPGFDWTGYYAGLQAGYGWGQSDISGTEGEPFSVSPDINGGFVGGHIAGLWQFDQAVIGAEADLNYSSVNGTAEAEPGNNFGTDIKWFGSVNAKAGYAMDRVLVYGIGGVAFAGIETSQSAGSAFSETRANVGWTLGAGVDYALTDKFVVGAQYRYYDFGSEHYDGSSDFVGRDQDTKLNTVGINLSYKF

SEQ ID NO: 19796 - protein, 193 aa, Wolbachia sp.
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEIKLYAGARYFGSYGANFDGKKTDPKGLTKQVTDAGAYKVLYSTVG

SEQ ID NO: 19797 - protein, 188 aa, Wolbachia sp.
SYYVRLQYNGEFLPLFTKVDGITYKKDKSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 19798 - protein, 1050 aa, Sphingobium herbicidovorans
MIERPGISTRKKALAIAIWAFASGAAYAQEPATTTTVEDNENVEEVIVRGVRASQARSIDIKRDNTRVVDSIVAEDIGKLPDTTITDSLQRVTGVQIKREAGEGTSLNVRGMPQVLTTLNGEQFLSPWSINKLEANFSDIPAGLISGVDVYKSQTASMLAGGVSGVVDLKTWDPSNLQEGFMVRARVEGSTGEYSGREYDENGKKSRRDPDYNVGLVAGFNNGDNFSVIGSLYTSESYNANYSMWENQTFAFLDQTGGTPHDPYDLDGDGDLVNDWYIVPEQFSANSQFVERERFGGSLTGIFDINENWSVRGDVFYTEMDKYDRGVSAQFNARQTPDAYQVNNTQPKDPYEGTYNSLQAGSIVSPGSAISFTDVNGNPRTINLNTIQVANVWAADFQSVSENIIEKTAAYNTNFEVRYTDHENFEANFRIIHAKAEMQQREATFQQGTPGWLWVDEDGIPGKDPVDGFHVTIDYRGKYPSFSYEGDVADANFLKQYQGFAEGFNSDAELNVARVDWKSMFDRDHFESMEVGVRYSERKTNYNKFWYVTPTGRYSNYNDSRVPADKQYRLLPGNMVWQKYPDWLKFVYSETDSNLIDIGGLQDNGFSAADTTVFYDFGPIKGFDKGVASLSPGDWDNPYEFMNRLYPGTRTVNEPGETYEVTEDTINSYIQFNFANDNEGLFGVPYNANVGVQVAQTDREVLKSIVPDVLDSFNSIGYDDWQKIAYIYETETINNSSTELLPSIGLNIFPREDLIVRFSAARTMTRNDMDNIGSSVVLWYGRCIKTDEDGNTVVVRDPNTGADMPDTVGCVGGGSDRGRPDIKPWLANVYNLSTEWYFDESAILGLGFFLIDVDTAVQSYQEQRHFLDMDGMDRNRFATVWSTRNTGAADLYGVEFGYKQPFNMFDNWFVNRTGVEFNYTYSHSESEDIDIQGNVLPLVSNSEHQTNLILWYDYEGLNVRVAYNWRSEEYAGLVGVNNSGGEVFNLANWAKPVGYLDLSVSYNINSYVNVFLNGTNLTEQSRKTYTQYESQFHSLWVQEPRYALGVNLTF

SEQ ID NO: 19799 - protein, 881 aa, Rickettsia sp. 103
NVLLDGGSFFKTSPVTVKPGARLGILSSTKAEAGSTVVGGPGSRSHLDINGTFKINGDLTLLERSRTLFNSGDISDTSLAAGTRSLSVTGVLTHNGENIDSRGGNYSINTGELRGSSNILVDGETLTLTIQNDSSFDGGIGDFNPGQQGGALIKKGNSTLVLTRDQGLANLRQLKIEEGQITLNNGNNGTILQTNIESGASLSLPNSSGELTSNSLDVKSSGILKGNGTITGNVRNEGTVSPGNSIGTLTVDGNYVQGASNPNASLNIEVDGSSSDLLKITGDNRTVLLGGNLNISSYNNAAVSPGKIYTAIDVTGDNATGGELGLKTNLNVVGSSGMTFVRETDREFRLLDPAYYATCTSNDPAVLLGCTKLQFAWLKVDPDTGVAVNPDRHKTPGQSTIKAIKQTGGAITAASSGNSSTNTNTCIANGGTTATCQQQNKQGSGSGAANTNSTNVAKTLDAGWASLSAAVTSGVTGGSAIGTTGYTTNQTSAALVTPDFAKVIAAFFSIPTRIELNQALHSITAEPYASMQSVALEAIEQFGKNSLALTDRSVPLTHTETFCKTDDGTLIPADSPERPDTCEERTKTVGSRWSLLLDGTNTEATLDGTSDLASLDYNVFSTIYGLQYAFSPEWSAGGAFGYGQANLYNYEYANSRIQSDTYGGSLWGIYRPSANWKFSGLLGYMNLQYDSSRQMNFGGLNRTAEANWDGNAFTAALDAQYNWALNGDNSDPDAIRIKPRTFLSYAVHNQGSFSEFGAQSLNLDVDSHTADSLLWGIGFTLETPIKLNSTNRLIPRLTVGYEYDFMGDANEEHQLNASFSELPALGSVDVLGQNRGANALDVGLSIEIETSDSVSLYAGVNGGFWSNGTEVSYGGGVKYSW

SEQ ID NO: 19800 - protein, 146 aa, Pseudomonas putida
TSHDIQKVDVAFLWDSGYAWGNPEGWLLDLQWEVNVARWHSTSSNNPRNPWEFGASPVVRLAWRRYSWVPFLELSVGVRLISETRTSDDHNYSTAFQFSDMAGLGVAFGKAQQFTVGYRYQHISNAGIKQPNPGTAFSTVYVRYRF

SEQ ID NO: 19801 - protein, 1055 aa, Escherichia coli
MLFCTCRYPHLWVPAFLFTLCKEKLMKRHLNTSYRLVWNHITGTLVVASELARSRGKRAGVAVALSLAAVTSVPALAADTVVQAGETVNDGTLTNHDNQIVFGTANGMTISTGLEYGPDNEANTGGQWIQNGGTANNTTVTGGGLQRVNPGGSVSDTVISAGGGQSLQGQAVNTTLNGGEQWVHEDGIATGTVINEKGWQAIKSGAVATDTVVNTGAEGGPDAENGDTGQTVYGDAVRTTINKNGRQIVAAEGTANTTVVYAGGDQTVHGHALDTTLNGGYQYVHNGGTASGTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGMATTGKGIQVVEAINGATTEEGAFVQGNKLQAGAFNYSLNRDSDESWYLRSENAYRAEVPLYASMLTQAMDYDRILAGSRSHQTGVNGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRDTLRGSAKHSVRELPVNWWVQPSVIRTFSSRGDMSMGTAAAGSNMTFSPSQNGTSLDWKPVSGKISPWAFRQVMSTASAAAALKAITVRPR

SEQ ID NO: 19802 - protein, 237 aa, Yersinia enterocolitica
MKKTLLTIALLSSLSTTAFANQAGDILVRGGVTMVSPSSNEATVLLDGSATPLSVSVDDNTQFGLNLVYFFDSNWAIELLAATPFTHDVILHDPKGATNDIYGIDLNGATLAEVSHLPPTLSALYYFDTGTAFKPYVGVGVNYTIFFDEDFTSTPQAAGFSNLELDGSWGYSVQLGLDYELDKNWSVNVSARYIDINTKATFNIDNALGVDGGLVGKGSASVDVDPMVYSVMLGYTF

SEQ ID NO: 19803 - protein, 578 aa, Pseudomonas sp. Y2
MNPIMNQLTLWLSIPCTLFLSGLYLIKIPGTAEATPILENAQQVSQVPIILPQRPTQSSFIKPRPRHKTFNSSSHSMEQVTSVSELQDISPTDWAYEALRSLVERYGCIVGYPDRTFRGERSLTRWEFAAGLNACLNTIERLLQENVAVLREDIEKLKRLSQEFEQELIALGARIENLETRTAYLEDHQFSTTTKLKGDIVFNLAEAFGEDINNGGRTRDLDAQTVFTSKIRLQLVTSFSGKDQLITRLTSGSIGNSFQDEIGDFEGRFAFDLPADNNDVIIDRLHYYFPIGNNLKIFAMASLAGHHFYADTFNPGLEAGGGGGGALSRFGERNPIYRLGLGGRGLAFTYRFNDTFKIAGGYMARNGNDPNLGRGLFNGNYSAFGQLEIQPIDNLKFGLTYLNGYDPNIRPNARTDQPNQLFLFGGTGTLPGNFQLGNLGVPNRPILSNSYGIQGQWDVMPKLSIRAWGGYTTGRLIGLGTAEVWNYALVLAMPDLGKEGGMGAIIVGAEPYMGGLQIPNRPINFENDTPFHIEVSYKYPLTEHISITPGVIVLTSPNQDSENNDTVVIGAFRTNFQF

SEQ ID NO: 19804 - protein, 215 aa, Listonella anguillarum serovar O1
MYTKTIALAVGAGLLLAGAAQAQDFQPKTAGTLMLNTRATVVAPDAGDPITTLAGAATGLKAEVSDDVMPTIGLTYFFTDNVAVEVIAGTTKHTIRAKGGATDVKVQETWVLPPVVSLQYHFMPDQKVSPYVGAGLNYMLFYSEKDYNGFGLKVDDGFGYALQAGVDVALQGKLSANLDVKKVFFETDATDRFNGVKSKVNLDPWVVSAGLGYKF

SEQ ID NO: 19805 - protein, 774 aa, Haemophilus influenzae
MRFSKKPLSIIVGGLIGISATIQLASAEEVQQVSAYQEADSAKAGSSTSNASSAGANASNRLENVLVTAQRRKENIQQVPSAVSVIGGDKLVATGVGRTAAEITQFVPNTSAGQSNGHSRPRWWIRGVGTGTQGLDSPSPVGIYLDDVYISNASATAFPLFDLERVEVLRGPQGTLWGKNTTGGAINLISQKPRFTPDGYLKLDQGSHDSTLIQGAVGGAIIEDSLAARISIHQDTRDGLFNNSFTGEKDFAYRDSATRIQLLSRPADDVELLFNLHYRDYRTDGANATVIGTGTNGAFWTNGATYIPSKDRTIVSSNVDQFSDISQDGALLNLNWALPGGYELTSITAYEGYDSQSLSDSDNTPLEISRGYTDAKTSQRSQEIRLASPKDGNYHWVAGVHYFTDRINSDAASGTLPTAQKPVGRADAYSDTVYRHDSESYAIFGNLTYNVTDRFSFTSGLRWSREEKSIDLYYYQATPNPVIFNDQTRWWLPSSVSSPIALRVRQDDTNDWSDWTYDLTPAYELSDSSRVYARVARGFRGGGYNSAPRTQDSISVLEPEYLTSYEVGYKSEWLDGQLLLNANVFTYEYEDIQINAVLPSPTGALSQLRNAAEGDARGAELEIQALVTANLQVRIGLGWLDTEFSNFSDVNGDYSGNRFVRSPEFSGVLSLDYQYPLENGSSLTLGTDWNYQTRYYFYTNNQTDPNLAQDDYGTGSARISWKSVDERITLSIYANNLNDKQYKLHTLPPAAGAAGNTVNWSEPRNYGVSLVTRF

SEQ ID NO: 19806 - protein, 708 aa, Haemophilus influenzae
MRLSKIYTALFLSLPTVSLADSNVSAELAEISVIASRDAFHWANHTSQKATLNKNQLLTQQPISTADALKQITNVDIDGGSRGIAQKPIIRGLSGNRVVQVIDGVRQNFDLSHRGSYFLPMALTQEIEVIKGPTSTLWGSGALGGIVAIRTPNALDLLKDNQQIGAKIHQGYQSANSLSETDVSVFAANEKFDGLVSGFYNHADDLRLADSKKLVDSRYTQKGGLFKFGWQINDENRLELSHRLSHFEQIAPTNNEVAEEFTDQDVIKLIGNWHRNNLNATPTDMATFYEGLTSVLGSVSYRAKQKITDQSSTLHYYFNPKDNDYINSQLTLYRNSTKEKEQRIASGLQDQTKLSSVGLSIRNSTVLNWLALNYGVDFISDRVVTQREKNATTPFRPNNYDAKSKNNAFYLLTHIPLWNERIIVSPSVRYDHFKTQSDEAKYSASRWSPSIAATWKATDWLDLSARYNEAFRTPSMQERFVSGSHFGTNLMGRSFNNTFVSNPNLRPETAKNKEIAAKVHFDNLFVHQDKFIFNAAYFQNDVKDFIHLDIFRASQREMIPSLSQYRNVENARLTGYELEFAYQQERLALGLNYAQTKGKNRQTQEALSNIPANKLGFTIDYAIVPQTFMVGANITHYASQKRVPKTHAMTYPSYTLTDLKASYTPSGEWRNLRLDMMIENVFDKKFQPAFSLMEGAGRNIKLNASYQF

SEQ ID NO: 19807 - protein, 715 aa, Haemophilus influenzae
MRFSKLSLAIATTLVTANVLAQSTELDSINVIATRDPSRFAYTPEKQSKDSLLSKQATSVAAALQDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSETDASVFAANDKFDVLISAFYNNADNLRIGKGNKLNNTAYKQFGGLAKFGWQINDANRVELSHRETRFKQTAPSNNEVENELTNEQITDQIKKFHGSKDDLPPTTQPSPSETLKFYSGVKTRLGSVSYLTDQQIPDQSTVFNYYLTPDNPYLNTHIALYNNKTIEKEQRKVSGVKDQTKLTTRGINLRNSSELSHISFVYGVDYMRDKIRTERGMNDKDAKFRAEPYNANSNTTGVYLIAHIPLFGEKLLVSPSVRYDHYDTSSKTVKYKDNHLSPATKLTWIVTNWLDFTAKYNEAFRAPSMQERFVSGAHFGASIIGGREEINKFIANPNLRPETAKNKEITANLHFDSLFKQGDKFKIEATYFRNDVKDFINLKIFNDAKTNTNGALLPKNSQYQNITNARLSGIELQAQYQTERLTLFTNYGSTKGKDKDSGEALSNIAASKIGVGVNYALVKDKFTVGATVTHYAAQRRVPKDHGVTYPSYILTDLRATYAPLKGEWKNLRLDFALENLFDRKYQPAFSLMEGTGRNAKISAVYSF

SEQ ID NO: 19808 - protein, 1189 aa, Photobacterium damselae
MNKNHDIGLLLPKKIINLTFILFMRVFILVLYLGLTSIYANSAKAQNEISVKVQGASLQTLFTTIQQKSDYVFFYNDDLLSSAKKVSLNQYATVTEILDTALSNTGLTYTIIDKQIVIKKSKKIQPVQQQEYDITGTVTDKSGNPLIGVNVILVSNKSNWDITREKGEFRIRAAASDSLRFDYLGYKSKTVGINNKRVINVILTPDVMELTGVAVVASNGYTDIPKERVTGAFEVIGAKELAEVPTVDIQSRLEGKMAGVNVDPRTGSITIRGTNSYSGVGSPLVVIDGFPQPINDFYFSKRGVSGSSILSYLNPDDIESITVLKDAAASSIWGSRAANGVIVVTTKKGKKAEPTISFTTTTTIGEKIDLGKLRVMNTAQYVDYEKDLVAGGFVSDDISNWQAKNPSAAQEIMFRQKRGEISLTERDQLLNQLSQNDNLGQINKYLLRNSITTQYDLSVSGGNEKSTYYLSLGYNKDQAAMRGNESQSYNITLNNSFQLKSFLKLNTGFNYVSTNYQVNNTANEALSNVSSFALRPYDMIADENGNGLDRYIIFRPEVAKGFEAKGYLPWSYNYLDELNYSNVVTKGANIRLNASLTATVTNWLNFEASGMYTSIANKIKSLSELDSYFARNMINEATSVNTAGKLVYGIPVGSYLYNTTSGNDSQSMRIQMNINKNFNDNNSLHFLAGSEIREERREGSSQRFYGYNLDTNSGQSVNPTVYYTTIYGWQNIIGTSDNSISKYRDRYLSYYGLGSYDFKNRYHLSSSIRFDDYNLLGASRKNRALPLWSVGTKWDVNKEFFLRNVTWLNDLAFRITYGKAGSAPGGGFGSQSAVIGVGSVDFNTQLPTAYISVPENPEIKWETTSTLNFGLDYAVFNNRLRGGADLYYKKSKDILTNLPFNPTTGWGYLNYNTGTLEGHGVDLNIAGTIINAAFKWNSSFNISYNTNEVTDSRFTATTTNQYLSGVTTLGKPIGYLYAYNWAGLDANGQSTVYKKDGTVVNANQGISTIDKDDLKYMGTTFAPYFGGFMNDFSYKNFRLGVQITYYAGHVFRNTVLQNYPSYTGVQYGAVAKDELIADRWRHAGDEATTNVPGLANISYNSLNRYQNADINVLPADNVRLQQVSLSYNVPSQWLEKTFIKSLSFNLAARNLGLLWVKNDLGIDPQYLSNNNYNTLPPQRNYTLQFNCSF

SEQ ID NO: 19809 - protein, 931 aa, Haemophilus parasuis
MKNKLNLISLALLSLFAVQSYAEQAVQLNDVYVTGTKKKAHKKENEVTGLGKVVKTPDTLSKEQVLGMRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPDELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 19810 - protein, 967 aa, Pasteurella multocida
MRTTTIKFSAITLALLSYCGTILADSHQEATELDTITVSSQQDEMNIKEKKIGETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYLQHSRGHDLSYNLVATTHIQLDEKESRHANDLTKRKNVSFTYENYTVTPFWDTLKLSYSQQRITTRARTEDYCDGNELCDSYKNPLGLQFKDGQILDPAGNKIKLQGSGLSTQIVDENGKPFPTTTGTNNAAFSNNLRLRPTGFWLDCSVFDCNKPFTVYNISNGTYQAREVLLSEEITVDGKLYKTAKEEGGLPNYLILPNSKGYLPYDYKERDLNTNTKQINLDLTKTFLTFNIENNLSYGGVYSRIEKEMINKAGYEGRNPTWWADRILGQSSYCGYNALKCPKHEPLTSFLIPVEATTQSLYFANILKVHNMISIDLGYRYDHIKYNPEYTPGVTPKIPDDMVKGLFIPMPKEPQLKDFDYNYAKFGEAYKKWKEYLPKNAEENIAYIAQDKTFKKHSYSLGATFDPLNFLRVQVKYSKGFRAPTSDELYFTFKHPDFTILPNPVLKPEEAKNQEIALTVHDNWGFVSTSVFQTKYRHFIDLAYLGSRNLSNSVGGQAQARDFQVYQNVNVDNAKVKGLEINARLNLGYFWHVLDGFNTSYKFTYQRGRLDGDRPMNAIQPKASVFGLGYDHKENKFGADLYITRVSEKKAKDTYNMFYKEQGYKDSAVRWRSDDYTLVDAVGYIKPIKNLTLQFGVYNLTDRKYLTWESARSIKPFGTSNLINQKTGAGINRFYSPGRNFKLSAEITF

SEQ ID NO: 19811 - protein, 367 aa, Helicobacter bilis
MRVIIMMKRNILAVVIPALLAAGAANAAEIYNKDGNKLDLYGKVDARHSFSDNNKQDGDKSYVRFGFKGETQITDQLTGYGQWEYNIQANNAEDTGAQDGNATRLGFAGLKFAEFGSFDYGRNYGVIYDVNAWTDMLPVFGGDSISNSDNFMTGRSTGLATYRNNNFFGLVDGLNFALQYQGKNDRSEVKEANGDGFGIGIGSTYDIGNGINFGAGFSSSNRTLDQKYGSTAEGDKAQAWNVGAKYDANNVYLAVMYAETQNLTPYGSFSDTIANKTRDIEITAQYQFDFGLRPSLGYVQSKGKDLNDVDANHDLLKYVSVGTYYYFNKNMSTYVDYKINLLDEDEFTIANGLNTDNVVAVGLVYQF

SEQ ID NO: 19812 - protein, 401 aa, Desulfovibrio vulgaris
MYRFIIAVALCAVWAASAHAAGFAMHEFGARGNALGGAMVARPATDPSSIAFNPALVTHLDTPQVLAGVTMVQPEVTIDTPGESTTTEANVWAIPHAYATTPLTDTMYFGVGAFPRFGLGNEYSKTWPMASELTYVGIQSVSVNPVLGFRPTKDFAFGFGVEAMYFDFEEKMRPLGMDARIKGDSTGFGLNGGMWWQAFDDVALGASFRTPVKQHVKGRATFDNVPAGYGPLFRDTDAEGDITLPGEVRFGVYWQATERLGVEVGAMRTFWSSYDELRIDYGSPVGGKPASIKQTEWEDVWRLSAGAEYRLTDNVDLRAGYVYDEEPVNSAHLDFMVPANDRHLMSLGVGYHEGPWRVDLSYTYLLITDREGEVHTAGGNVPVRFHDGYAHLLGMSAAWEF

SEQ ID NO: 19813 - protein, 207 aa, Desulfovibrio vulgaris
MRHLYATILLFTTLLAGIAFPAQAESGHGAFSVGYAQVHPGGVPALSGTGARAGDLKGINVKYRYEFTDHLGGIVALSYASVKKSDTMKTGENTFHYESLRGRYVSLMAGPVWQLSERVSLYGMAGMAYTRWSDSVQDYRRDEVKPGYVKETTTASDGHTARHLSPAWNAGIQFSPVETVVIDLAYEGSGSGDWRTDGFIVGVGYKF

SEQ ID NO: 19814 - protein, 819 aa, Desulfovibrio vulgaris
MRLRLMLTLGSLPLLGMVTPAQANCTFAPGPGNDTYTCDSGTAPALVDSSGDNRLVFPASGSGAITGDVTFGAGTDSIDMGSGSIGGNVNQGAGIDDFVMSGGVIEGNLNQGDGLDTFHMSGGWIKGTFDSGDYAEMDDGRIGNVNMRLDENTFIMRGGSVDRNVIAAFDKDYIEVFEGNIGGNISVSGGDDQVLVHGGQVGGDVLLSSGNDRFTWDGGRIGGRVDAGPGDDTALLKGLTPEVLSITLDGGEGNDSLTFDASQPTGGAHYVNWERVALNNGSRLVLDDTLVMGDSNSSTGSLALDASSRITSRQGVITAFAPGQRAAISNAGTLDLTAGNDAMGRLRIEGDYTGINGTLRLNSVLAGDGAASDRLVVSRGAIAGSTQVLINNLNGAGAATAQNGIQVVEARDGATSTATAFVQTQRLSAGAYDYRLFKGGVTAGSENSWYLRSTLVAPPAPAPVPAPGEPPVIAPAVTPPVAAPAPGQAELPAPVQGESLPLYRPEVPVYAAAPRGAAIIARQALGTFHQRQGDQLLLQGESALPASWGQAYGGTLRQQWSGTVSPSLDGDLYGFKVGQDLYAKVGDNGYRQHVGIYVSHSRLDADVKGFALAVHDRSVGDLKLDGDSVGTYWTLVGPQGAYLDAVLQYTRLDGRARSERGDTLNLDGHAWTASLESGYPITLSEHWRVEPQAQLIAQKVALDSASDGVSRISHDAQVELTGRLGLRLEGAFTGSSGRLLQPFAQVNLWHGDGGRDTLSFDDADKIKTDYRYTSVQLESGVVAQVNEALSLHGGVQYTANLDSRQQEASGVNLGVRWQF

SEQ ID NO: 19815 - protein, 403 aa, Desulfovibrio vulgaris
MKRLALSALLIPAISLAVGYRVPEQSIRSTGTAASYTSTVEHADSVHFNPANMSFLKDRWYFELGSRLIYLPKIKFKGNVLDPVQKRYVYVDTRSEDETHFVPYFHMVFPEVKNFRFGISFVTPAGLSKRWDDVPVSAYAKRFTLKVYELDFALSYRVNEKFSVGGGLRGVYASGKVKLYYPNVYNLKLDGDTDVKPGYYLSFTFKPTENFNISAVYRSKVDLDIEGDAKGNIGLHRVNTSGDVSVPLPAELRISGSYVWNNTTFELTLERTFWSSYDYLDFNYKDPVAENQFGKPIEKDWEDVNTYRFGLQHKFGDSFKGLLGIAYSESPIPSKSLGFELPEPKSVWILSLGGIYNLTKNWEVGFSYLYLAKDSRKVDNQRIKGEFSDISAHLFTLSVGAKF

SEQ ID NO: 19816 - protein, 237 aa, Desulfovibrio vulgaris
MGKRKLRGVLAGSGALLLAGASLAPAATLVEGDGYTLDLYGSARLHAEVVRPDDRGALDSYTAFRDSYSRIGARGDYQLNPGLTLFGQLELPVDLANWEIQDPSDHSQDVRVAQVGLRGDFGSLAFGKMWTPYYNAIAHPVDMFSSYYSGFATYSTFREGQTFSYYSPDFNDFSFALGWAVNNDNWHTVAWNNDEGKERFQVTASYNLTDDTTMAAGLDHLSSDQRLWGLSESENAF

SEQ ID NO: 19817 - protein, 753 aa, Leptospira interrogans
MRILEKNHGKSRVRFNCTHTIKPAAWVLAANVSLLGCAYAATDENNSQKKERENNPANTTITVTASPLRHAGVTEDSGSYNTSSMSTATGLNISARETPQSVSVMTKQRMRDQNLNSVESAVNNITGISVRQFDSDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLGLGWNRQRQNIDNDYYLATCNATRTCPDLGDFTQPGWQYPKPVWSDKRAYGSKGRSDQSSQYVVTQLSLIDPLTLILGGRLTTWETRGDNFGTPQNARYKNEFVPYSGLTYDINRDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLSDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 19818 - protein, 841 aa, Leptospira interrogans
MILRMKLIYKILILFLKDFCFRFLVFDFLSKKIYLVLFWVRSFETLLELISEFQKCKKTNLNIIKSSRFWNGFLKTKSFQKVFLFQKMRILGSLVVFVNKSLFRNLRTYFGNLWCGNSYRNLATEKSFKFGDSALRDITCGNDCILLKIFPRFVDFFGVLKITPKWILKIISILFISNVIMAQEPNAEKEETKKKEIVVTGKADFTNLNSASEDTVRSEQIRSRPISRTGEIAEFVPGMIATQHSGSGKGNQYFLRGFNLDHGTDFASHVNGIPINNPSHGHGQGYTDLSFLIPELIEEIKFKKGVYSAEEGNFSSAGSMNVSYLRSLQKGIVSLEGGTLGYARALVAKSYKIGRGSLLYALETSHYDGPWTVKENYKKVNGVVSYSGGDEQNGYRILAMGYRGNWHTTHQIPKRAIGHELRRFDTVDPTDGGFTNRASISGEAQHTDKNTHAKILIYGLYNDLSLFSNTTYYLDDPIRGDQIEQTDRRTVSGLKSSYKIRSVWDEIKFENLFGFQMRRDFIRNALYHTEKRAELDIVRSNQIIETNISVYYESKIQWSSKIRTIIGLRGDQFQFHVDDRNSELNDRKRFSTANPKGGIVFGPWLNTEIYLNAGRGFHTNDARGLTNKENTFTPIVRSYGGEFGVRSMVFENWKTVLSLWQLDLDSELIFEGDSASTVASRSSTRRGVEWSNYFEPIKGLILDSEVSISRSRFRGDESTGNFIPGSIEHVYSGGITLKETNGFFGSIRGRYFGPRALIEDNSVRSPPTTLFNFQIGKKFNDVWSIVFEIMNIQNAKVSDIDYYYASRLKSESEGPDEGGYNDIHTRPASPRSIRFGVRASF

SEQ ID NO: 19819 - protein, 213 aa, Leptospira interrogans
MKETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNFYQAKAGN

SEQ ID NO: 19820 - protein, 485 aa, Leptospira interrogans
MKRKITFQKFKSYKVLHMQKTKIAFRFYFKILFFICIGSISVNSLFGVGVFQPSHNARYAGMAGVNLAIGGSPMDIATNPANLVLNSKGGLEFGIGLPYIRSQYKDRLSDTNPETEYHNSQNYNILAPLPYFGLTLPLTDRLSYGIGIYVPGGGSGQVNGILRLTPNAQSLRDWSGVDIPGPIGDSKKIKEDLSTTFYVVKATNALAYRFGNLSVGMGIEMIYSKQIANQKFYDITHTLEIPGQGFDYRSKNAYSMGGIFGFSYAFTELFRIAYSYQTRSILPLDGGMQIGIGDVNNYRRTGVSATFNLPEKHGLGFSFGNESLKIGLDFLYYNYNSYDQTFKQRLEDPWFPTFLGKTNTITQNIAYHDAWAGAIGIEYKLDSFVYRGGYRYNTGVVRSEGISALQAGIMVQQLATLGLSFLSGKWSFDLAINYLFAKKVTADPGNNWAVLHSAFGPNDIRILNYSQSLQSDVPAILFGASYKFD

SEQ ID NO: 19821 - protein, 3046 aa, Leptospira interrogans
MGKLTSAATAAGAVSSRVDRLARFADGLEQLADRWGREARDPRVAAALSERFGPSAPELLATQDSVAHLLATSFGTPGALPPKLLLRLHDALASLAVLAARKPAPSALNIVPIIDVRSRAQAARLETSARKLLKGLGRLLAAGAIGASVLGALPAAAGDYTQHADGSGGGGGTDLPAHGTNGGGGGAGGSISPTLGGNYDKVGGPAVNVTANGGDGGDGGVGFLVPPLIPVGFGGDGGAGGNGGTVNLTVNGQISTTGDNAVGVQVLSKAGAGGDGGTGVGAVGEGGDGNHGGAGGTANLTSNGTVTTHGAQSSALFAQSAGGAGGDGGFGGGLVGAGGAGSGSGPGGGVGVINNGGLETFGKGSNGVLAQSIGGLSGSGGSAGGIGAFAGGSNSAGIGGGVSVDNHGLITTHGDVAYGILAQSIGGGGGAAGGAGGIAALGGGGSGGGDGGAVDVFNDGTIETGGVASIGMFAQSVGGSGGVGGGAGGLVGIGGAGGASGDGKAVTATNQGVILTHKDLAVGLFAQSVGGGGGNGAGGGGLVGIGGKGGASGKGGDVLVSNSGSIETDGKQAQAVFAQSVGGGGGNGAGAGGLVAIGGDGGAGGAGLGVTVTNDGDLITHGYDSYAVFAQSVGGGGGNGGGAGAQFAVGGKGAGGGAGGNVTVTNHGAINTDLDGSGGVFAQSVGGGGGSGGDSVSLGLFVNLSIGGSGGTASKGGDVTVVNDGAIVTHGDRASAIYAQSVGGGGGDGGFGAGGAIGVYGAVSIGVGGAGGAGGEGGVVHVTADGTLVTTGADSRGVFAQSVGGGGGDGGYSVAAALAVGDVGAASGAISVGGKGAGGGAGGQVIIDHAGAMSIDTTGDRAVGVFAQSVGGGGGNGGWSGAIAVAGSGGVSAAIGVAVGGAADDGGKGGQVTVNTAGDIHTRGVDASAIYAQSIGGGGGTGGFALAGALAGGTAAGSASVGVGGKGGAGSNADEVKVTSVTDIVTEGDRSAGIYAQAVGGGGGSGGWSGAVAGAGGQAAGAVGISIGGSGDHGGKGGVVKVDSTGHIDTTGADAAGVFGQSVGGGGGSGGFSIAAGVAVGQGALGGSVGVGGSGAGGGDGDTVTIDTLGAIHTRGDRSAGIFAQSIGGGGGNGGWSGSLAIAAGQTAGAVGVGVGGSAGTGSDGKIVKVTSTGDITTEGHDAAGVLAQSVGGGGGTGGFSLALGVGAGQTAGAVTVSVGGTGGAGGDAELVKVKSDGVISTKGDRAYGVQAQSIGGGGGSGGFSGSLAVGAGQTGAAVSIGVGGFGGTGGDGGDVEVDVIDLILTLGDDATAVLAQSIGGGGGSGGFSIAAGVGAGQTSGSGSLSIGGFGGAAGDAGDLVTVTSHADISTTGARANGIQAQSIGGGGGAGGWTGSLAVAAGQTSGAVAVGIGGFGAGGGDGKDVTVDSFGQIETHGDDAVGILAQSVGGGGGSGGFSLAAGVSVGQSTGAGSLSIGGGGGVGGDGGVVTVHSRDLIETHNDRAYAIQAQSIGGGGGNGGFSAAVTAALSSGKPVGVGASIGGFGGSGGDAKDVTVVSDVGAVTHGEAAHGLIAQSIGGGGGSGGFSISGALTAGTSTIGVSASIGGFGGSAGDAGDVHVTTDGVTTTEGARAYGVFAQSVGGGGGDGGFAGSLAGGLSSTDNIAIGVAIGGFGGSAGIAGDVYVTNNGKVGTTGDGATAVFAQSVGGGGGSGGMAVSAALGGAKSKNISIALGGSAGGGGEGGDVNVTSTDLVVTEGDDAIAIFAQSVGGGGGAGGAAGALAVSGGESTNLAMNIGGFGGAGSMGGDITVDNSGVVVTHGEQSHGIFAESIGGGGGHGGMAGVDENQWSDYMAGGAGTVSLGSNSNNISVALGGFGGTGDDGGAVKVTNSGVVATTGESQANAIYAQSIGGGGGDAGVATAASGSFGQGKNGTYAIALGGFGGEAGDGGLVQVFNSGSLSTVGGNATGVVAQSVGGGGGGGGDARGFSLSFSKKASGAGTAKATSVNVSIGGQGGAAGDGGEVDVINSGQILTLGGDSHGVFAQSVGGGGGRGGLISTQGEEVVTFLDMANKGEAKGGQIAIGGSGAGGGDGGLVTVGNSGLIWTKGKDAHGVFAQSVGGGGGDGGSGLAGEVSIGGQGGVAGDGGEVRVTNSGTVVTEGALSRGVFAQSVGGGGGTGGATDYDGDDTYSYSKGLSDTMSVVGNLTATKDLVDSFSEPAWGISIGGTGGSAGDGGVVKVDNSGAIYTSGRLSHGIMAQSVGGGGGTGGEGTITAVGQVVFSGVGGTAGDGGDVTVTNSGLIQTSGYGAYGIFAQSVGGGGGVAGDTSLGIASWGDFGPFGGEDYSDYGKLSVNPLDGYGGDGGDVKVTNTGDIILLGEGSVGIFAQSVGGGGGLFGSGLGLSFAGSLGGTGDAGTVTVIQNGNIWTGAKNGVGAFFQSQAGDIDPVSAPTASSLAAPALAAPALAAFTPKDIVATLNGDVRGGSVYGKGILIDGGKNNVITLNGVVSAASNLAIVGTTGNDAIISNKGVIGNIDLGSGTNSFHNTVNSTLLTLDYVKLNGGLLTNDGIVTPGGNGLVQVSRVEGGFKQSATGVFLADLDLGKTGKAGEIDRLDITGSLDLKGKFVLQIADPGHILPGDHTATILNGSGTVTSSGMQLVAPTSSIATFELKTTADDLNLHYVVDFSPAGFNVNRTAVGDHINNIQLAGSSNGFAPVAAELFWEPSQVNLANYYDSFSPETYADQVAVTTFAIAGFTDSLMTCPTAPGQDTATRCVWTKAGGRRLTLDATDQDMAYEERSTGLSGGFEDGNDHWRFGGALSAEDLRTGIPTRTQGDGERYQFGAVVKRIDGPLTAALAFDAGTSSVETNRAVLLPSGLRMAEGKQNQGFKALTARVSYRFGDDKAYAKPIAELSHSRITTHAFSETGAGALNLVAPKQEDRATRLSVKLEVGGEFMQGVTAIRPYARIGASQTLSGRAPLFTAAFQSAPTPSGQFSVAGRLDKTTADAELGVAIVNAKGVSAKINWSGQFGDRVSNQSLAVKFSIPF

SEQ ID NO: 19822 - protein, 802 aa, Leptospira interrogans
MFMLYKFVVLSCFLSDAVRKYLLILKNTTQHITLKIRFLNSNVIFNFYKSFIRILLFIITLTLDGQESTLPTLKEEDKKTSEKENGIMVQGKKDKRDIEIFKTPSSISRFNEQDILDKGISRTNDIDKQVPNFAIIDSGARNFTYYNIRGMRSTLFSDPSVGLIVDGVPLVDNVALNTELFALDSIEVHRGSQATVFAKNFQGGVIEINTKKPNNMPQGRFMVDWGNYKKKEYSFFYNTPLIKNKLYISISGKSTQRNGYLNNVSGFNYPNNLVSDIPIEVHKTHPDGRRGKSGRLRLFWTPLENLEVDLQTNAESFDDGSLNIVNYLASKTERRKSLVKGCVVSPEVCDKNIRTYINRTKAVRKVFWDYEGVSNTTGKTYSSNITYKLPKAIFKTVYSIRKMEIDPLIVDGDFTRSPVIKSEYIEHSTTRTHETSIESKNKKEPLQFKIGTLFYHKISDKEFIQERLMQAYTYNVLKGLNAPAKEIHHSRVVDKSFSFFTHNSYTFWEKFTLTLGARIETQKIGIGHSRDARGVLFDNPYGDVRILSPHYVRNDSYRYNVSRIIFDYKPIESLMIFIGLSRGYKNGGFSTVVNQPSLAAFKPEINDTLEVGIKSKYFNETLGMNLAYFYTETADFHVIRAISIAEAINLNAEKVTIRGAEMEAYLKLHKSLQLGFLAGYTEGIFNKFYDRILNTNFDGKHVHFIPQYDVVSYLQYRSSPGLFFRYEFQVVGKMYFAADNTIYSSPYAITNLKIGYEEERLSAYLYCNNINNEYYFTSYIDGTFQAVPGAPRTYGFIVNYKI

SEQ ID NO: 19823 - protein, 638 aa, Leptospira interrogans
MEKSRHGAFVYAQKVLKHSLFLFLLINLLSISPDISASTTLLEQKYTLNLSFKDARLEQVLDAIMKQSGVKIAYSSDELQKDRVVSVDIQTSDILTALRSVLGDGYSFKQIEDYIAIARKETSDSSDVINNSVIDDRIWTIQGQVLENSEPPYPLPGVNILIKGTSLGTISDGNGYFTIKAKRGDILIFKYLGFKDYEYVVSRAISNLTVSLNSDSEELDEIVVTGISEEKRVNSVSAVSSLDVTKNLSTKPITSLSQSLQGGITGLNVTQSSGLPGADAAAIKIRGISTLGTSDPLVLVDGIPMDMNQLDPNTIESVTVLKDAAASAIYGARAANGVIVVKTKRGTPGKISISYNGYAGFQQATYLPEFVNAADYMQMVNVANANVGGAPIYSQEAIDATRSHSDLIKYPDTDWTDYMYQTGMIQSHSVSVSGGSNLARFALTANYLDNEALIDNAGYNRLNIRANTSVSLLDNLSVNMDFNSYRTNRHEPLQAVLNYLYTTPPNTVIHYPMKEGSDILYYGNRPEQRNPAALMEKGGVRTYLGDNISINIAPRWEIIPNLIVRGQYSYRISSGATKEERDAYNFFDYNSGSFLQTWGAIHNASKSRSSYYYLGEPLNIPWRKINIGYLLLVGIIRN

SEQ ID NO: 19824 - protein, 1173 aa, Leptospira interrogans
MNDRRNSFFRLFLLILLCLGVQSLRAQTVTKVFKNEPLKAVLKEVERQTKYSIIYKTDEVNENKKITASFQQATVNNVLATVLDKDVEYKLQNRMIIITKKTERNTTAVPSQPLHRVTGKVVDVNGDPVIGASVQVMGQSMGTITNLDGEFTLSSVPANALVVVSYIGFEKKEIKVSDLQKSSRVILREDTATLEEVVVVGYGTQKKINLTGAVAVVDSKAMEDRPVPRASQMLQGTVPNMNVTFGSGYPGASATINIRGVNSISGNASPLVLIDGIEGDIDRLNPNDIASISVLKDASSAAIYGARASYGVILVTTKEGSARKTTVSYDGRYSWSNQTTSTDFETRGYYSAGINDLFYTNYNGKPYTNYTEEDYRQLWLRRNDKTENPERPWVVTDQRDGRDTYVYYGNFDWYNYLYRKNRPMWEHNISVSGGNEKLNYYLSGNTVDQTGIFRQNPDKYKVYNFRSKISAKITPRLTISNNTKYHYNSYSYPGLSGINNNFNTAVNHALASFVPINPDGSAVYLTSLSNSAVLDGMGAILAYGKHKNEDQRYEFSTTFEASFNVMKNLNVRANYSYLHYNYQTMNRTVNVPYSKYPGEISYLTTGSGVNQLKETQTNHWYQAFNVYGDYMLDIADHQIKIMAGYNYETKRLKDIKVSRQGLLSDDLNDLNLAVGDAMTMSGGQNEYALLGAFYRLNYSYKGGRYLFETSGRYDGSSRFRSGHRFGFFPSASVGWRISEEPFFGNLKKNIDNVKLRLSYGSLGNQQVGYYDYIQTINTNGTMNYIFGDQKKGSYASVSDPNSADLTWETVSTWNVGLDLGFLNNRLNLTADAYVRDTKGMQTSGKKLPGAYGANEPKQNAANLRTKGWELMLTWNDAFKLANKPFRYNLSVGLADNTSEITKFDNPSKILSDYYVGQKLGDIWGYVVDGLFRTDEEAANYNVDQTAVNFVINTAQVNPGLHAGDMKFVDLDGDHTISSGSNTADDPGDRKIIGNSLPRYTYSIQGGFDWYGFDFSIYLQGVGHQDWYPGTNSVFFWGPYARPYSSFIPRDFLSQVWSPENPDAYFPRPIGYLSLGNNRSLGVVNDRYLQNLAYCRVKNITVGYTIPAVWTKKVKIERLHIYFSGENLFTFSPLKSDYIDPEQASAENSIQSANGNAKLYPWSKTYSFGVNVTF

SEQ ID NO: 19825 - protein, 777 aa, Leptospira interrogans
MKKQLYYYFRIFLFSILISPISILALDVTITGIVKDKNGNSISNVKIIVQESRKTTITNEKGEFVLNHVPPGKYTLVAISRGYQSETISITIGEKDEKTQFTLLESSLDQSAINVTAKSTNSDFLTAPQPITVLSGRQLDRQRGETAMSAINNTPGVSNLTTGSGTSKPIIRGLTGQRVLVMTDGIRQEEQQFGDDHTVELDSFNIQKIEIIRGPGSLLYGSDALGGVVNVIRDKAPLSGEGIPKMAGIFNSNSYSNNKQDAGNFAIYGNLNGFGYRASSNSRKAGKITTPNGTLRNTGMIEKNQSASIGLDGDWGNFYLDSFKREQTQDLLDNPNENPGATVSQKLLHEKSHFHSFFIFSAGNLELDFSYQRNNRREIESKNKLLPIQDILLDENAEVLDKSFQFYQVTSKEKYQGLNLFLDTTTADAKFHHKPIFNFLKGTIGISGLEQRNKTIGTEPLIPSYGIINIAGYFLEELKLGSLTFSAGIRGDKRSVDIRNNQTLGVFEQTKNYYMTTGSTGVVWRIYKSFSTIFNYGRGFRAPTPFELFSYGVHEGTGKFEIGNNHLKPEYSNNLDFSLRFASSKIQTEISVFQNHIQNFIYAASIAQIDLDSGLPKYEYKQGNAILKGGEFSIQAELFRKLVFSGGIDIVYSRNQSDTHPLPRTTPNRARAGLRWTEDSILGLKNFYFSINGRFYDSQYRVDPKETPTKGYNLIDVGLGFELPHFGDGTSKPTVDLSIQNVFNVSYVDHLSRYKDYALNPGLNAILKVSFPFTAIP

SEQ ID NO: 19826 - protein, 1064 aa, Leptospira interrogans
MYVQASDRSEGITISCKNESLEQVIHLIESQSSYLFVLNDKVNTKHKVSIKIENGNINAILNKIFQGTNMTYQVDGDHILISTTHKSIGLDETRQTTMIKGKIVDNVGEPMIGVNVLVKGTTNGAITDFEGNYSLADVNENDVLMVTYIGYLTQEIKVGKQSVINIVMKDDTQSLDEVVVVGYGVQKKSDLTGSISSIKPADITSTPTTNALKSLQGKVAGLDITQSSGQPGASISLTMRGNRSLKADNNPLVLVDGIDYGSFVDINPTDIESIEVLKDISSTAIYGTKGANGVIIITTKSGAKGQKTKIDFNAYVSIKNKAKYPRMMNGEEYAQLKREAYRTTNSAAPDQYMDDALIFNAEELEYLEKGYWVDWQDLLLGTGITQNYEISMSGGTEKTSYSLSFGFQDDKGLLKNDVLKRYNGRISLDHKINKIFNVGVNVSYTFKDQDKRQNPLNLANKIPCIGRAYDDNGNFILNPAPGNSSAFSPLCDEQPGAYEDNIRTKRMFASGYLNVNILKDFFFKSTIGIDVTDSREGIYKDKNTVANLGVKSTSSVQADNDWRYTWENILNYSKTFGKHGLTAMIGSSTTAYGYEKVLASGANQASALTSFHDLGANADSKENASQLIETQMVSFFGRLNYKFNERYLFQASLRADGSSVLAKGHKWGYFPSASAAWRISEEGFMADQDIFSNLKLRLSWGVAGNSAIDAYATLGGLKKSVYTFGSSVYGYYPSEIANKDLTWEKTSTWNLGLDFSILRNRISGTIDTYISQTSDLLLPSLLPSSTGYASVMQNIGKTENKGIEVTLNTIWFQNKNFSWNTDWTYSLNREKIKALNSGVTRDEGNLWFVGSPTQVFYDYKKIGIWQLGEEAQAKAFGGFKPGDIKVADMSPKGSEGEGVFSTDDRVIFSRVPKYTFGITNNITYKNFDLMFFIYGRIGQYVKDAYTQLYKPSALENSAPVNYWTPENPSNEYPRPNSGYSTNSYLLQSSLAFRKASFVKIRDITLGYTLPKEWTSKMMVQKLRIYCSLNNFITFTDFPNYDPESNGSMDFPLAKQVLFGINLSL

SEQ ID NO: 19827 - protein, 601 aa, Leptospira interrogans
MSRYLTGGAVAALVVAACAFAGSASAQTYNRLVVFGDSLSDNGNLYLASGGTQPPSPPYYQGRFSTGPVFTELLGFNAVNFTGSVSGSINYAFGGARTDASAGPPPGMLTQLAAYTSRGGTFGSNDLVSVLGGANDIFQGLPAAGASASPVGAITPVATSAAANINSLVNSVAGAGAGTILVTNLPKLSLTPQFRGTTAAPLADYAVTTFNSSLLTGLNTTAAARSGSNIILMDLFKIGDTLAADPGQFGITNVTQACFNGVTVCSNPSSYFYFDGVHPTAAGHQIIARLATDYLYYGDIGSQAALQGETTFRHREDALDAASEALSGREAWEAGVAVTASAMVDSVDTDARHSVTESSSDGWGGRIALEAGPSANWRFGMAGTARKTDVESQALTFNVESFGLDLYGGWRSGDLFVNAAVGVARDNIDDIERVTSLAPIVHTAETRAFSTGARLQGGMWFDMGGVALSPRAAVTWATSDVDGYWEQGVAAQYEYEDREMKAISGEVALRAEAEMGGFGLFAEGGYRDALDDSSDPVRVGLYNNPAQVLEREVEDPFGGQFLASAGVEGSLGPVKVTIAYRGRYGEHADSHMGGVQLRLPL

SEQ ID NO: 19828 - protein, 678 aa, Leptospira interrogans
MFAFGADCLSVRSSCRDGRSIRRAVTRARRLGWPLACLTALCVPSAAWAQTPNLGSAANFAVLAGSAVSNTGPTTLIGSLGLSPGSSVSGFPPGMVTAPGGIYIGDAIAIQAQIDLASGYNAIASRPTTADLTGQNLGGLTLTPGVYNFASTAQLTGALTLNALGNPNAIFIFNIGSSLTTGSAASVTVIGGGLGSNVYWRVGSSATLGTTTAFVGDILALSSITLNTGANISCGSALARNGAVTLDTNTIAARAFSSCVQAALLPTDSGVTPAQSGMAGLVNNAFANAIGNGNNLPQGFLNLSALTPEMLAIVLRQLFGEGGTGIAQGGILAMNSFLSMVLNPYANGMMSDGRAGFGPAQPVVRTLGYAPDSRMATKAPAAAAIDRGLLGGSDQRWGSWGAVYGGKTETRGLTALDTSDRSSRGFGVSAGLDYRLLPDTIVGVAVGGGTTNYALGNGLGSGHSDMFQTALYSSTRIHAAYVSAAVAYAWHDVTTDQFLSVATADHLTAHFNANNLGARIEAGYRFAVPGVWMVPEFGITPYGALQAQAFRTPSYAENINSDFARSFAARTETAVRTELGAWFDQANLLDDGNVLILRSRAAWAHDRTSTPTMNAAFLALPGSNFTVYGATPAGDLLLATVASELRFRNGFSVAAQLDGEFAERATRYGGTGRVRYSW

SEQ ID NO: 19829 - protein, 825 aa, Leptospira interrogans
MKLKMKHRSALPLCIFLFLLFSWEAPAQSEETNKPILSETSSNGEETEKEKWNQGTISVIGKRKTDLKRIPGSATVIEKEFLEQTKPVDSMEVLRRIPGASIRYQDTGLILNLGFRGVNNDLGRKVLILEDGVFTSLNPYSAPEQYYTPNIDRMERIEVVKGSGAILFGPSTIGGVVNFITKRPPKDPMLSVSVQGGSYGFFSSQVSYGGTFGNTGIDISILRKQGDGFREHQSFRIHEFSFKSVTDLNDKHTLTSKFLATAQDANMTYLGLTTAQFWNHSSSNFAEQDNRKLERYSGDIGHEWKLTDHSKLVTKVYSAYTERNWARQNYLRNTGSNFNTIPSNVIKSYDTEPFVNRPGDTVYMLDSVGHRNRSYRFVGAESRYQQDYQFLGIKNQLDAGLRYHYETADIKYLDGPPTPDYAIFGNGFNNPPTGVASSEYSLAKSGNVRDHEVNNTKSLAGFAQNSFQFQNRFSVIPGIRYEMFTQNRTILRQQTIDPVTNQPDPNSPSQEVDKGSKHTYHVVIPGLGLTYDIRKNANWFKDLTWFAGAHKGFSPPRYQDALNNSGIVNRIDPEYSYNYETGFRGDITKYLNAQITYFNLNYINQIIITSSTSGNDSASSAKNGGRTYSRGVETNVTFDPAQLFDSSFKLPIDLIYTRADARMNQYSIDTSKITADQSLLDFVVTQKDKNGNYVPYVSKDTATLAIGFIHPKGFYARVEYQYFSSQYHDDSNTRTVYWADSITDPLGKKVLQYLNITSNSSGETGVIPAYELINCSLGYKDPIKRWSLFITGKNLADVRYISGRLPEGIQVGPFRQINVGATFEL

SEQ ID NO: 19830 - protein, 573 aa, Desulfovibrio vulgaris
MNGNSFKHLWFSMMVLQIMATILPSTAIANPDLPTSDTWEQLQRYSQEGKKKPQQSQVTSVSQLSDVQPTDWAFQALQSLVERFGCIAGYPDGTFRGNRALSRYEFAAGVNTCLDRISEIIAAETSDRMTQGELLAVKRLQEEFAAELSLLRQDIRRIDTRLDQIENNQFSLTTQLRGEAIFALTDAFGEDTGTDQTVFQNRIRLDFNTSFTGRDLLLTRLQSGNASSFNRGVIGEGTQTFNIVGDTENQVQLERLFYQFPVSDRLYFILAAKGVTWDDFVPTLNPYIDDYDGGKGSLSAFGQRNPIYRLGGGAGIGINYEFRDHSLTSIFGPTSLSVGYLTPTATNSQPSQGLFNGDFSILAQLTVTPTDNLQFALTYNHSYFTPGNFGFDNGQNNGPVFNRTTGEVNRNAFNGYTGTGIANSLLGLTNGLNPLGVATGVSSHSYGLQLSWRVHPQVILGGWGGYTAARARGVADGQIWNYAITVALPDLFHEGSLGGVIIGREPYLANLDASGRLGRTLPTDSSWHLEGFYRYQLNDYLSITPGIILITNPNQSDRHQDLVIGTIRTTFTF

SEQ ID NO: 19831 - protein, 459 aa, Wolbachia pipientis wMel
MHWSNKWILPLIMKLAPNKQDQNIIEMIIMKIFNKTLIAVSVALVSTQTMAAGFQINAQSATGIGRAFAGDAVIADNASVLSRNPAAMALFDEKQLSMGLTYADVQVEVQDVFVNSNLGELHFGNVDDGAEAKVIPNFYYVSPVNDKFAYGVAMFSNFGTGTDTTELSNNIAMGAIPAPIDLLGKTEVTTINFNLSASYRINDNFSVGAGLDVIYGSGTLTRGGAMPTGADPVHVELVDVDADGIAFGGIVGAVYEINADNRFGVSYRFSPEFTADGTVMFAGTDYQEINIPLPDIFQVAGFHQLTDTFALHYTAQMTTWGDFHEITVTDPAEAQLKKYAWDDSWLFSVGGTYTLTDKWTLRAGYMFDQGVVGEVSSISIPDSDRQWYTMGATYNLSKHTSLDFGIAFVRGEETNLTEQSSVLGLVGNLNPALGDDLSTVHATTTSNATYYSIQYNYKF

SEQ ID NO: 19832 - protein, 97 aa, Wolbachia pipientis wMel
MIFGNIRIGGGARYLGSWYAYNNTYTKAYKLPQAIVYDAFIAYDTKISGKKVSFQLNGKNLSNKVYSPSTSGNASRTLIPVALGYAREVILNTKIEF

SEQ ID NO: 19833 - protein, 481 aa, Wolbachia pipientis wMel
MQGFWVRMAAVALSCFATLPTWSLVADAADRFIDVSNPSVHRVFLPMSQSVTIAVNATLGDIVVGDEKIADAQPMTDRTLYVIGKGAGTTTVNLFSPEKRSLGVIQIEVGVDVSDMAQAIRQVAPRSRIEVASVNGRVRLGGHVKDGVTMAAILEVAKQYGPDDIINSVTIDDSQQVNLEVRILEAKRNAGRDLGVSIRSNNSRSTTIVGTGIAAVDKDNVVLGTGGFLSDLLSTSTPFGALLTRVIDNNIKVDLYIEALEAKGAVRTLANPNLTTLSGEQASFNAGGEVPIRTLDKNGEISIVYKQFGVNLLFTPVVLDDGKIHMNLAPEVSDLNGFTTAGDPIFTNRKLSTVVELRDGQSFAVGGLLSSRTTKLQNQVPWLGQVPVIGTLFRNSSNQKEETELVVIVTPHIVRPVKPGEQLATPFDKTRPANDPEFFVLGQLEVNKDMIRRYETGDGVTGPYGHMLNFKSKDKMLYVKK

SEQ ID NO: 19834 - protein, 175 aa, Treponema denticola
MSGDSGGQSTLSIDYNIEGFGFVGAYSKSDRTNEQVGDGYGDNAEVWSLAAKYDANNIYAAMMYGETRNMTVLANDHFANKTQNFEAVVQYQFDFGLRPSLGYVYSKGKDLYARDGHKGVDADRVNYIEVGTWYYFNKNMNVYTAYKFNLLDKDDAAITDAATDDQFAVGIVYQF

SEQ ID NO: 19835 - protein, 914 aa, Treponema denticola
MKKLIFIAFFISGLCSALFAQTDKATVEGVVRDSDGKPLSFATMFIAELGTGVSTDLEGKFRFTGTKGTEYTLNVSYLNHVDKEVKVKAGSPEPLVIVLEEQSYELAEVVVMADYKKNQGSTAVINQQALEHIQPTSVADVLSLIPGGLFRESSATGFNRISLRQSGSDDNTSLGMAVVMDGIPQDNDGFRASIPGLSTDEYSDRLGMNRGIDLKTLSTDHIRKIEIVKGISSAKLGNLSSGVIQTTSKIGITPAQLRMKVDPLTKLIYLGKGFRISPKMGYLHTGIDYTSVYDDRRDPMSKYSRLTGQVTYNNSVDVGDKTLFLFFKLSEVYTLNQAKEDELTQDYNESFRNKYSRTGASFKAQMYDLGKIVDNVEFIASADYTYDLIDRNRLVQTGTPLPSPLATEEGESEGIYLPSTYYSPFQIENKPLSLLTQLNAESLFETRSFRHKVIYGLSWKRTKNYGEGVMVDMTRPPYPGNNEYVRPVPNRSIPALSVGAAYAEEQLKHSNRWFDFELNAGVRFTQMFNLDTKYTELRKLQVEPRINAALSFNIDLAGGKSLRNMFRFGFGQENKLPTLDYIYPDRVYKDMIVLNAYTKQDDPFNHLITYTKIYDVTNNSLRPNRNTKYEAGWDVEYEGYSLSLTFFKEHSDRGFESVAEYSPVRYTRYVDPIDGQPIVGRRPEKEDYVADPYATFVDMDIVRNSMKVEKKGLEYLLRFPKIIPLSTTVEINGAYYDTRYSSGAPLQYHPAFRDDDRPQPYVGIYRRQDITRQRIFNTNLWFNTNIPRYKMIFTTFFQFIWLNEEMRINGDEYPSAYFDTDGRMHTVDDRILQSIKDGHTVWRHYHIYKEDFSETLPVSLTVNFKVTKEFSRMIRASFFVNNILDINPLYKNRYNQNVRVWQKSFFGAEMTFSF

SEQ ID NO: 19836 - protein, 248 aa, Geobacter sulfurreducens
TRSIRGRGGARPQWCNRGSLIGLASGIGTLWVCRVVYQFDDASPAIDPWARYYDVASQLGIFKFHEDMPVSVWYDSPDFSDFSGSVQFVPAQNSKSAYMPAYVAVENGVAKKVAAVVGKPGSDVYYSGLNYKNGGFAGNYAFKYAKHANVGRDAFELFLLGSGSDQAKGTDPLKNHQVHRLTGGYEEGGLNLAWAAQLDLSENADKTKNSTSEIAATASYRFGNAVPRLCYAHGFDLIDRGKKGENTS

SEQ ID NO: 19837 - protein, 344 aa, Geobacter sulfurreducens
MRNLYFSRDRRNDDRDPETGDRQSRQAEWGQGFIGTFESGFTQGTVGVGVDAIGLLGIKLDGGRGTTNTGLFPVDSEGRPEDSYSKGYGAVKARISNTVLKFGGQFTALPVFATDDSRLLPEAAEGFLLTSKEIEGLELNAGHFTRLDAQAQSYKDSIRGRNDAGIKNGGLTEANIFGGTYAITDGLSTSLYYSKVEDYWRKYYANVNWAVPLSDKQGLVFDFNIYDTKSSGAANVKAFDGDKLDNRAFSLSAAYNVGAHTFTLAYQKVTGDGDYAYGIDGGGTVFLANSIARSDFNAEDEKSWQARYDLNFAEYGIPGLTFMTRYARGSDANVAGTTNGKEWN

SEQ ID NO: 19838 - protein, 750 aa, Geobacter sulfurreducens
MRTIIIIITSSKRGSVSGKRPCHVSRRLQMTFKALLLANAAMTAGMLAVMPQAQADSAAQKISQAETSALPTLSVQGQKTTASTPVQGFLATRDTSATKTDTPILETPQAVTVITQDRMQVLNTRSISEALRYTAGVNADSYGADVRGFYGSIRAFTPDVYLDGTRTPITTTSQAFQIEPWGMERIEVLRGAVSPLYGSGNLGGLINAVSKTPRLNQQNQMQIQGGSFGRIQGAVDVGGKLNKSGTLLWRFNALLRDSGTGYKNIKNNRIYVAPSIAWKPDADTSVTLLASYMQDDAGSSAQFLPAKGTVLPNPNGRIPRDFLNGDEQFDVYSKRQIAVGYAAEHHILSNWVVRQNMRFAHIDLNYRSIYGNGYAGQSLRTLNRVAMWQQPIMNTVTLDTNTEYKAATGPIGHDILLGVDFRSNANQQRNASLNGPTLDVFAPVYRSFTWPTFAGPRGVTLTSTNQTQTQTGVYLQDQLSYQNWHLTLTGRQDFASTSTVNNLKKSTASQDNQAFTGRAALLYAFPSGVSPYAAYSTSFLPQAGTDMQGNGFQPLTGDQVEVGIKYQPPSTNVLFTAAAYDLHQQNVLTPNPIAPTFSVQTGEIRSRGIELEATGKITRNLSLISAFTYQEPLITKSNVAGATGSRPVAQASHMASVFLDYTYPISEDLSVGLGAGTRYTGETAGAVPNTFTVPSFLLFDLVAHADYKQWRLQVNATNLTDKTFVAACSSLSACGYGQGRAVFASLGYRW

SEQ ID NO: 19839 - protein, 686 aa, Geobacter sulfurreducens
MMNLSNAARIPAHLSVVALSIITINSMLVSSLANAEEVALDAIVVTGEKINKNIKDTTTAITVITEDQLESGETKQVKDIATQAPNVVADSFGHIAIRGVSGGGAATGGVALMTGAHARVTTVVDGSTQDWSGYNFAPTDLWDAKQVEVLRGPQSTTQGSSAIGGAIVVNTNDPTFDSEAAVRVGLERYKNGNLKYNLAAMSSGALIYDELAYRIAVDENKGEGWLNYDTSRYSKDHPNLSESENLNLRGKLLWQPKSNPKLSAKLTLNHLKNDGEHANFASNTDAGIATQTMTVADSGGAISRVQDSEENSIAADINYQLSPDITNILHISYINSDIYADGYGSANGGTTHTYDIQQTTTSLENRLVFNRKNSTLNGVIGFFTANKDSVIDATQGIINIDTDYSISTTALYGEGTYSLSPKTKATLGLRIEQEDVDKIGSFFSATKVDQNTNDTYYLPKLSLTNEVSDTTTLGASIRKGYSSSGTYINTAGEAFSFESEEVSTFELSSKSNFGNGTMLNAALFYNDYTDYQALSGFTIVNVDAAHTMGAEIEVTTWATDNLELRGSVGLLRSKIDKNNTNKGNKLSSAPETNLGFGFTQYIGDAWSFGADITYVGEYYSDLANSDTTTVGDYLITDARAQYTVGDLTISGYIKNLTDEDAVYFRADSLASVAQTRTIGISALYRM

SEQ ID NO: 19840 - protein, 406 aa, Geobacter sulfurreducens
MYNAEKTNRISKNLVLVFILLIGFRGLSQQEKDTTKLMNVRYGSKGIELQTKDNKFLFQLQSRLQFRFSTPYDTDPLTYDDYSQDAKTTFKINRARLKVGGHAFEPWLKYYWEYELSQSNLLDFRIMIEKWDWLSFKVGQWKTEFTRERFISSGEQQMVERSLINRPFTVDRELGVEVYGHLKGTGIADFNYWFAALTGTGRGSTSNDDNHLMYFGRAQWNFLGRFLDFEGCDLEFHEKPTPIIAFSAITNRSPYTRFSQAGGGSLDGFENGLPGQYRVNQWNLETAFMYRGFSWQSEWHTKEIIDKYNNNDMTVMKGYYVQAGYFFHNVFEWWPKHLEMAARHAAYRPDYSIRQNRQDESTLAFNWFFKGHKNKLTSEVSYFSFQDKTLPLEQGWRFRIQWDISL

SEQ ID NO: 19841 - protein, 322 aa, Geobacter sulfurreducens
MFWRSLSSLHTLLAGGVGLLMLELLVGYQPVQAQSCTVDPLGGEVCLPDPIPETPNQPEIPDESIETQEQDQPEKSDEPETIDQPDKPNPMVIVPPCFGPCTQFPPAPPYRQFQELVEKTDAADMVITVDGLRYEEVVDPHSLLFTNELNEPGVNAWVRGFGGASSNGAAGHRYANFSNGGGQLGIDIPISDETRIGLFGTYAVMNGTDGARGSWDTDGWGGGAYAEYWTRNVYLRGMVSGGGYSGEHLRKIDGDTAKGDRSGNSWTGVLNIGAPLQSGEWIIEPQALLSYTNTSLDKFSEHGADRRDRLRFHEMEVDQLGS

SEQ ID NO: 19842 - protein, 781 aa, Geobacter sulfurreducens
MPTARRWPILSSPRLLRSATARLLLGAAICLVSLPPSSRPAEAQGVAPAAGAELPSVTVDAPAARPARPRSVAAPQRNPQAVARRPNPQRNPAPAPPTPSERAAAAAAVLNEQKLGYRAMPSPTTLRTGASPLESSQSVNVVPEQVLKDQLPRNLDDALANVSGVTQTNTLAGSFDAVIRRGFGDNRDGSIMRNGMPLVQGRALGATVESVEVLKGPASLLYGIQTPGGIVNTISRRPELYQHGSLTLLGSSFGGGKNGANAIFDLTGPIGDTGLAYRFIGSGLDEDYWRNFGANREMLLAPSLAWYGERTTVQFSYEHREFSYPFDRGTSFVNGAPLAIPATRRLDEAFNRTWGKSDLVQGSVEHRLDDVWKLTAAYSYNSETYDANQLRITGVNAATGVETRSNDGTKGALAYSSYGTSYLSGELWLGGLRNDVLIGGDAQRRVIYRQNLIRQSTPSFNFYNPVYGLVQPGTTVSASDSDQTDKLETRSLFVQDTLHLTDWFSLVGGLRWMEYDQLAGRGRPFTANTDLAGSKVLPLAGAIFKLNQQVSLYASYTQSLQPSSTIAPLTGGVVIGSNIAPEEGTQYEAGVKFDLNKRLSGTLAVYDIDKKNVLVSQFNASTGLNEYRAAGKVRSRGVEFDVTGRLDDHWSTIASYGYTDAYVTEDPTLVGKRLQNVAMNTASLFLVYDFGTALPGRLRLGGGARYVGDRPGDSTNSFVLPAYTVADVFASYEVKHAGIPVIYQLNVKNLFDQVYYPSAVNTLNVALGDARRFSLSATAKF

SEQ ID NO: 19843 - protein, 340 aa, Geobacter sulfurreducens
MKVRSLCTAALCCAAAGLLAGRSSHAQTSATLYGLIGLDVASTKRSGGPPAAIAMQSPGLTAPYWGLRIAEDLGGGYRALAVLESFFQPVNGGIGRTSADPYWGRNAYAGIEGPFGTVTLGRQTNLLYLAEQAVNPFRASILFSPLVMQTFVASYGGAIAGDTVWNNAIQYTSPTVGGLTASAVYAPGGLAGANGAANAGLSLRYASGPLTAVAAAQRTRIVAGAAAPTQHAYLAGFAYAFPRITLYGAIQGTRTTATDTGSHTFEAGVSVPVTSRLSALGEWAYTRRTAARTAVSRNTGVAGLDYSLSRRTDVYALAGYDRLGGSGVAATWALGIRHLF

SEQ ID NO: 19844 - protein, 1133 aa, Geobacter sulfurreducens
MKKHTFCRFSILLSIILVFLLYPMSSMGAQKYISVKGEDMTIKQAIQLIEKNSEYTFFYNASDLENNTKRDYNSTGNIEKVLKDVFEGSNVSYVIKGKEVILKVTKTENTQQVKKRTIIGVVTASDIKEPIIGASIWLKNSSIGVITDVDGKYSIVIEGVGGVLEFSYIGYKKQEIALANQEVINVVLEPDTEVLDEVVVVGYGSQKKESVVGAISTLDMRKLNVPGASISNVLAGQLSGVVAMSRSGEPGKNSSADFYIRGVSSFKGTSTPLVLVDGIERDLDLVDTDDIATFSILKDASASAVYGVRGANGVILITTKKGQEGKPAINVRTEFGFTAPTKRPEMINSAQWAELYNEASGTNYYSPEVIQKYRDHSDPDLYPDVDWFDALFDDMAENQRVNLSVTGGGDNIKYYVSGSFYNESSIYKNAGNIYGYNSAIRYNKFNFRANVDLNVTKSTTLNVNLANIYEKSFGPGFGDNDNDIWSYTFNASPNAFPVQYSDGTLSGPSTDSGHNPWNMLVHSGYREQFWNSAQSLIGLTQDFGKIWEPLEGLTANIKFSWDAWNTTLQRRSKSPSFYHARGRDAEGRLMYDDNNNDGEWDPVHTGSESLGYEIGRQGTMTRYLEGSLNYNRLFGNHRVGALFLYNQKIHTNTQAADGNAALPYKNQGLAGRVTYAFRDTYFAEVNMGYNGSENFARGHRFGFFPAFALGWMVSNEKWFEPLTKTIDMLKLKGSYGKVGNDDIGGQRRWVYESTIVGTGDQGWWFGQSGNQGGAGIRVGEIENLYASWEEATKLNLGVEFSLFNKVKVQADYFREERQGIFLQRAGLPAIVGLSTIPYVNIGRTLNKGFDANVEYNHQIGKVFLTARGNFTFSRNKLLDNDEPDWEYKYQNRIGKPFGSDGQMQPFGLVALGLFQSQEEIDNSPRQTFGEYRVGDIKYQDINGDGIIDTQDEVAIGYTNLPEIMYGFGLGAQWKNWDINAFFQGSAHTSFFLDGVSVKSPFSSGNMERAAINKDLWGKVWMSTNSPEQNAHVTYPRLSNGSGGAGASNNNKNSTWWLRNGSFLRLKNIEIGYTLPKEFVTKTFIKSLRFYVSGNNLLTFSSFKLWDPEKAKGSSDGSGYPLNRVVTVGFNANF

SEQ ID NO: 19845 - protein, 1006 aa, Geobacter sulfurreducens
MKQRIVFVMCLCFLLMNGVLAQTKSLKGTVKDKLGESIIGASVLIEGTSQGTITDLDGNYVIENIPAGKNVLVVSYVGYQTQKLEINGRSVIDIVLQEDTEVLDEVVVVGYGVQRKTDVTSAVASIKKENFTQTVTSSSPLQMVQGKIPGLAMSRAGGGDPTSDMTLQIRGMSTINAGASPLIVIDGIPGGSMSTVSPNDIESIDVLRDGSAAAIYGSRGTSGVIIITTKKGVADGKTKIEYDGNVSFDQVSSTWDLLSGDEYRSLKESMMNSSIKLAQEKGQAMVDYGGNTDWMKEITRTAVSHQHYLSLNTSSKHSRTAASLTYNNYQGIVATSGKEEINGRISTEFKHFNDNLKVNLNLAYTSKTQVPIEKLALRQALFWNPTMTPYQEDGSYTPGADPLIYNNPVNLINETRREDKYNTLMGNAKITITPFKGMTLTGMIGLDRTESSLAWYKTSKHEEMMMKGKSGEAYKKSALNETRTLELTAGYNRQLIDDLNFDIMGGYSYQEFINEYLDATNYDFKFDDNGYNSIGSGAALKNGQASLDSYKGSSKLIAFFGRVVFNYKDKYLFNATVRHEGSSRFGKNHQWGTFPAASVAWRIINEPFMKEQKVFSDLKLRLGYGVTGNMIDQAYLNYVLFASQPIYAHNGSTSGNAYEPTYAPKTNANPDLKWETKKELNVGLDMAFLGGRLNANIDIYQRKSEDLLYKYNVPVPPYLASEMWGNIGTISNKGVEIGINATLIQKKNFSWSMNFNGSYNKNNVEKLTTADGDVQERYELNLASPMNGHWAVVTKVDAPIGNFWGFKYAGVNENGETMVYQLNEDKSIAMGEDGKPLTLRWLDAKGSEDNKTIIGNGMPKYYANMSHQFRYKNFDFSFLLRGVFGFDILNLGSAYQGSPTFNRVDNVLKSALTSPIYDEPSITDAVVENGNFVKLDNITLGYNFPIKNNKFISSLRLYGSVQNVATFTSYSGQNPELEINGTVVGVDNMDAYPVARTYSLGVKISF

SEQ ID NO: 19846 - protein, 751 aa, Yersinia pestis
MLRLVSKTICLSLISLFNPLEAFQKHQKDVFFVEAGFETGLLEGAQTKEQAIAQNTQNTQKIYENPLTHPQTKEQPKEQNKSDTATPQSVYGRYYILQNTILEKATELFTAANINGNGLTFYSQNPVYVMAYNKDNAEFEGYGNNSVVVIQNFLPYNLNNIELSYTDAQGKAVNLGVIETIPKDSQIILPASLFNNFSNDSPFNSDGLQQLQTTTTPFSDANTQSLFEKLSQITTNLQMTYENTDPFSSGNNDPNGPLASPKPHYECPGYKKSCQVASVSFTPQTAEELTNLMLDMIAVFDSKSWEEAVLNAPFQFSNSPSECGIDYPKCVNPFNNGLVDPKDEKYALTPEEVINSYRVANELTVNLLNAAKGFLGLGSQLGSANAPDDDGFNQGVLGIAPFALDPEKLFGKNLNKVAILALRDIIHEYGHTLGYTHNGNMTYQRVRLCQEGNGPEARCEGGHEVEKNGKEELEFSNGHEVRDHDGYTYDVCSRFGGKNQPAFPSNYPNSIYTNCAQVPAGLIGVTTAVWQQLINQNALPINFANLNSQTSHLNAGLNAQNFATSMVSAIAQNFSTTSTTTYRSSSKNFRSPILGVNVKIGYQHYFNDYIGLAYYGIIQYNYAQANDEKIQQLSYGGGMDVLFDFITTYTNKKQDHPTKKVFASSFGVFGGLRGLYNSYYVFNQVKGSGNLDIVTGFNYRYKHSKYSIGVSVPLIQSGIKIASNNGIYADSVVLNEGGSHFKVFFNYGWVF

SEQ ID NO: 19847 - protein, 761 aa, Yersinia pestis
MNNHKIWRLSAVAVALLISGNSYADQTLHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEVYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGGASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYTVSSNNKNYDLIDTRYSSYSDHAVALHAGVRLDGRYPLTNETLLKPFFNVGFQQMLYGDEITIDQSIPNSPVVGVSTKDKTTQGTFDLGMALVSDNGVSASLQLSGMVNSDRQDFTGWANLGWAF

SEQ ID NO: 19848 - protein, 399 aa, Yersinia pestis
MKNSNDTKISSGFRITTHKAALATAVALSMCSSLSYAQAESASRNILSGSDAVKLSISGQINRAALLVEDGEDTTLLNVDNNASSSRVRFIAESTASGPWSAGAALETEFRLNNSYTISQLEENQDDSSAFRNRRIEVYFANKDLGKVWLGQGWTASEGVSENDLSGTAIAGYSEVNTTSGGILFREKGFDGELSPRSGGGIALRDVATNLDGLSRNSRIRYDTPEFNGFQLRTSAVNQGGVDVALFYSGNVDRLKIAAGIGWANSNEATGNDGVTALDDQVSGSISVLDTSGFSATVALGQASKNDSSLEDVTFYYTKLGYQTKLIDAGTTHFSVDFSNTDDLQLKDDTAEVVGFQALQKINSIGTEVYGGVRSISLDRTGVDYEDNLVALLGARVKF

SEQ ID NO: 19849 - protein, 1449 aa, Yersinia pestis
MKNSNTLNTRLLPLSILISSLVSGGAMAVPVVIDGGNNGLVDNISTPVADGGAVAVEPAVEQPGLLDKIKDLLGLGEITEDQAKALTENVKAKAEKVDAQAAAKLALESAQAEAQKAAEDALYLKTENVSYQAFAQTEEKIKKEADEAKKKQDKSKEDAIKAVIVNNAPLVPGADDIAEQVTKAVTDTKKVQEEKAVELDEKTTKATEALEAKEANTKALEEIKGRLGTVTKDLETATNTDKPALAELVVEAKAAQADDEKKPLTAIAIAKAADKKTEAELNNNTDTDEGRAKKAEAVKNRKEYERLAAEYEEKIAEAEQKVKDIEAKIQELTKNQGFIKKEQSTEDAKTADLDSTLKKANSAKVAAQGEFDKAETAAKLAETAAKAIEAAKLTDKAVEDATAAHKEAADKAEQTKAAVEAAEKVKTEADKLVVTNTGLLNDADQALEQLIADQNNVSPSTDLPTIDVTIEPTKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAAGGVVTAGDHSVIEKMISSGDVTASGNNTIVRDTTINDGKLSLAGTATANNTTFNGGIFSVEGDTTATKTTMTGGKFAVTGNAKIEETVVSAGDVLLADNATASNTTLTGGTFTAAGDAAVTATNMRDGQLAVKGNATIKDTKLSASDFSLADNATANNTTLTGGTFAAAGDTAVSATNMTGGTFTVADNAAVTATNLRDGQFAVTGNATIKDTVLNASDFSLADKATANNTTLTDGTFTVAGDAAVTATNMSGGKFAVKGKAKIKDTQLSVGNFTLAENATANDTTLNGGKFDVSNEATATNTTINNGLFTLKDGAHADSTTVKSGTFVMADQSTANGIQLVDSAFTLASGAKASGITTLTGGQAQVAGSLESLSLTGGRADFANNAKASGLLDISADSQIIMNRGADTAQANLNLAGRLELLASDVAQAVAQPAARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPIALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSTMGTLGVNAGYRFVMNNGAELKPYAIFSVDHEFAKNNQVTVNQEVFDNNLSGTRVNTGAGMNVNITPNLSVGSEVKLSSGKDIKTPVTINLNVGYSF

SEQ ID NO: 19850 - protein, 183 aa, Yersinia pestis
MVFMNKTLLVSSLIACLSIASVNVYAEGESSISIGYAQSRVKEDGYKLDKNPRGFNLKYRYEFNNDWGVIGSFAQTRRGFEESVDGFKLIDGDFKYYSVTAGPVFRINEYVSLYGLLGAGHGKAKVSSIFGQSESSRSKTSLAYGAGLQFNPHPNFVIDASYEYSKLDDVKVGTWMLGAGYRF

SEQ ID NO: 19851 - protein, 377 aa, Yersinia pestis
MRVIIMMKRNILAMVIPALLAAGAANAAEVYNKDGNKLDVYGKVDVRHYFANSESGEDGDDSRVRLGVKGDTQITDQLTGFGRFEWETKTNKTENNNDNKNRLAYAGLKFKDFGSVDYGRNYGVIYDTNAWTDVFPLWGGDTMAQTDTFMTSRNRNLLTYRNNNMFGYVDGLSFALQYQGKNTDSNKSGASAQDEHGDWSNGYKDNGDGYGFSTAYDLGWGVTLGGGYSNSARTEAQKYEGSTAHGDRAQAWNVGGKFDANNVYLAAMYGETLNTTHFGSAHEIANKTQNVELVAQYLFDFGLKPSLGYNQSKGKDIEGYGNEDLVKYISVGSYYYFNKNMSAVVDYKINLLKDNDFTEAKSIMTDNVVGLGLVYQF

SEQ ID NO: 19852 - protein, 473 aa, Yersinia pestis
MVTHCQIAAHKAKRKTLALAIAGVLFGTGFMAVPEARADGFIDDSSLTGGIYYWQRQRDRKDMTPTSPEYGKYVANLHHSTFNANLAFSSGYVADMFGLDLAAFGAVEISNSGPAAPNEIGFSDAKTRWDEKWTGDKSGVSVYRAAAKFKLGDFWARGGYIQPTGQTLLAPHWSFMPGTYRGAEGGAKFDFDTAGALSMSYMWTDEYKAPWYQNMYHFRQADGLTGVSYLHSFGAKYDFKNNLVMEAAFGQAKDYMDQYFAKASYAFPVAGNDLRTTYQFYGAKDKVDGGASNANDVYDGLAWLQALTLGYTTGPFDLRLEGTWAKADGNQGYFLQRMTPGYATSNGRLDVWWDSRSDFNANGEKALFGGVMYDLKNWNMAGWSVGTSYAYGWDAKPSTNPKFDQNTRLKESAWNFDILYTLQEGRAKGTLFKLHYTLYDNHTNIPSYGGGFGNVFQDEKDVKFIVIAPFTLF

SEQ ID NO: 19853 - protein, 1152 aa, Leptospira interrogans
MLLKREITSLLFVSALCLLHAQVNTGTITGTVTDPSGAVTPNVRVTVVQTETNFESRAVTNSEGLYRVQSLQPGIYRVTFEGEGFKRVVRTGLDLHTGDVVPVNVRLEVGQLTESIQVTANGTLLETETSASGSLTEGDTLYKMPLYQRYVLNALNLNPGMTMSGYAYGGSLGGFNVAGQRSSGTAVFEDGVLGNDPQSSSGTDIKPVENSVDEVKVLTGTLPAEYGHSTGGLLTVVKKGGTNGFHGTAADLGRTRTLTHRQFFNLYKTSDPQPGAPNGVPAWFMQPDASVSGPVVLPHIYNGRNKTFFFFGYQKLIEKKSAAFTSQTPTPDLLNGDFSFGGLGVPLYDPLTTRQLADGTWTRDPLPGSIVPKNRFDPVAAKIIALNPWLPPNTPGSLTSSGPVSNFTWASKSRTFFEDYSQRVDQQFNSNFKLYGSYTYNHQGGLQRPTSIAIPAFDGANGILTPFTQRNLSLGATKLFGPTALNEVRLGYYRARNDTIVPSYNQNWASTLGIPNDSPLLMPSFSGTAASGNSTAPGLNTAYGLTVPGPSRTVRETLSFRDDFSKMVGRHALKAGYEVLYFKGNYFQLGQPSGVFQFDNMTAGLQPNGQPVPNTGNLFAGFELGSVRQANFSLYTATWLPRDSIHSLYLQDDWKVTPTLTLNLGLRWSTESPYHSAHGQLSNFDPTVVDPVSGKLGAIVHPAGGLNNRSLRNFQPRIGGAWHPAEKWVFRGGFGINTVDIRFPNALQQFDEYQAQVVQQRAPGDPRPLFQLSQGPSPVQYNIQPNNTATYVGTNFGSRSANWMDGNLHPGYVMNWNTTVEYQISTNNLLKLMYQGSAGVHLVESWNYNLFPTDFGADNPSLRAAAFAAPQNYLPFTQFGSINYMSNTGHSTWHSGTIQFQKRYSQGIVLNTFYTFSKALDDCDSDSGTCSGVAPKTNRNLNKARAGYDRRHVFVTNVVYELPVGKGRHFVNHNRALDYVIGGWELAWVESVETGNPFGFSFTNSPNNYFPSSMGNYVPNLTCSGISMPGYGLGSKIGGARFNQALENPVLDVNCFAPPAAFTVGNAGRNIVTGPGILYSQASLKKNFAFKERWNLQLRFDYQNPFHNWGFNNPSNQVDFRNPQLFGKITGDQTTASFAGQPLMNLMLRLSW

SEQ ID NO: 19854 - protein, 710 aa, Leptospira interrogans
METNPILNQLNMFFSFRRFFSSNWIQILFLFLFYVSIQAQDENIKTENKVIQKESPNTTTTDSKKDNGNGQNGQIVPEESQIVVTGSRGERRLKDSTVATEVISRKKIEASGARNAAEVLETQLGIDVVPFFGGSRVRMLGLDSQYVLILIDGERISGRLNNAVDLSRFKVQNIERIEIVKGASSALYGADAIGGVINLITREADKKLSYEMRTTYGNGSRKNFNTEGEFNTTANMGFRNEYVSGAVSAGYNKNPGYRLVPNSQATTGNAYQDLNTGINLTFNPDGKFKGKTRILYQHRDQNGVDVTQSKAVFDRNNKTHDFLATGSLEYGFGKRNLISFRGNISKWENKYYNNQRGSDELDVKQLNSELTSQGTVQLDMEASEKHFITVGAESFANELESDRLQSRYVYRTRKAVFFQDEWTVSRSPRIRVVPGVRYDDDSQFGNQTTPKLAARYDIFQNLVWRASYGRGFRPPSFQELYLRFENPAVGYVVEGNPNLKPERSITINSDLEYSPFSFLTFSLSVYRNDIINLIQYKFDSNKGREFAEFQLQNIAKAYTRGGEFGVQYRFLKYFTLELGYNHTDTRDLSSDRPLEGRALHQASANFIYNSPGGFQFNLRGKHLDKRPFYSSTNNLSAAGQDYIPSEVKLNENPPVIYGKPFTILNVRIEQKFFNKHFALFLGVDNLLNQYELAYNPTRPRFYYGGFSAQF

SEQ ID NO: 19855 - protein, 696 aa, Vibrio parahaemolyticus
MTKNNLLTVAIRKAMVCAIAPTVAVVALSANAQDDVTAMETITVTAQALKVETPAAETPRSVSIISEDELRVRAPQKLDEALRYTSGVTAQPYGADNDTDWFKVRGFDAATYLNGNRLFRDGYYTWLVEPYGLESVEVVKGPSAILFGESAPGGIVNAVQKKPTFTPQGEVKVEVGNNQHQSVGFDIADEANDDGTIRYRLVGLMTSQDGELDGTNNERFYLAPSVEFDISDRTMLTVLATYLRDDGVPTNPFFPAAGTLIGSNFGKIDPSTNLGQPNYDKYERTQFSLGYLLEHDINDTWSFSQNLNYGSNELYLRSSYAFSNNDPAKEELTQGIVFRDGKNQSITFDNNAVGNWMTDNAEHTVLVGMDLQFHKTDGDEQDNYAFGTINPWNPVYGNFNPLDPSKNVKREIEKSQASVYSQYQLKLHEQWIGNVGARYDWVKTENSGKGVGVDQNESRDDGQLSLSAGVMFLANNGLSPYANYSQSFEVISTIDAATNELYKPLEGEQVEVGVKYEPSFMDGFINLAWFDITQKNALVTNPSTWIATQTGEVTSQGIELESTAQLTDDLKLMASYTYTKAKTDESFGKGKKQAALIPEHQASAWVDYSAYSLIPGLNIGTGVRYVGESKDNPKSSNLNVPSVTLWDASVTYDITSQWQAQLNVNNILDKEFVSGCDYWCYYGQSRSVMLNANYRW

SEQ ID NO: 19856 - protein, 823 aa, Vibrio mimicus
MKSTKALADSLARIVLSAFLMLALLVPLAAQAGTITGTVTDKTDGEGVYGASVTVNGTTIGTATDLDGNFTLRNVPETTQKVSVSIIGYSPATQAVTVGAAGATADFTLSQTTVMASEVVVGAAMYEQDRLDMPVTVSVVSSEEIKEKPAASLDQVIENVPGVVVNRAGGFGTATVQIRGSNTFNGGGIGTRVQGLYDGFPINTPVTGEIVWHNINMNAADKVEVLKGAAATLYGSGAMGGVVNVQGSMPEKFEVKAGFSGGYYDDPPVGDKSDYYDTGSTPWFWNTYVGFGDKQDKLNYSVLYSHGDDDGYKQNANHKLDDIKFKARYDIDASQYVQLSTFYSETKAAYPTTWPINFAANNTPLPDFAYENLGDNYDDDYIRRKNALVGLNYVNMLSSDLSVDTRLYYTRNENRVEYNPEGGDETTFVLALDKDVVSRYARQFNEDISDRFGAGTKVDYRLNDNHRMLFGVDANIVDVQSTQYTDEIPDAPVLDDDALHGIQERNLAFFVQDEFKATDRLTILASVRYDWSDISADNVTYVDYSAADANNSVTTEIDNPSVDALSPRIALNYRASDKTALRASWNRSFRAPTLAERFVRDAGMWDGNPNPELDKETLTAYEVGMFTMLNKRVSFDISAYLNYYDDLIESQFLPVTNSPTNTTYFTYTNVNKARIWGIETALNINPIDPVNVALTYSYMNAKNTDYEEGVNTFLDENPDPEWLPMRPEHTASASVAWKATNRLTLNTSGRYVSEYKAVNAYTDPDGENYPGDFVVFNIGAKYKVNDNFSTTLLCRNINNTQYEEAEWFRAPGRSFVLGVDFTY

SEQ ID NO: 19857 - protein, 185 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSIVGAEA

SEQ ID NO: 19858 - protein, 185 aa, Wolbachia endosymbiont
SYYVRLQYNGEILPFKTKITGITHKSGKDKDSPLTRSFIAGGGAFGYKMDDIRVDVEGLYSQLAKDTAVVDTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEA

SEQ ID NO: 19859 - protein, 186 aa, Wolbachia endosymbiont
SYYVRLQYNGEILPFYTKVDGIKYEKESKAQDPLKASFIAGGGAFGYKMDDIRVDIEGLYSQLNKNDVTGAEFTPGTVADNVTAFSGLVNVYYDIAIEDMPITPYIGVGVGAAYLSNPSKADGVKDQRGLGFAGQVKAGVSYDVTPEIKLYAGARYFGSYGASFKKATASTNKDINVLYSTVGAEA

SEQ ID NO: 19860 - protein, 186 aa, Wolbachia endosymbiont
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDSTKQVTDAGAYKVLYST

SEQ ID NO: 19861 - protein, 182 aa, Wolbachia endosymbiont
SYYVRLQYNGEILPFYTKIDGITNATGKDKDSPFKASFPTLAGSGAFGYKMDDIRVDVEGLYSQLAKDATAVSDDKAADSATAFSGLVNVYYDIAIEDMPITPYVGVGVGAAYISNPSKANAVKEQKGLGFAYQAKAGVSYDVTPEIKLFAGARYFGSYGASFNKETVSATKEINVLYSAVG

SEQ ID NO: 19862 - protein, 185 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKTAKGDTAIKNVVYSTVGAEA

SEQ ID NO: 19863 - protein, 191 aa, Wolbachia endosymbiont
SYYVRLQYNGEILPLYTKVDGITYTSGQSPLKASFIAGGGAFGYKMDDIRVDVEGLYSQLAKDATVVSDDKAADSVTAFSGLVNVYYDIAIEDMPITPYVGVGVGAAYISNPLKADAVKEQKGFGFAYQAKAGVSYDVTPEIKLYAGARYFGSYGAKFDGETKKQGSSENEVTTTDKGAYKVFYSTIGAEA

SEQ ID NO: 19864 - protein, 185 aa, Wolbachia endosymbiont
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVGYSTFGAEA

SEQ ID NO: 19865 - protein, 184 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGAKFGKTTKDDGGIKVLYSTVGAEA

SEQ ID NO: 19866 - protein, 180 aa, Wolbachia endosymbiont
SYYVRLQYNGEILPFKTKITGITHKSGKDEDSPLKASFLAGGGAFGYKMDDIRVDVEGLYSQLSKDGDVADNPAIAESLTAFSGLVNVYYDVAIEDMPVTPYIGVGVGTAYVSNPLATKVTDDKASGFAFAYQAKAGVSYDVTPEIKLYAGARYFGSSGANFGKTAKDDAGIKVLYSTVG

SEQ ID NO: 19867 - protein, 187 aa, Wolbachia endosymbiont
SYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGTNFDKSGGEKDKGGHTVPYSTVGAEA

SEQ ID NO: 19868 - protein, 161 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGA

SEQ ID NO: 19869 - protein, 184 aa, Wolbachia endosymbiont
SYYVRLQYNGEVLPFKTKIDGVTYKSGKDNNSPLKASFLAGGGAFGYKMDDIRVDVEGLYSQLSKDADVVDTPPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEA

SEQ ID NO: 19870 - protein, 184 aa, Wolbachia endosymbiont
SYYVRLQYNGEILPFYTKVDGIKNAKDKEKDSPLTRSFIAAGGAFGYKMDDIRVDVEGLYSQLAKDTAVVDTSETNVADSLTAFSGLVNVYYDIAIEDMPITPYVGVGVGAAYISNPSKADTVKDQKGFGFAYQAKAGVSYDVTPEIKLYAGARYFGSYGANFGKAAKDDGGIKVLYSTVGAEA

SEQ ID NO: 19871 - protein, 128 aa, Wolbachia endosymbiont
SYYVRLQYNGEVLPFKTKIDGVTYKSGKENNSPLKASFLAGGGAFGYKMDDIRVDVEGLYSQLSKDADVVSDDKAADSVTAFSGLVNVYYDIAIEDMPITPYVGVGVGAAYISNPSKADAVKDQKGFG

SEQ ID NO: 19872 - protein, 194 aa, Wolbachia endosymbiont
SYYVRLQYNGEVLPFKTKIDGIEYKKNSDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDLEKKVTDKGAHKVFYST

SEQ ID NO: 19873 - protein, 195 aa, Wolbachia endosymbiont
SYYIRLQYNGEILPLFTKVDGITYTKDNSDYSPLKASFLAGGGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLTALLFFTALLVQKLE

SEQ ID NO: 19874 - protein, 182 aa, Wolbachia endosymbiont
SYYVRLQYNGEILPFYTKIDGITNATGKDKDSPFKASFPTLAGSGAFGYKMDDIRVDVEGLYSQLAKDATAVSDDKAADSVTAFSGLVNVYYDIAIEDMPITPYVGVGVGAAYISNPSKANAVKEQKGLGFAYQAKAGVSYDVTPEIKLFAGARYFGSYGASFNKETVSATKEINVLYSAVG

SEQ ID NO: 19875 - protein, 184 aa, Wolbachia endosymbiont
SYYVRLQYNGEVLPFKTKIDGVTYKSGKDNNSPLKASFLAGGGAFGYKMDDIRVDVEGLYSRLSKDADVVGTSPAVVESLTAFSGLVNVYYDIAIEDMPITPYVGVGVGAACVSNPLVAEVTGDKKFGFGFAYQAKAGVSYDVTPEIKLYAGARYFGSYGANFDQTAKDDGGIKVLYSTVGAEA

SEQ ID NO: 19876 - protein, 196 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISAPLEPAVNDQKSKFGFAGQVKAGVSYDVTPEVKLYAGARYFGSYGANFDGKKTDPKDSTRQVTDAGAYKVLYSTVGAEA

SEQ ID NO: 19877 - protein, 192 aa, Wolbachia endosymbiont
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTVGAEA

SEQ ID NO: 19878 - protein, 186 aa, Wolbachia endosymbiont
SYYVRLQHNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEA

SEQ ID NO: 19879 - protein, 184 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEA

SEQ ID NO: 19880 - protein, 162 aa, Wolbachia endosymbiont
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGA

SEQ ID NO: 19881 - protein, 182 aa, Wolbachia endosymbiont
SYYVRLQYNGEILPLFTKIDGIKNTAGKEKDSPLKASFIAGGGAFGYKMDDIRVDVEGLYSWLNKDADVVGDTVADNLTAISGLVNVYYDVAIEDMPITPYIGVGVGAAYISTPLATAVSSQNGKFAFAGQARAGVSYDVTPEIKLYAGARYFGSYGANFDKTDKDGKEELKVLYSTVGAEA

SEQ ID NO: 19882 - protein, 187 aa, Wolbachia endosymbiont
SYYIRLQYNGEILPLFTKIDGIEYAAGTDSHSPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFDKSGGEDKGGHTVLYSTVGAEA

SEQ ID NO: 19883 - protein, 185 aa, Wolbachia endosymbiont
SYYVRLQYNGEILPFYTKVDGITNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPESKLFAGARYFGSYGASFDKAAKDDTGIKNVVYSTFGAEA

SEQ ID NO: 19884 - protein, 184 aa, Wolbachia endosymbiont
SYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKGKFGFAGQVKAGVSYDVTPEVKLYAGARYFGSYGANFDKSGGEKDKGGHTVLYSTVG

SEQ ID NO: 19885 - protein, 190 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVAFN

SEQ ID NO: 19886 - protein, 185 aa, Wolbachia endosymbiont
SYYVRLQYNGEILPFHTKVDGIKNAKDKEKDSPLTRSFIAAGGAFGYKMDDIRVDVEGLYSQLAKDTAVVDTSETNVADSLTAFSGLVNVYYDIAIEDMPITPYVGVGVGAAYISNPSKADTVKDQKGFGFAYQAKAGVSYDVTPEIKLFAGARYFGSYGASFDKAANDDTGIKNVVYSTVGAEA

SEQ ID NO: 19887 - protein, 185 aa, Wolbachia endosymbiont
SYYVRLQYNGEILPLFTKIDGIKNAAGKEKDSPLKASFIAGGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFDKAAKDDAETKKVLYSTVGAEA

SEQ ID NO: 19888 - protein, 179 aa, Wolbachia endosymbiont
SYYVRLQYNGEILPLFTKIDGIARKTGKDNDSPLKPSFMAGGGAFGYKMDDIRVDVEGLYSWLNKDADVVDDTVADNLTVISGLVNVYYDIAIEDMPITPYIGAGVGAAYISTPLATAVSSQNGKFAFAGQARAGVSYDITPEIKLYAGARYFGSYGANFDKTDKDGKGELKVLYSTVG

SEQ ID NO: 19889 - protein, 161 aa, Wolbachia endosymbiont
SYYVRLQYNGEILPFYTKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGA

SEQ ID NO: 19890 - protein, 180 aa, Wolbachia endosymbiont
SYYVRLQYNGEILPLYTKVDGITHTSGKSPLKASFLAGGGAFGYKMDDIRVDVEGLYSQLAKDATVVSDDKAADSVTAFSGLVNVYYDIAIEDMPITPYVGVGVGAAYISNPSKANEVKDQKGFGFAYQAKAGVSYDVTPEIKLFAGARYFGSYGASFDKANKDDTGIKNVLYSTVGAEA

SEQ ID NO: 19891 - protein, 185 aa, Wolbachia endosymbiont
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKAGKDDTGIKNVVYSTFGAEA

SEQ ID NO: 19892 - protein, 185 aa, Wolbachia endosymbiont
SYYVRLQYNGEILPLFTKVDGITYKKDNSDYSPLKASFIAGGGAFGYKMDDIRVDVEGVYSYLNKNDVTNAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVG

SEQ ID NO: 19893 - protein, 430 aa, Wolbachia endosymbiont
CSSSQSPNWLRPAPFVSDQAEAKGIVEDSTLNLLVPNYYFNRDNKDGGNDQKDWTQGIWGNFSSGYTQGLIGVGVDAFGYLAIKLDGGDGTGGTGNMSRDADGEVNDSQGKAGGAVKFRVSKTELKVSDMQPSTAPVFAFGGSRILPQTASGIQLQSSEIKDLDLEAGHFYSATSQDRNARDGGLFATYAGEEANKIDYFGGKYGFTDNLSASLYGAKLEDIWNQYYANLNYTIPLGGDESLNLDGNIYNTKDTGDAKAGDISNTTYSLAAAFSFMKAHTITLGFQKVNGDTPFDYIGVGKNNRGGDSIFLANSIQYSDFNAPNEKSAQVRYVLKMAEYGVPGLSFMTRYVKGWDIDGTNTPANSAYAGLYGAYGTHFDINVEAKYVVQSGRAKDRSFRIRHAWHFANADEGEGDTKGFRLMLDYPLPQV

SEQ ID NO: 19894 - protein, 188 aa, Wolbachia endosymbiont
  misc_feature (73)..(73): Xaa can be any naturally occurring amino acid
  misc_feature (77)..(77): Xaa can be any naturally occurring amino acid
SYYVRLQYNGEILPLFTKVDGITYKKDNSDYSPLKASFIAGGGAFGYKMDDIRVDVEGVYSYLNKNDVTDAKXTPDXIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 19895 - protein, 186 aa, Wolbachia endosymbiont
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGVAYQAKAGVSYVVTPEIKLYAGARYFGSYGASFNKEAVSATKEINVLYSAVGAEA

SEQ ID NO: 19896 - protein, 185 aa, Wolbachia endosymbiont
SYYVRLQYNGEILPLFTKVDGITYKKDNSDYSPLKASFIAGGGAFGYKMDDIRVDVEGVYSYLNKNDVTNAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAVKDKGELKVLYSTVG

SEQ ID NO: 19897 - protein, 181 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGASFGKTAKDDGVIKVLYSTVG

SEQ ID NO: 19898 - protein, 187 aa, Wolbachia endosymbiont
SYYVRLQYNGEVLPPFTKVDNMKIKKGTDDVDPFKASFIGGGAAFGYKMDDIRVDIEGLYSQLNKNVNNNEVLTPDTVADSLTAISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLYSTVGAEA

SEQ ID NO: 19899 - protein, 188 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYGTVGAEA

SEQ ID NO: 19900 - protein, 185 aa, Wolbachia endosymbiont
SYYVRLQYNGEILPFYTKVDGITNATGKEKDSPLTRSFIAGGGAFGYKMDDIRVDVEGLYSQLAKDTDVVNTSETNVADSLTAFSGLVNVYYDIAIEDMPITPYVGVGVGAAYISNPSKAGVVKDQKGFGFAYQAKAGVSYDVTPEIKLFAGARYFGSYGASFDKAAKDDAGIKNVVYSTVGAEA

SEQ ID NO: 19901 - protein, 984 aa, Moraxella bovis
MKQKSVKWWRYFFLLCLMGISVCMYASGGKRTLNGLVTDVEGVPVIGANILVKGQTTGVISDVEGKFSITVSSPKDVLVISYIGYNTVEMIVGEKTSINVQLTESSNLLNDVVVIGYGSMKKGEITSAITNVKSEDFIQGVVKDATQLLQGKVAGLQMASPSGDPTAGVEINIRGVSTISASSAPLIVIDGIPGGSLNSIAPEDVETIDVLKDGSAAAIYGTRGTNGVIIITTKKAKQGKASLEYHGYVAFESIQKQTDVLTASDYRRLAQDPLFKDNISDEGADVNWIDAITRNPVNHTHNLSLRGGTEKTNYIASITYRKQDGILLNTGKEALTFKIGLNHSMMDDKLKIQLNVNNSTIKQDVTWYNAYLQACLMNPTRPVYNEDGSYKEYGTSYKPYNPVALLNEETDQEKWNQLLASGKITFSPIEGLNLSAMAAMQRYDSMRDKWNTFNYFTTTIENKNAEVTKWAAGSMDRTLELTADYFKTIGKHEFSGLVGYSYQDFERQGSQMYAMDFPTDIFGPWNIGTAQSTKDGKSTISSYKNGNKLISFFGRLTYNYDNKYMLMGSLRREGSSKFGVNHKWGWFPAISAGWRISEESFMKNIGFVDDLKLRVGFGVTGTELSDSYQSLVLLNYSGVGQMNGQWTQGVVPASNPNPDLKWETKSEWNLGIDFSLLSRRLNGTIDLYQRTTSDLLSEYQVPVPPNFISTMWANVGKIRNRGIEVALDGEVIRTKDFTWRLGGNFSYNVNKLLSLSNDKYQRDYWYTGWTSSGIQQTTHIVKEGEPIGNFYGWKAVGLTDDGLWLVEGADGNPKLASEAGQEDKQVIGNGLPSMYAGLNTTLLYKKFDLGISLRGAFGFEVLNEYRMHWETMKRISEGNLPKSVLKKPFGSQSYVFDSHMYHSYYVEKGDYVKLDNVTLGYTLNLNNKYLRSVRLYVTGHNLLTITGYDGLDPEVSIKGLDPGVERKELYPTVRSYTVGAIVKF

SEQ ID NO: 19902 - protein, 647 aa, Acinetobacter baumannii
MALRCHFCDSVKIDTDQPISLRPKTCCGKGTTTTLLAAAFAFAAFAALAPAQTAAESTTSAKPTVLDDVVISASRTPQDVKTTPSSVSVISLPEMERQQITDLRTALQTVPGVVVPQNGGGLGSQSMVSIRGADTDHTLFMVDGIRVNTQDFTAGYSSLLGGVGLGGLDRVEVLRGAQSVLYGSAAIGGVISLQTPRGQGPASGVLSAGGGSFNTFGGSASISGSGDIATGRNGEGPFSYSLNLALVNTENDRDYNDFKQVSFAGRAEYALSDLFTFGVTYRAMTSDYEEPGSILSPWPGYAELENTLATAYADWHPSDVFTSRLTYGWVQNLYSWSDSTGEYPSHSTRNIIDWQNTWQATEWLQLVAGVNAEWSRYTSSGTRMDDDLRSLYANVLMQPVRNLEYTVGFRADDYDTFDTHATWRTGAAYRIEKTNTTLRANYGTGFNAPAPQYVLGGGFYVASPNLNPEESKGWDAGIEQDIWDGRVTLGATYFRNEFTNKFSTQMVGSQYQYYNLPGESTTDGAELSLATRPHESVRARVSYTYLSARDDNGGRLPYSVRHVLSGDVNWQATRVWLIGAGASFLAGRVDNYSSAMDDYVTVRLYTSYELRPGLTLKARIENLFDEGYDSITGYPALPFGAYGSIEW

SEQ ID NO: 19903 - protein, 422 aa, Frateuria sp. ANA-18
MKKEISLIALSLFAALPAIASQQSDSQGFVNDSHLNLFLRNAWINRDYQGGVQDKAEWGQGIVATFESGYTEGLIGFGVDGIAQYGVRLDGGRGRSGAGGIDFFKQDSDGRAKSDLAKFGATAKMRISNTVLSYGNQRPQLPIVYADDSRLLFESFTGTMLTSREIDGLEINAGYFTDEQRKSDDRHNSGLKSLSFGGASYQFNDQFSGALYASHVEDVLNKQYLGLNFKQPFSTGQQLVLDFNGYNSRLDSGYADSLNTGRSNSIWSLAASYIWDIHTFKVAYQQSSGSTGYHYGSYRDQGGVGDGGNTIWLANSYWSDFNGEDERSWQASYGLDFAGLGLPGLSWTTAYVRGDNIKTSATSNGKEHEWFNQVQYQVQDGMAKDLKLKLRYSVLRVSSNASDYNVSGNEIRAYVEYPFNIF

SEQ ID NO: 19904 - protein, 777 aa, Serratia marcescens
MFIEWLISRKIMNKNYISWFKINNSTHLFLSTFNHLSLAGLLVVTSSAFGQSASEEVKQTKQQDDVVQFPALSVVGNLNSSVGAGSSVLKLKDIERTQANNLAELVDQLPGISSSGSPRPGGQTLNIWGMGDVEDVKVTLDDAPKGFEKYRQGSVFIEPELIKRIDVDKGPHNIMDGNGGFGGTVKITTKDPADLLLADQHFGAMFKYSYHTNDRQNIYSSALYGKTLNGVADGLLYVSKRKGDDLRRPDGTRFGFSQADQLSYLLKTNLYLNDEHTLSLSVMRSESDNLVPWAAKRDELATPTQKEIEQYGFDGAIKRKLVQRDQQDQNYSVKWNYIPENSDWINLTTTYAWSKSQQHDTRPENASKYLTSSLGNKSWVDYTDQLFDIHNESLFDTGRLEHQLTIGARWHKNDRGILMFDAGKAKNPKYNYGYYQPQFMPAGVQETTSVYLQDAISWHTLTVTPGLRYDYVQNKGKGNLAATYMEQDPLIGHDYRSVTYSGISPHLGILWKTTPNLTLFGDVSRTWRAPVIDEQYEVQFANSSLTGSSRNLGKERMDGVRLGAILDFDQVIQANDQLQIRTTLFRNRGKDEIFRRRGEYCEAKKNGTGDCGRPLSNYRNLPGYTIEGLEIELFYDSPNVFGKMAYSAIKGERDASPRDPWFGQKTWIGEIPPDTLHVMLGYKLPQWNANFGLTGDFVGHQVRSPADRDPKADSWGYPKSKGYALYGAFAQWQPEFIPDTNIRVTATNLFDRDYYPYLGESVSGVGRDVRLSITKYF

SEQ ID NO: 19905 - protein, 348 aa, Neisseria meningitidis
EGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPESQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAAS

SEQ ID NO: 19906 - protein, 241 aa, Neisseria meningitidis
ASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGSFHASSSLGLSAIYDFKLNDKFDKFKPYIGVRVAYGHVKHQVHSVKKETTTTFLAPTGDAKVPGKIVEGPFSKPAYHESHSISSLGLGVIAGVGFDITPKLTLDTGYRYHNWGRLENTRFKTHEVSLGMRYHF

SEQ ID NO: 19907 - protein, 1285 aa, Escherichia coli
MNKIYSLKYSHITGGLVAVSELTRKVSVGTSRKKVILGIILSSIYGSYGETAFAAMLDINNIWTRDYLDLAQNRGEFRPGATNVQLMMKDGKIFHFPELPVPDFSAVSNKGATTSIGGAYSVTATHNGTQHHAITTQSWDQTAYKASNRVSSGDFSVHRLNKFVVETTGVTESADFSLSPEDAMKRYGVNYNGKEQIIGFRAGAGTTSTILNGKQYLFGQNYNPDLLSASLFNLDWKNKSYIYTNRTPFKNSPIFGDSGSGSYLYDKEQQKWVFHGVTSTVGFLSSTNIAWTNYSLFNNILVNNLKKNFTNTMQLDGKKQELSSIIKDKDLSVSGGGELTLKQDTDLGIGGLIFDKNQTYKVYGKDKSYKGAGIDIDNNTTVEWNVKGVAGDNLHKIGSGTLDVKIAQGNNLKIGNGTVILSAEKAFNKIYMAGGKGTVKINAKDALSESGNGEIYFTRNGGTLDLNGYDQSFQKIAATDAGTTVTNSNVKQSTLSLTNTDAYMYHGNVSGNISINHIINTTQQHNNNANLIFDGSVDIKNDISVRNAQLTLQGHATEHAIFKEGNNNCPIPFLCQKDYSAAIKDQESTVNKRYNTEYKSNNQIASFSQPDWESRKFNFRKLNLENATLSIGRDANVKGHIEAKNSQIVLGNKTAYIDMFSGRNITGEGFGFRQQLRSGDSAGESSFNGSLSAQNSKITVGDKSTVTMTGALSLINTDLIINKGATVTAQGKMYVDKAIELAGTLTLTGTPTENNKYSPAIYMSDGYNMTEDGATLKAQNYAWVNGNIKSDKKASILFGVDQYKEDNLDKTTHTPLATGLLGGFDTSYTGGIDAPAASASMYNTLWRVNGQSALQSLKTRDSLLLFSNIENSGFHTVTVNTLDATNTAVIMRADLSQSVNQSDKLIVKNQLTGSNNSLSVDIQKVGNNNSGLNVDLITAPKGSNKEIFKASTQAIGFSNISPVISTKEDQEHTTWTLTGYKVAENTASSGAAKSYMSGNYKAFLTEVNNLNKRMGDLRDTNGEAGAWARIMSGAGSASSGYSDNYTHVQIGVDKKHELDGLDLFTGLTMTYTDSHASSNAFSGKTKSVGAGLYASAIFDSGAYIDLISKYVHHDNEYSATFAGLGTKDYSSHSLYVGAEAGYRYHVTEDSWIEPQAELVYGAVSGKRFDWQDRGMSVTMKDKDFNPLIGRTGVDVGKSFSGKDWKVTARAGLGYQFDLFANGETVLRDASGEKRIKGEKDGRILMNVGLNAEIRDNLRFGLEFEKSAFGKYNVDNAINANFRYSF

SEQ ID NO: 19908 - protein, 1089 aa, Escherichia coli O157:H7
MILYSIFRYEFLKRMSEMEASIDKLLKLVFLAAPKNINLFKCIKSMKRRITLFKKCIVALLLLFLANLSFAQVRVTGTVTDADDGSGLPGVSVVVNGTAQGTVTDIEGNYTLSVQSEDATLVFSFVGYLTQNVQLNGRSSVDVSLKLDIQQLDEVVVVGYGVQKKKEVTGAVGSIKSEELLKNATPDIGDAMQGQIAGVNVQASSGRPGAKSNIQIRGIGSISPSGLGPLYVVDGVPYQNDPNIAPEQVESIEVLKDGAAAAIYGVRASNGVIIITTKRGKAGEMKVDFSAYKGIQNITSGTPLMNTQQQMYVEEVKTEALGQEPQIFRFTPDALDYNTDFVGDVQNDNAAMQNYNLNVMGGKEELTFSMNANYFQQDGVLINSGFDRFTTRLSGEYKRNNFKAFATVAMTEENTEQEPWALYELAIVQKPWQRGINDLESFGASGVLVPSDNPIQFGYLSRQLNNEDKRKVNNNNIALNLSYEFLPGLSYQVNLGRNSWNYQRKFFRPQYLAYSADGGLQPAGSNMDALLDESYTFTTKNTLENIVKFQRNFGKHDLGATAVLSYENFNSKNVGVGVVGLLSNDTDVLSAGTTGTKPTGTESVQNIIGKMARVQYSYDSRYLFSASIRYDGSSVFGKENRYNPFYGISAGWNLSEEGFFQNIGMLNFVSALKIRGSYAELGNQSIGPYQAVASIESGIDYPYGPEGAEYLGVGAIQRRFANPLIQWETTISRNIGIDMGMLEDRLTLTADFYLNDKKDMLLAERLAPSSGTWQTRAVGVYNVRTINAGNMQNKGVEVALGYRDQTSFGLQWSVNGTFTRNVNRVTDLNGIEGIAFGGGRPITSSGERTDFTTYLSQGYEGGAFFLLEHIGVIKTDEQLAAYREVEPSAMMGDMMYRDQLTVDTDGDGIPDAGDGLINDDDRVYAGSGQPEFEAGLNLNGAYKGFDLFIQMYYSHGAEIYNGAKLYAYGTGRHRDLYYMWSPQNPDSDIPTARTSQQHNNFRARSNYFLEDGTYLRIRNITLGYALPSNLFGGKVDNVRFYITAQNPFTFTKYEGYDPEIGGDGLFTRGVDVGNYPITRKFLGGIQVKF

SEQ ID NO: 19909 - protein, 199 aa, Escherichia coli O157:H7
MRKLCAVILSAVVWLVAAGTPASAAEHQSTLSAGYLQTHTYMPGSDDLKGINVKYRYEFTDTLGLVTSFSYAGYKNRQLTRYSDTRWHKDSVRNRWFSVMAGPSVRVNEWFSAYAMAGMAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 19910 - protein, 191 aa, Escherichia coli O157:H7
  misc_feature (109)..(109): Xaa can be any naturally occurring amino acid
MSTSYDFDFGLSLGAAYSNSDRTDNQVHKGTHNTRYGDRFDATAGGETAEAWTVGAKYDANNVYLAAMYAEPRNMTGYGDADAIANKTQNFEVVAQYQFDFGLRPSIAXLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 19911 - protein, 352 aa, Escherichia coli O157:H7
MKRKVLAMLVPALLVAGAANAAEIYNKDGNKLDLYGKMVGERILTDRENGEKGDNSQDTSYARVGVKGETQINPELTGYGQFELDLEASNRHNPDQTRLAYAGLSYKDFGSFDYGRNVGVAYDAEAFTDMFVEWGGDSWAGTDLFMTNRTNGVATYRNTDFFGMVEGLNFALQYQGKNEGTGNYKANGDGHGLSVTYTIDGFSFTGAYANSDRTDFQSSDSKGEKAEVWALSTKYDPNNVYAAVMYGESHNMNSDDGDVVNKTQNFEAVLQYQFDFGLRPSIGYSYSKALDVAGYKDSDRLNYIEIGTWYYFNKNMNVYTAYQINLLDKSDYVLAHGLNTDDQLAFGIVYQF

SEQ ID NO: 19912 - protein, 255 aa, Escherichia coli O157:H7
  misc_feature (50)..(50): Xaa can be any naturally occurring amino acid
  misc_feature (95)..(95): Xaa can be any naturally occurring amino acid
  misc_feature (99)..(99): Xaa can be any naturally occurring amino acid
  misc_feature (192)..(192): Xaa can be any naturally occurring amino acid
MGWTDMLPEFGGDSYTNADNFMTGRANGVATYRNTDFFGLVNGLNFAVQXZGNNEGASNGQEGTNNGRDVRHENGDGWGLSTTYDLGMGFSAGAXYTSXDRTNDQVNHTAAGGDKADAWTAGLKYDANNIYLATMYSETRNMTPFGDSDYAVANKTQNFEVTAQYQFDFGLRPAVSFLMSKGRDLHAAGGAXNPAGVDDKDLVKYADVGATYYFNKNMSTYVDYKINLLDEDDSFYAANGISTDDIVALGLVYQF

SEQ ID NO: 19913 - protein, 549 aa, Escherichia coli O157:H7
MGIDRARFRGFVWPKNTDYLYFLDVRISMVSVSCNSLWRPSLLLGSVFFAVPAFAQIDPSGLPLTDMSKNHPDPAMAQLTSVSQLADVPPTGWAFEALRSLVERYGCIVGYPDRTYRGDRALTRWEFAAGLNACLNSIERSLQAGVSIAQGDLDTLKRLAQEFQAELGALGARVDNLENQAAFLEDHSFSTTTKLLGEAIFVVANAFQGAREGSNTVFQDRVRLRFVSSFTGKDQLNVRLDAGNARRFNLGDGTPEATQSFNLVPSLDNNVNIGWLAYYFPIGERISAYIAAVNGVTYDFIPTLNPYLDSGTGGGKALTVFASANPIYQIGGGAGGGFNYQLSDRWIASLGYLAGDHAAPNPGSGLFNGQYAAIAQIAWLDSRSGFGITYVHAYQNRGDLFDIGSSFGIVGTRQANNPFGTPLISDSFGASGFFTITPNLAINGFLGYTNSRNLQGHGNADIWYYSLGFAFPDVGKDGNLGGLVVGVQPYQANNPTDAKDLPIHVEAFYKYQINDNIAITPGLFWLINPGQNSNNTSVIIGTLRTTFTF

SEQ ID NO: 19914 - protein, 468 aa, Escherichia coli O157:H7
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 19915 - protein, 2637 aa, Escherichia coli O157:H7
MNKIYKVIWNHTTQKWDVVSELTSCRKKCKSTRLGIALSAMVLGGAIAINCNNAMADVILSPDWRPGTNNSGVGAATVSGKTEYITGPNVVQSGGSGLIWMTVEQAILNGYTTGDNLSGLIYVNTGEKTKTITVKDEVTGAYQTLQVFDTDSFSQRDAGTGGNETIPGFSGTADFFNATRFVTANNGGTAILDVGSPAIGNFFKNTQLAVADGEGSSVVWNSVNDFYFQPGATMQGGGVTQKIIDSMKYAGTITDWAGKVHHINSLDDLKQYNQYLIKSLEDKTLSYKQYDAEFNKALIVTKHNYNVDMTAGGRIDSTPYKENVGLLAVLHATNNARAILGKTGKLTGVLPAYGNGGGIVATNGGTGVNEGVIDAIGTEMIAYQDSTIVNDGTLFVWDNNDKYALQAEGMVAGSNGSSAINNGVINIRPFKNAFAPEGINTAIVVSNGGMATNKGTINITADASTNDNNGKTRGVNVGAGGSFINSAFGSINVGIAEDKTATHSAVGSVAIEVQNGANKVVNEGTIFLGRGAQGNYGILAKDAGSVDVVNKGTITIDGYDSDAPALNVGMLANNSSGMKNSGIINVNGLNSTGLQVINAGQLNSDGTINVGGEGISSGFRNYGAWVEGARSNVNVSGKINLSGTGAVGVFAKDGGSLTLSGNGAVLFGSSDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFASDGSGITDQIAFRIIGDGATIKTNIAPGTLLDASGERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLINSGNIDFTTGTDNIGVWVDNGRFENTGSRIAVNGVALFVEGEHAQITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDSGGLVINLKGTGGTGIFANTKDGAVVKSGASVNVTQADGGSALVVNNAASEVVQSGNLISASLSHAVVDASKAQSFTNKGQIKAASATGTAMAFDDAVNTTVLNDSGAEIQGVVALNGGDNTFTNKGSITGTVSAKEGNNTFLFDDGSILTGEVAAGNGNNNVTLNGKAHVDKVTAGTGKNTFTIKGEGATWNLLDGGQGDSDSLIFDNAIHTLDSAVKLRNFEHVGLKNSSLVTLKEALVLTDGGTGPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDGVKGDGLYIGYGLKSLDLQGTGDKALVLTPRANAQGLQTDLGAQLTGAGDLAIEAAGQVVTLSNGGNNYTGDTLVRSGTLQMANDNVLGATGSLNVASNAVFRTDGYSQTVGALQTETGAHIQLDSGSVLTVSGTQRQPGDDNGGIIENNVLTGDGTLAVTGSNLTVHGTNIGFTGNVSLTRGSLVEMNGAQGLGSQGSISFESLNDRLAIDIADGSGVSSNLSKSLSGKGSVGILNTTDLTLSGDNRNFSGEFRVQKDAALRASDEKHLGTGLIDSDGVTWLTASGNWLLKNDITGSGALVKQGAGNLIINHELTYTGDTTVENGVLIVGDDSVTRAAGATLSGSKNIHVLNGGTLSGLGTVSGQVNNQGTLASLNALSGYETAEAGNFTVGSLTNTGVIRLAGGKTGNTLTVNGDYTGGGTLIINTVLGDDTSATDKLIVTGNTSGDTGVVVNNVRGQGAQTADGIEIVHVGGQSDGNFRLQNRAVAGAWEYFLHKGNAGGTDGNWYLRSELPPEPQPQPQPQPQPQPHPTPDKPVQKVYRPEAGSYIANIAAANTLFNIRMHDREGETYYTDVFTGEKKATSMWMRHIGGHNRWKDSSSQLNTQSNRYVVQLGGSIAQWTDGQDRLQLGIMAGYGNEKSSTTSSLSGYKSKGAINGYSTGLYGTWQQNDGNDNGAYVDTWIQYGWFNNTVNGEKLAAESWKSRGFTGSVEAGYTFKAGEFTGSQGSHYDWYIQPQSQITWMNVRASEHTEKNGTKVQLSGDGNIQSRLGVRTYLKGKSASDDNKAHQFEPFVEVNWIHNTRSWGVKMDNTALSQDGATNIAEVKTGVQGKLSDNLNVWGNVGVQAGDKGYSDAQAMLGIKYIF

SEQ ID NO: 19916 - protein, 406 aa, Escherichia coli O157:H7
MPVVFYVAGILPAVRIMTGKSIKENIMTIKKTALAASIGAAVALTSFASQAEITVLKQDPQAGNPLSRLNFTVGGSIRPQFQNMAGDDGKNGYKRNGFDGGTRFRFAADYYLFDDISWVSYYELGVNFPAMFNWDNHYADGANDTTRRMLYTGLKSDTWGTLTFGQQNSVYYDVVGVKTDIWDYDMIGQAPGNGINGDYDGSYRTRKSLKYKKTVGDVDLYASYLFSDDYNPNNGLRYKRKGGGSLGADYHITDDLTWGTAWNYTRAEMRPGNGGDGKDYDQNIVGTALSWTPDNWTFALGGGWYQNFMTTKRVDAHDYFAGDAWGIEYFAGYKFPINQYAVKSIQPYFMGDRIEYVNGRNYQRIDNGVGISFQLDYGFRVDYEHVFTSSTDDLGDMNLVRLRYDF

SEQ ID NO: 19917 - protein, 735 aa, Gamma-proteobacterium EBAC31A08
MNKFFNACIVMTASSMFSLSILAQDVEEIVVTSALIDSTEITNPLYVINGDEIVNDATTSLGDAIDGYLGISMADYGAAVGQPIIRGMSGPRVKILKNGMVNRDVSGLGVDHLNDVDLNDIQQIEIVKGPSSLLYANGTIGGIINVVDDCIAAMNFEIPEVKIGYETQSVNDGSSEFVNLKRNINGFNINFGYKNSEFGNYDIPNGAILHEEEHEDEHGDEHEEDLGYVNNSDFAVEATKFGISKVGDWGYVGLSLDSLKSVYGIPFHGDEHEEEHDDDHGDEHADEEEHEEERIFSTTDSESFTIKGSYNVNGDLVKKIDYTYRDSDYTLTEAHAEEEGHEEHEDEEEHEEHAPTNFINNATEYGAIFDMSNDVMTQKFSFNYVDENTSIFGEEAFMNPANNEVLTLGYFVGRDFDPFHLDFGMRLDQIDRSGTVTDEDHGDIDSYNVNENTNSFAISIGRDLTDNLDINLGFSSVERMPSVIELFMNGPHLATGRFEVGDPTLSSETSNNIDISFNFDNGEYFGYASFFINDVDNYITLMDEDDDHEMHGDEHHEDEDEDEHHEDEDEHHEDEDDHGHGNLIHANYIQEDAEFDGYEIEFGRTIDLGKGQLKLSFGRDVVNAKFSDGHNVPRINPSRNVYSLSYAQEDVVFKLDLKDVAKQNDFGEGESATDAYQMLDTRITKTFNLNGSSNLKVTLFGKNLLDEVARNHSSFVKNEVPLPGRNYGIKFNLTY

SEQ ID NO: 19918 - protein, 869 aa, Gamma-proteobacterium EBAC31A08
MKIKIGLIFLILISSFTYLYAEVEELVVTGTLLENTEQDSSPVDIITDEDYKNFNISNIAEISKYLSSSSGSHFQSNTLDGVDQGMNAITLRGLDQASTLLLINSKRQTFAGTPSNEGEGYIDANIIPEIALKRIEVLKEGATSLYGSDAVAGVINIITHKNFSGLKVQAGHRKTSNFNQTDSSLGLLFGSSYKKTSYVLGINLLKRTPLSAIEIPRIAELAISGLGRSFKVSDAVSLPAGIWAGDYSKNQKIPDPNCINNGGVLTNSTTCGFAYGNRFNIVNDENQMKFYINLAYQADSFDYGINFISSNTNVNDNPQSPSYPALPFLSRMIQPGEGGNPFDVAVKWFGRPLGSDYASPNSPKDIDQYHFSQTINTSIGKDIGLEVSYTLSEHSNKHLRPDIIDSRFLDSINGTDMGISGGEIVFWNLFDSSQNSEALINYVRGSEKSVKKANLESLDLILRSNAWSGYSVAYGVQLNKEALNVSYDEISRAEFDTNGKIIKTADLFFLGGGIDVSKSRNKYASFFEIEKDFINNFGVRIAGRYEDFGNDSSFDPKLSVKYIASDNLTIRASKSSSFSMPSMAQMFASDINLGSVRDFNGTSPFVRQAQIGNPSLKPATSINNNLGFIFNKENQRLRVDFWDIDYENRIEVQSAQAMLISNPNGLSITRNTEGDLIGITTTYFNEANTEVSGVDLSYEALMNLEKNGVISFAIKGTSINKFLTPNNKINDGEEEHHNKMINRVGKYNYDANTHSLPKKRINIFINWDYLNYDIGLNVRHIDGYKNSRPISGLGLEYGYKNKVESFLVFDLSASKLISTKNGTMDIKFSITNIFDESAPRLYDAPDFSFDTRVHDPRGRIIGLFLEYKH

SEQ ID NO: 19919 - protein, 378 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAA

SEQ ID NO: 19920 - protein, 346 aa, Neisseria meningitidis
IKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTDGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYT

SEQ ID NO: 19921 - protein, 235 aa, Neisseria meningitidis
ASEDGSRSPYYVQADLAYAAERITHDYPQATGANNTSTVSDYFRNIRAHSIHPRVSVGYDFGGWRIAADYASYRKWKESNSSTKKVTEEINNNYKETQTKHQGNGSFHAVSSLGLSAIYDFKLNDKFKPYIGARVAYGHVKHQVHSVETKTTTITSKPKNGSPQGGPIIQTDPSKPPYHESHSISSVGLGVIAGVGFDITPKLTLDTGYRYHNWGRLENTRFKTHEVSLGMRYRF

SEQ ID NO: 19922 - protein, 195 aa, Wolbachia sp. wMel
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAE

SEQ ID NO: 19923 - protein, 242 aa, Neisseria meningitidis
AAQAASEDNGRSPYYVQADLAYAAERITHDYPQATGANNTSTVSDYFRNIRAHSIHPRVSVGYDFGDWRIAADYASYRKWNNNKYSVNTKEVLRHSNGNWQELKTENQENGSFHATSSLGLSAIYDFKLNDKFDKFKPYIGARVAYGHVKHQVHSVRKETTTVFSKSQGSTAPGKIPSSVTKPAYHESHSISSLGFGVIAGVGFDITPKLTLDTGYRYHNWGRLENTRFKTHEVSLGVRYRF

SEQ ID NO: 19924 - protein, 535 aa, Agrobacterium tumefaciens
MIRFVSRVLHAGLTSRSAILVGSCIVSQSLWAAPPSAVDDSRTMASDSRLTINVMANDFDSDGDAIRLVSVGSPDNGSTAANADGSVRYIPNSGFIGTDTFTYVIEDDAEPATRSTATVTVTVVDSSVTPLAEGDNDRKVAQVFESACGSLNSQTDDEISVGGSLLLARCEGLSQLGINNPELVAEALNKIAPEETSSQMRNSASSSRSQSSAVSQRQKLLQNGATGFSLNGVAWNGAASGGAAGEESSPWSRVGVFANIQREGGEYDKTGLESGYDYSGVVLTLGADYALRRDLFVGGAFGWTHTGVDYANQGGELDTDIYTFLGYASYFVGDFSFDVQMGYGATRFDSKRHIAYTDPTGDVDVTAVGDTSGDQFLFNTRAEWQWSHNALTLSPYVRLDYLNSNIDGYGENGAGGLNMTLSEQRIDQLTLAAGVQGTYAISRDWGVLIPSFQLSALSEIHSDRDAVTGRFSYDPDPNNHFDLQADSEESLFYQAGVGATAVLPHGLSVFLEYQQIFGYEHLTAYQVQTGVRYEL

SEQ ID NO: 19925 - protein, 771 aa, Agrobacterium tumefaciens
MRLQFRGLKALALGATALTALSVHPAFAQDAASAPADNSIEEIVVTALKRSTTIQTTPISISAVTEKSLQSLGASGIQDYFRTVPNLQVEGNSPTNRRLTLRGVRSAGEATVGLYYDETPLTGPAGTTADASSTSADVNLFDVERVEVLRGPQGTLYGSGSMGGTLRVIMNKPDSHQYTGAVEAQGTATKDGGPGYSVKGMVNVPLIQDKLAARLVLYEAEQGGYVDDLLLNKKDINDQHSTGGRLMLGFTPTDNLTLTATGVFQKTTLDGQNSWYPALGSKDYSTNARVIAPTDDNLRMYNVTAKWDLGFATLTGTSSYYKWTLLRNSDYSPTLSASRANATSCRNYIAGGAPASGTTNPACTTTQMAQYTAYADSRVPGALYQPMGLTSWNHELRANGALFDNKVDWTAGVYYEDRSDYIESQVAKADATTGVINPSDLTAWRHVGTDTKQTAFFGEITYKPIEKLSLTFGARRFDYDKTVSGQVLISNFITQSYVGPAAQVDASASGWVSKFNVSYQVTSDIMVYGLAAKGFRPGGANNIPGLTSALLAYGPDSLWNYEAGVKSQWFDHRLTLNAAAYQIDWSNMQISATSANGAFSYLTNAGAARIKGVELEAVARPMRGLTLNATAAFVDAKLTEDQANSTILITGSTGLRGDEFPNVADFSGSAAVEYSWPLTDALNGLLRADYAYVGESASQFRPTYTYYEKQGDYGYANLRGGVEGADWGAYLFVNNVGNEVGLMSVTSALNNKQQAVSINPRTVGVSVRKRF

SEQ ID NO: 19926 - protein, 1043 aa, Agrobacterium tumefaciens
MECINIKKLITFCLLLISISVFAQKKIEVTGIVTDENKEPLIGVNVTVKDQAGLGAITDINGRYKINVEEYSRLLFSYIGFDKQEVLIKQQRIVNITMKEANAREIDEVVITGTGVQKKLTVTGAVTTVNVDDLKSNPSANLSNALAGNVAGILAMQTSGQPGVNTSEFWIRGISTFGANNSALVLVDGFERSLDEMNIEDIESFTVLKDASTTAIYGPRGANGVILITSKHGKAGKININAKVETSYNTRTITPEFADGYTYARMMNESRITRNKEPIYQDDELELLRLGLDPDLYPNVDWKDVLLKDGAMTYRANVNMNGGGATARYFVSLSYISEGGMYKTDDAMREDYNSNPSSQRWNYRLNTDIDITKSTLLKVGVSGSLKKRNAPGQGENVWKSLMNQNPISVPLMYSNGYIPAFGKEDDRSNPWVLATQTGYKEFWNNKVQTNISLEQKLDFITKGLRFEGRFGFDINNDNEINHKKMPETWRAQRFRNSAGEIVYDRQREEQKMEQTSKSSGNRREFLEAFLQYNRGFKEHHVGATLKYSQDAYKTTVDVGTDVKNSIAKRHMGIAGRASYNWNYRYFVDFNFGYNGSENFADGHRFGFFPAFSVAWNIAEEKLIKDHLKWMNMFKLRYSYGKVGNDQLGTRFPYLYTISGKYTEKVDDKDVEKIFPGWNWGDYGYDKKFDGMTYSMLASENVTWEIATKHDFGVDLSLFNDKLTATVDYFHEQRDGIYMERKFLPGMVGIVRSNPKANVGSVLSEGFDGHFAYKQKLGKVNLTIRGNMTYSKNEILERDETNTVYPYQLEKGYRVNQAKGLIALGLFKDYDDIRNSPKQQFGKVQPGDIKYKDVNGDGVINDGDKAAIGATTKPNLIYGFGISAQWRGLDFNVHFQGAGKSSFFIEGSTVYAFKDNQWGNVLENLVENRWVDAETAARFGIPANENPNASYPRLSFGGNDNNFRKSTFWLRDGSYLRLKTLEVGYTLPKTVVNKLKFNKIRVFFIGTNLLTFAKFKEWDPELGSSTGTEYPLSKVFSLGLSVNI

SEQ ID NO: 19927 - protein, 342 aa, Agrobacterium tumefaciens
MKNAKYIYLGAVLICSTQTLAEPLDFYGRLWLGVANSSNGLSGNEKVDGFSLENYASYLGVKGEYAAYDNFSLLYKFEAGIESFDNDDSNIFKPRNAYLGFKTNYGSAVFGRNDTVFKSAEGKVDLFNITSSDMNMIIAGNDRLGDSVTLNSAKVVGVTMGISYVFDKDFNQKNPELSDKQNNYAVSFTVGDASLKNKNHYVSIAYADGLNLLEATRLVGGLSVASIKFGAMYQHSESSLYDNIKGNSYLLSMSVPIDKYDIKLQYLKDDAGLGKITKNAGADLKTLKESDASQYSLGVDFKAQKDLTFGVGISYFDGDYTDAKGHTEFDDTLIFVSTRYLF

SEQ ID NO: 19928 - protein, 747 aa, Agrobacterium tumefaciens
MELKITIMKTFPLSSIALVCRQALVNPKLLLCSAMLASVPHAVADTVDADGKTKKHQKEIEIINVIGAKDLHDNRYKTQAMNTATGLDLSYLETPQSVTSITRQMMNDQQLNSVIDAMTSVAGINARPMDNDRYSISARGIAVTSILYDGVPTTYDTRFNYGDNLIDTAIYERVEVVRGATGLMTGAGNPSAAINLIRKRPTQEFMGSTSVSVGSWNNVRGMVDVSSGLNDSGSVRGRVVAAYQDKDSFQDRYEQQRTTLYGIVETDIGDSTLFTLGVDYQDATPSGTMSGGLPLFYSDGSRTNYDRATSTAPDWGSAHTQGLNTFASLEHRFDNGWNLKATYTYGDNSLEFDVLWATGYPDPVTNIGATAGSIAYVDGSRTQHNVDLRAEGQFQLFGQEHQLMFGWNGQRQEFANPYYYPTAAVPPLGDFRDPNFQYPKPQWKEAYTIGSFGETKQSAAYVATQLNLSDALAVLVGLRLNEWETDQDNFKSLYNFNINNELTTYFGLTYALTEQYSIYASYTDIFAPQTKQRIDKSYLDPVKGKNYEGGIKASLFDEALDMSLSVFEIRQDNLGISTGDVIPGTTTQVYEGVNGTKTQGFEFESTGKITDDWNVYLGYTQFTTEDPKGKRINTTSPRQQLKLFTTYTFGGDWHKLQIGAGVNWQSRVYQEADKPVGNGIDKIRVEVEQGSYALASLMASYAFTEQLKLSANLHNALDKTYYSQVGQYSQFQYGTPRSASLTLDYRF

SEQ ID NO: 19929 - protein, 773 aa, Agrobacterium tumefaciens
MQGKNTIVTTGDYSIGLLSQTSGNLNTDTIIRVNSDGSVTPSFSDGDDTFIVTAGNHAVGVLACASPGSARACVSSLDEESTTDTGSNENNAIAKLDMAKGEITTHGTESYAAYANGTVVKAGDTLDYTNASVTLTDVDITTHGDNAHAIAARQGTVSFNQGEIYTTGPDAATAKIYNGGTVTLKNTSAVAHQGSGIVLESSINGQEATVDILSGSSLRSANEILYHKNETSNVTITDSEVSSAADVFINNIKGHLTVDATNSKITGSANISTDVNTHTYLSLSDNSTWDIKADSTVSNLTVDNSTVYISRADGRDVEPTRLTITENYVGNNGVLHLRTELGDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRLEAGSYVANLAAANTLFVMRLNDRAGEMRYIDPVTEQERSSRLWLRQIGGHNAWRDSNGQLRTTSHRYVSQLGAELLTGGFTDSDSWRLGVMAGYARDYNSTHSSVSDYRSKGSVRGYCAGLYAIWFADDISKKGAYIDAWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGASNLGEIKLGVNGNLNPAASVWGNVGVQLGDNGYNDTAVMVGLKYKF

SEQ ID NO: 19930 - protein, 341 aa, Agrobacterium tumefaciens
MSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFGIVDGLDLTLQYQGKNEDRDVKKQNGDGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAIGLTYQF

SEQ ID NO: 19931 - protein, 183 aa, Agrobacterium tumefaciens
MKTLIVSTVLAFITFSAQAAAFQVTSNEIKTGEQLTTSHVFSGFGCEGGNTSPSLTWSGVPEGTKSFAVTVYDPDAPTGSGWWHWTVVNIPATVTYLPVDAGRRDGTKLPTGAVQGRNDFGYAGFGGACPPKGDKPHHYQFKVWALKTEKIPVDSNSSGALVGYMLNANKIATAEITPVYEIK

SEQ ID NO: 19932 - protein, 692 aa, Agrobacterium tumefaciens
MAKSTVSTILTKKKLRNLPAACLLAATLSASPQVLATSLIEIPNNSGQNIYVTFNTSGILGGAIYIGYIGGDVHAAIWNTTTGEMLNLGTLGGVAMVHATNTSGDVVVGDSGVLGANGYHVIRGFRWTQAKGQLEDLGTLGGTYSSARAINAVGDVVVGLSDMPLNANNRIFSHAFRWTEASGKMEDLGTLGGLQSVAHGVNAIGDVVVGESDIPEDANGNEAQHAFRWTQAKGKMEDLHSPINGDWLGYNSSAHAVNAAGDVVVGVVRSSDLSIGHAFRWTEAKGKMESLGTLGGNSFAVAVNAKGDVVVGQAMLANGDPRAFRWTETSGMQSVEDWLAAHGVIVKGANTNFATGVNDRGDVVTGLLQNGSGFLARVTGMIDVSEFKLGLYRVANSALLAVNDAGLVMHGAHGNPMRSLLPVGRSSFWAAGDVGRQDHGVYNSKQGVAEIGYGYRPTQAMQLNIALGHTYSSADTGFGGNTTARSTYVFPELILSVPDSSTKATLSTYYGQGDLRIDRAYLNAGNLTHAYGKPDTETLGARARLDWVDAITIGKTSLTPYTSLTYMETRLDGYTEQGNGFPVQWNKRTEHATTARIGFDATHPVSNTVTVLGRLEATHRFENRGTTASGLILGPGGFPYAFKGQDLNRTWLRTGLGLEAKVGNGIASAMLNATTQGEMPTYWLAANYRWMF

SEQ ID NO: 19933 - protein, 477 aa, Agrobacterium tumefaciens
MRFSRFIIGLTSCIAFSVQAANVDEYITQLPAGANLALMVQKVGASAPAIDYHSQQMALPASTQKVITALAALIQLGPDFRFTTTLETKGNVENGVLKGDLVARFGADPTLKRQDIRNMVATLKKSGVNQIDGNVLIDTSIFASHDKAPGWPWNDMTQCFSAPPAAAIVDRNCFSVSLYSAPKPGDMAFIRVASYYPVTMFSQVRTLPRGSAEAQYCELDVVPGDLNRFTLTGCLPQRSEPLPLAFAVQDGASYAGAILKDELKQAGITWSGTLLRQTQVNEPGTVVASKQSAPLHDLLKIMLKKSDNMIADTVFRMIGHARFNVPGTWRAGSDAVRQILRQQAGVDIGNTIIADGSGLSRHNLIAPATMMQVLQYIAQHDNELNFISMLPLAGYDGSLQYRAGLHQAGVDGKVSAKTGSLQGVYNLAGFITTASGQRMAFVQYLSGYAVEPADQRNRRIPLVRFESRLYKDIYQNN

SEQ ID NO: 19934 - protein, 185 aa, Agrobacterium tumefaciens
MRIFTMLFMGLLSCNVAAESPHIFGGSVGYGFQDLDKSESHSSSGGDNFVADIYYRYMWHSNFGIEAGYFAGSGGVASIFTGIISSVTDIEYSGYRATLYGEYRLSASNRLYAKVGASANELSYDVGRWGSDEVSHIETNGTDIYAAVGWGLRFNSGIGINIEYQYVPVQTLEVQNLNIGMSYRF

SEQ ID NO: 19935 - protein, 785 aa, Agrobacterium tumefaciens
MRSNSVKNFRFWLTTEIATCCLLALAPAQAETVSQSNTLDGDLRTAIAGDSSRDWLQFEKSLEQSLKQKEEIDSWKPSLELMQAKSLVKPGQKLTNIELLVQELEALSDPLALNFPEPNQTSVAQMAPPSRPMPPPPAGSGQVMFPNPEIIIQQQGGVPQRGASPQVGNPSILSPAVPVAPVRSRAVPPPVGDLAISNINASFDMIDLGQRGQVNVPSLVLREAPAREVLAVLTRYAGMNLIFTDNQNNEGTPTPGTPPGGQVAPPQAQSTITLDIQNESVQDVFNYVLMASGLKASRRGNTIFAGANLLPSARNIITRTIRLNQASAESVASTLASQGAEVNILFEGQEDVQLAENAPPRVIKQPPTLVPLTVQKPANDSSVLILEGLVVSTDPRLNTVTLVGEPRNVELASSMITQMDARRRQVAVNVKIIDINLNNIQDYDSSFSFGIGDSFFVQDSGSAVMRFGDTAPVQEIDINNNLGRITNPPAIVNPFQDGEIFFDLNRITNIEVPLGPGTIPINFFTSGSGAVSNNPLFNGVTEFPIVEVDEQGLLTITQPEFGLPSFYQYPKKFQAQIDAQIRSGNAKILTDPTLIVQEGEAAQVKLTESVIASVDTQVDTQGDTAVRTITPVLEDVGLTLNVIVDRIDDNGFITLRVNPIVASPAGTQVFDSGAGAINEITLINKRELTSGVVRLRDDQTFILSGIISELQRSTTSKVPILGDLPVIGALFRQSTDTTDRSEVIILMTPKIIHDSTEAQFGFRYNPDAATAEFLRQKGFPVQAQP

SEQ ID NO: 19936 - protein, 772 aa, Agrobacterium tumefaciens
MKNLFSIFIISILESVFWNANAQTGNISGSITDNGSALAFATVQLKSKTINFGGITEENGNYAFIDVPFGEYTFRVSAIGYKTVFKKIDFKSEKLKININLETDILNLEQVVVTGTRTDKRRVDSPVIVNLINSETLDKVVATNLSEGLRFQPGLRVETDCQTCNYTQLRMNGLQGGYSQILINGRPIFSPLTGLYGLEQIPVNMIERIEVVRGGVSALYGSSAIGGTVNVLTKIPKKNDYNISYSYQNTKGSSDNIILGNATIVNEEGNAGATLFVNNRSREAYDDNDDNFSELPLLRNNSFGANMFFLPSENEKLDASFSSLNEYRYGGELIDNAAHTAQQAEERTHNVLMGNLDYQLNFNENQNSLIFYYGWQNTKRDHYTGIQPDNPEELTAFLANAPYGTSNVTTHQGGTQYNHRFNEFLNGSLVLTSGLEYVYDDVLDVISAYNYKIDQTTRNFAGFLQNDWDITPKLNFLSGFRIDKHNFVDNAVVSPRLSLLYKPNNTTQYRIGWGTGFRAPQAFDTDLHIAFAAGGISRISLSNDLKEERSNSLTTSINFDKATEHFIAGFTLEGFYTKLNDAFYLEPIGSDTFGERFEKRNGSGATVKGFTFEARSNFDYILSLDAGFTYQSSTYDKAVENIEGLPLKKEFLRTPNVYGFANLNYTPTKSFSASANVVHTGSMDLVHFGGVNTGQTIDVYTKTQTFTNISLRIGYTFKMKKVSSGIELFGGVKNITNAYQNDFDLGKNRDSNYIYGPNSPRTIFTGVRLKSL

SEQ ID NO: 19937 - protein, 445 aa, Agrobacterium tumefaciens
MRHRARLRASMRAARRRLAAPRDYSPAVRPRAAEHSYNNGPEPGDITIMNKQLIAAPLLLSLAGLASAQSSVTLYGIVDAGVTYRSNERVGTAGAYTGHSSVGLTTGNLSGSRWGIKGSEDLGGGLRALFVLENGFDITNGTSGQGGRQFGRQAFVGVGSDRYGSITLGRQYTSLDDFVSPVGPSSFIGGFGAHPGDIDDLDQTARVDSSIKYTSANYAGFTFGALYGFGGQPGSMKQRNTWSVGAAYAAGPLRVGVGYERSDNSKTGATDTTLGKWQSTDDGLFNSSINEGYASAQSQQIIATGATYDFGPAVVGVNYSNVQYRSGDRSLFSGHATFNVAGVFARWNVRPQTQLFAGYSYTRGSDVDGIDDRAQYHNVTLGAVYDLSKRTSVYLLGAYQHASGMTLDALGRPVAATASVSDKANGHSSDTQSQAIVSLGLRQRF

SEQ ID NO: 19938 - protein, 743 aa, Agrobacterium tumefaciens
MTVNRTTASPARRRRAKVGVGVGLGITLFAAQAAAAQGDAPAPEADAAASATLPAIAVSGERGGAFRAREASVAGLDDAPLRDTPASVSVVTRAQLDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTTGVDSRGSTSAAVDLGRRFGPGRQFGFRINAAKENMHSYIDGTNGRRTFGSIAADWDISPRASLQFNAEFQQWIQRSAPGYQLLGGTVVPSVNTTSKALGTQPWAKPVTTDALNLNARFDYRFNDDWNAYIAAGRSRTMIDDNSAFAYGCYYAPSCAAGPTSPFFFGANGDYDVYDFRSPGEYRRNDDLRAVTTGKFATGSLRHELTLGVSVQRRVVHMANAVYDYVGSENIYGPDVAFAPSPNTAGPSYPQLDSWQYGVFGLDRISIGEHWQVLAGGKEVLLRQRSWSSLDGDATHTDRSVFLPQVALVYKPVNVLSLYASYSKALSLGDQAPVRATNAYAFLPPVESHQFELGAKYDWLDRLSLTAAVFSISKPFQFADPDASGTSYTFVQRGTQRHQGIELGAAGRLTERLSLTASVAAIRARAYDSGSPAYEGHQIINVPALRASLYADYAVPGVAGLNMLGGVEYSGGRNANEEGTARVPSWFVFNLGARYTTKIGGHRAVLRVSVDNLFNKFYWRDAGEQQGDAYLFPGAPRTARVSLTYDF

SEQ ID NO: 19939 - protein, 708 aa, Agrobacterium tumefaciens
MGQFMSVFRINMTAATVLAALSSSVFAAQTEGLETVHIKGQRSYNAIATEKNGDYSSFAATVGTKIPASLREIPQSVSIITNQQVKDRNVDTFDQLARKTPGLRVLSNDDGRSSVYARGYEYSEYNIDGLPAQMQSINGTLPNLFAFDRVEVMRGPSGLFDSSGEMGGIVNLVRKRPTKAFQGHAAAGFGTHKQYKAEADVSGSLNSDGSVRGRVMAQTVGASPRPAEKNNRRETFYAAADWDINPDTVLGAGYLYQQRRLAPYNGLPADANNKLPSLPQHVFVGADWNKFKMHSHDVFADLKHYFGNGGYGKVGMRYSDRKADSNYTFAGSKLNNTGQADVAGLGTDIKQKAFAVDASYSRPFALGNTANEFVIGADYNRLRSTNEQGRSTLSKSVALDGFRALPYNGILQNARAGNKGFNHSVTEENLDETGLYAKTVFRPLEGLSLIAGGRVGHHKIESGDGKTLHKASKTKFTSYAGAVYDIDGSNSLYASASQLYTPQTSIGTDGKLLKPREGNQFEIGYKGSYMDDRLNTRVSFYRMKDKNAAAPLDSNNKKTRYAALGKRVMEGVETEISGAMTPKWQIHAGYSYLHSQIKTASNSRDEGIFLLMPKHSANLWTTYQVTSGLTIGGGVNAMSGITSSAGIHAGGYATFDAMAAYRFTPKLKLQINADNIFNRHYYARVGSESTFNIPGSERSLTANLRYSF

SEQ ID NO: 19940 - protein, 199 aa, Escherichia coli O157:H7
MRKLCAVILSAVVWQVAAATPASAAEHQSTLSAGYLHASTNVPGSDDLNGINVKYRYEFMDALGLITSFSYANAEDEQKTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 19941 - protein, 174 aa, Neisseria meningitidis serogroup B
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSIGLGVLAGVSYAVTPNVDLDAGYRYNYIGKVNTVKNVRSGELSAGVRVKF

SEQ ID NO: 19942 - protein, 703 aa, Neisseria meningitidis serogroup B
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADAYGIFVQNIFSATPDLKFVLGGRYDKYTFNSENKLTGSSRQYSGHSFSPNIGAVWNINPVHTLYASYNKGFAPYGGRGGYLSINTSSSAVFNADPEYTRQYETGVKSSWLDDRLSTTLSAYQIERFNIRYRPDEQNDPYTWAVGGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNITFAAANLLNQKYWRSDAMPGAPRTYTARVNYSF

SEQ ID NO: 19943 - protein, 269 aa, Pseudomonas putida
GERGLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIWL

SEQ ID NO: 19944 - protein, 1716 aa, Pseudomonas putida
AEAALVPSFTQAQHDLGIKYKETDLSSFLDNTRHKARRARAEILLYIERVKQQDFDTKKQEYINQGVVPTDIEAATNLGISYDPSKIDNNVEHDQKVRRAEKDKQAVIELYVSSINRGIKYKHYVDNDIIPEMQEVRTALNMNKDDAQSFVASIRTEIMENAKGQYIADSHIPTEKELKKKFGISRDDNRDGYIKSIRLKVMENAKGQYIADSHIPTEKELEQKFGADKVRHKLYRTIATQMMLGKKSYYIDNNIIPNADELMNEFKIGPVKATVYINQIRAGIEANQLLNNNDTTKPSTGRSQKKSGNKNDHWYMSNQGINNTGTSSRIFTGREKKQRYFFDPISTFKTYFNTKASKGNLTQSQHNINRIIQQEENIEEFKNLIKTDPIAALTLQVDSSYKQEAVTTILSDFNDDTIQRVLFSNDKGQLDFSTNIDVKNRPILQELLENSYSEEKTKFAERIQDYATRNISNSKFEEKARLDLIKLAASKDKSSVENFLTLQLELKNRMQPYIVNSVYILTPEIVEEINIELKNKGLIRDSLTKDYMIKLAKEVNNHTLNSVIKVILSDSNILSNETNKILGLAVGNNANNLEQTQSGIPNPPHSNRSLGVFQSASSTAQRSMPPPPPLILHRLYASKHFDLNQLQAEYPHIHSLYIQFTHNTTVQSKAPLQPTASSATSTGRSTPETAYAKLYAEYRTETGGTKANDLQDQLIKRQADLTNVIRQILTESYANQGADEKTLVNLFSISTPEIAEKAKEAFNTLVQDQYIKDITVNGKKTITSEEIIKNLFNEDTDDAVKRILLSSCKISEELKRPIKLEFNKSELIRELQGKQNPFEQLEFAYINAKNFDQDIFGNRVEELINNPNILTIVQQATFLITEDTNLRKTINSDQAQAKLDDLRTAILSTIKFEELITANLPQHDFIAIVKEKDPELLKEFLKATTIKLTDNNNLDQLRLALPSFTGMSNEQIRILTSKLKMPIILKALKECSQEKAKKHIHTGNMPPPPPPLPDSQDLELAYLTSLGITKFNANTSTFKTTPKTYHFSSDIALRYKEFTLSGQKSAGYKAKYSDADLLKKAIVESVAFEHSKNLSKAHQNNKYFEQIQEAVDTMQSSFIGPRTEIGQKIHNIYTSKLLELTKDKEFIKYVEDNIILNKKLTEAFTSADSDFIDSRTELGQKIHNIYIQQLTKYPEEAVKEAFNTASLDFIGPRTEIGQKIHNIYKSQLLELAKDKELFLFVQQVLVESTELEQKYGSDIQSENSKNEKKVGRLDKKKLRLFPQENKATNDESSTKDDTQPEDSNKKSEQSDSKTALSPRLLSSNDSKNDKSSDDKKSLLALRSSDEDDKGYATDEEELEESNSTTDEELKKDIVLESEDEAIDVSFKTEAITEQDEVTQRQQVSDDTSGKVAILVQETSTLHKPVHYNINDRLTVAAIGAGDEETSINRRVWISGLYGINKQRIWKNIPKYQNRTTGITIGTDAEFINSHDVIGIAYSRLESQIKYNKKLGKTTVNGHLLSIYSLKELIKGFSLQTITSYGHNYIKNRSKNINNIIGKYQNNNLSFQTVLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGL

SEQ ID NO: 19945 - protein, 266 aa, Pseudomonas putida
GARIVEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQC

SEQ ID NO: 19946 - protein, 298 aa, Salmonella typhimurium
AEVVRPDDRGALDSYTAFRDSYSRIGARGDYQLNPGLTLFGQLELPVDLANWEIQDPSDHSQDVRVAQVGLRGDFGSLAFGKMWTPYYNAIAHPVDMFSSYYSGFATYSTFREGQTFSYYSPDFNDFSFALGWAVNNDNWHTVAWNNDEGKERFQVTASYNLTDDTTMAAGLDHLSSDQRLWGLSLMHNWEQFYIGAKLEVYDSDYGNDGDAAVNLYAAYTTGKHTFKAMLAEVKGYGGTVFHLGVDHQFNESLMFFAEYYREQERAAITTKRGSVDGTWLNDFGGGEVFLLGARFDF

SEQ ID NO: 19947 - protein, 938 aa, Wolinella succinogenes
MKTAHARATLLSLVLVMAVPGRAEEPGLLHSPPERAEPRVALQLDGTLVEGRRVLELYVRYRGPGEPYARRPMEREYGDLYRALIPAEHVVPPGIEYYVEGLTADGQRVPLFQSASRPARVLVGGETPASASIVRPTPPPERRPPPSRTPPRAAPPEPAPPPERTPPPERSRAQASAPRKDAPPATRQDDSMAALTADLPADAPTEASSSARPSRASAAAGSAPAPREPAAPRSELEEDLALYSAEDTLALATRHEAAVRTVPAIGASFSQQQLRSLGARTVADVLDVVPGLSVSRDVQGFHRTAIRGLRNDAEVLFLLNGHRLNSFFDGKALMNLPVENLERVEVIRGPGSALYGAGAFLGVVNIVTDTSDGVRTAVSVGGYPGQDDRLAVTGNGHISAGHTAGNLRVFADIDVWSQAGDSTVIENDGLDDESRSQGLRDVTDPAGRTRDERFLFNAGAGVTYAMGDAGRLGASARFLTERRSALVGLFDTVGEDSKLGWNVFLADLTWERSFGPDVTLRARAAYDQQSTDRFFQITPHDFSAGTGANRLFEEGMQEQTRVSVRSLTGSVDADVALGAYNRLSLGAVVEQQSLGEYDYVTNYTLDAQVRPDGLTRPEGLVDLTSGAASRRLNVGLFAQDQWTVVNALTLTFGVRMDATQLPTVDASGAINGTRFVPTLNPRVGLVFAATDALVLKALYGRAFRAPTLQELVERIPDTEYNQGRFEGNPRLQPATVDTFELGADLIQSAGDARVRLRANAYVALFGSPIVPVDTSGNIVPLRNRELGVRVYGVEGEARLEASKRAYAWLNASISRAEDLELPAQSRLLTDTPQARFNAGVTMPIGAYVNFDVVVRTGAERRNNSRSVLELIRRYKIPSYSLITAQLRTEPILEHFEVALVAHNLFDNDLRDDVPRPDRVPGLLPREGMSGFLTVRAHY

SEQ ID NO: 19948 - protein, 703 aa, Wolinella succinogenes
MQKTWWLDAALAVLAATAPASAQEAGTATGEDAAADRPIDEIIVTGARQRSGAATKTDIPVIETPQPISIVPAELYQAQGALSVADTLRYVAGVQANPYGPDSRVDSSFIRGTNPLQFRDGMRDLFSYYASIRADPYTFSQVEVVRGPASVLFGTTSLGGLVNLVSKTPRFETGGEVSLRYGSFDRKEALADVTGTLAPGLAGRLVARVRESGTQTDHVPDDRTLLAPSVRWQPGPDTDITLLGLYQEDDGGSTSQFLPVVGTLLPNPNGRLPDSLFIGKPGWDRYDGRLRQGTGIVEHRFTDRVRMNLRARYVDSDLTYLTHYPDSYANPTNPYLDPARRLIGLYADGSKARMDIFSTDNNLRVDFNTGAAVEHVVLAGVDYSWNHVRKKGGFGYEIIDIYDPDYDALSDFGGGLPATDPTEDVAQKQLGFYVQDQIRLWDRASVVLGGRRDRVRTTNAGSPTEEAEATSLRAGLIVEVLTGVSPFVSYTESFEPIAGTASDGGAFDPKRGRQYEAGVKFHPDDATLLTLTGYHIKESNRPVDDPATPDPFDQTQAGSLTSKGFEVEASRLLPGNYEIIASYSYTKAEIEEEGTQLENVPKHNASLWGTKTLDLGSEARLRLGGGVRYAGASRSYGAAFPDGLRTPSYTLVDALAEVTWRNWQFTLNATNLLGKDYYSACLARGDCFMGAERTVFGTLSYRF

SEQ ID NO: 19949 - protein, 251 aa, Wolinella succinogenes
MQASFVLTFKSLADRVGRAQCSKTRTHHNDFHHSISHHRESCSVSIQFPLPWSASISKSKELSYMTKTFKIAAATSLLLACACTAQASEPYVGLGVGAFNLGSGVTKKAVAGGYLQLGDDFSEYLGGEVRIGTTGKSGEELTLQPRMKIEYFGAAYLKPKYQFNDQWMGYALLGIATLRSSYSETGLAVQKKTRTGYAYGLGVQYRLADEYSIGLEYSHMLSKPKTNATAIKTNFQGLEASSLSLSAKYHF

SEQ ID NO: 19950 - protein, 664 aa, Wolinella succinogenes
MKTAHSLFSSLVALSMLHTSALANDEALSLENVTITAQKQKENLQEVPLSVTVFQESDLEDRNIRSLQELAPYVPNFFLFDLGNMGALSPTIRGLSTNVTLGSPTVGLYVDGVPYTSTIGYDVMMEEVERIEVLRGPQGSLYGKNAEMGVVSVITKQPNNEFRAKAGVTLGSDNLREYTASASGPLVRDRLYLGIAGKHYEKDGFIDNTYTGEKYDDREHNYGKIQLRYTPSESLDISLISSRLKYDDKALSMNAYPVLDKRKISSDAGFNKSVVETHALHVKYAPNDYQIESITTYKKDRDYRLSDMDFTSSVGYHTLQDVAQRNLSEELRLSTQKDHYNWLLGLYGDHGKSQGGYEAFSPWPGYAGVFRQSQKSRSLGIFAHAGYQFDSHWKLSGGVRYDRDKKSIDDPSYGVQGDESFSEVSPKIALEYRFSPETSAYISATKGYHSGGFYVYSAPGYSNQYDKETLWSYEAGVKNSLFGNRLMLNASLYYMDIDDMQVLSVVNSYGQGYVSNAAKATSKGAELELAFRASESVTLLAGAGYNRTTFGEFSDFAGDYKGNTNPFAPRYNYSLGAQYRSIEGFYARVDWMGYGKMYLDNANAYEKDAYGLMNAKVGYEADSFDLYLYAKNLFDKNYDSEGYYGRYTYLSKPREVGVQGVYRF

SEQ ID NO: 19951 - protein, 432 aa, Wolinella succinogenes
MKNSIKYFVLLLVAVFGLQMQAQEDSFFKRSLFDRDFDNFRNPDQTGINEFEPEKDSLTNFGGINVRVGGAFALQFQDIDHENSGNESTPVLQDIGGNFNLATANLDFQVMLYDGVQLHLRTYLSSQHHTETYVKGGYLQIDKLDFISEGFAEDLMKHMRIKIGHMENNYGDAHFRRSDNAMALYNPFVGNYLMDSFTTEVGAEVYYFNKGFLAMVGATNGKLNQSVTNPKNTSPSLLAKVGYDDYLNEDLRFRLTGSVYHTNQTASAYLYSGDRAGSRYYNLFTDIDGGGDGFRSARVNPNLRNELTSIMVNPFVKYGGLEFFGIYERASGKAAAESDTRDWNQYAGELIYRFGTDEKLYVGGRYNYVDGELATGEEVSVDRFNIGAGWFMTKNILAKIEYMNQSYSDYPLTDVHNDGDADGIVFEAVISF

SEQ ID NO: 19952 - protein, 734 aa, Wolinella succinogenes
MDWATGTRLRAIAAAASVAFGAAAAGQAFAQTTPAANAQAAAPNAASAGTLPAITVNAASEGDGTVGLVAKRSRTGTKTDTPIEEIPQTINVVTAQQIEMTGATDVNTALRYVPGFSSYGSDNRSDWYAALRGFTPTAYVNGLQVPNTLNLSSWRVDPYMIDSITVLRGPTSVLYGAGDPGAIVDVKTKLADGERVREAGVEIGNYARKQFMIDVGDKLDPDGKYAYRFVGVARDGNAVTGPNNDQRVALAPSFRWRPNADTSLTLSATYLQDWGDISSNFLPAAGTVLPNPNGQITKDIYEGDGNFNYYRKKQWSLGYQFEHNLNSMWTFRQNTRWMHLSVDNGSVWGAGFADETLTEINRWAGVFQMNYSRFDIDNNLEGRFATGPLQHTLLLGFQYNRQTATDSEWLAAAPTLNLYNPVYTPVTTAVFSDPDTTYRTNTYTTMNTFGLYAQDQIKWNRWTLTLGGREDWVNMRMDDRAAGTQSKADVSAFTGRVGLTYQAGYGLSPYISYSTSFNPIIGVSLLDGGVPKPTRGRQIEAGLRWQPPGKNLMLNAAIYQINQTNGVTPALPTQDPGGTKSVQTGEVRARGIELSATGKVTPNLSLIASYAYQDVKVVQANDATLNNWPVDIPRPRQMASLWADWTWHTGPLAGFGLGGGVRYQSASAGAADNSLTVSSYTLIDAAVHYDVRNWRFAVNATNLFNRHYISGCQSTSVCMFGNDRTVIATAKYNW

SEQ ID NO: 19953 - protein, 884 aa, Wolinella succinogenes
MKSKIVLVLLSLMSAGVQAGVIKGKIKDAQTGEEIIGASVIVKEDPGKGTVTGLDGSFNLSVNRDKYTLVCSYVGYKKYEVSIAADKKEIVIPLKSDDVALDEVVVVASNPGRTEAGARGIERQAMNVVNVMSAKAIELSPDITVANVIQRMSGVTIERNSSGEGQYAILRGMDKRYNYTLVNGVKIPSPDNKNRFVPLDIFPSEMLDRLEVTKSLTANMEGDGIGGAVNLIMKDAPSERQFTANLSTGYNAMYFDRDFQSFNHGAIVKKSPYEQMGMPEDSRVTMDNFTTDNLRMKWNKPLPDLTAGLSYGDRFFNNKLGVMLAGSYLNTYRGKESQLYYQPGTTHNGIEYRNYSSQQTRIGAHAKLDYHINANHKLTWYNGYMDMREAEVRDGHDDKEGAVRMKWNHQYIINSTLKGEHAFLEGGVLRLNWSAVLSKAYSETPDNAEIFFLGNHVQTSGAAIRRWEHNSDKDKAGYLDLMYKLKLDGGSVFDFSVGGMYRDKKRDSFFNEYTFNSATGVKDPQYQGEDWNNYDEILFTPLKYGNISDPLNYDATEKIGAGYGMVKYTYQKWEFIVGVRVEHTNQGYTLKFPTENTDPEGYQKYTDVLPSFHAKYGVHKNANLRFSYARSINRPSFFEIVPYSIINEDYKEKGNPDLKHTVADNLDLRYEFFPKSSEQFMVGMFYKKLKNPIEYGLLNEGQDTYYKPMNFGNATNLGVEVDVMKYFNWFGIKANYTYTHSSITTEKRIMDGNDVKACTQTRPLFGQAAHVANLSLLFKSTKYGWEGQIAGSYTGKRLSDISNWYDDDIWEDGYMQLDASVEKSFKNGISLFAKASNLLDTPLLRFIQSGPRTENVNSERNNGNVIERKEWHGQSFMLGIRYKL

SEQ ID NO: 19954 - protein, 1105 aa, Wolinella succinogenes
MGLTTYAFSQITVSGTVTDNNGDGLPGVNVIEKGTSNGAATDVNGKFTLSASKGATLIFSFVGYQNREIKLISGQTDLGTVKLAEEGSLNEVVVTALGLEQNKDQTGTSVSQVATKDLISSGEPQLLNQLAGKAAGVQIISNSGSDPGAGATIRIRGANSISGSNQPLIVIDGIPMYNNTDQAGSGAGGTAGVAQQSRLNDINPNDIASMEVLKGAAAAALYGARALNGVVLITTKSGKASKKGFTVVLNSSIAIDRLNRKVPLQTSYGQGVGGRFQETGTFGTAGSWGDRIAARPGGANTFITDPNDPNYAGRFEANDGKTYYRIPSGTATEPWGGKRSRETFDVYENLFQTGITLNNDISVSSANEKGNLYISFSDTRQEGIIKGNSSYRRTTGRLNSTRYLGKYFTIAAKANYSHIESSRVQRGSNVSGILLGGLRTPADFDMRGYSGTYYDVNNTPYPNLQRAYRNPVGSRNFNSTPNSVYDNPLWIVNNILGDNAVDRFIGSLEFGADPLPWLNLTWRIGMDHYSDIRGDFFPFISAQASGGSYALNNIRNTQFNSDLIARSSFKINDNISSTILVGIGANERKFSQNSSTATNFVNTLAPPILANSSASGRTPISTFSVVRNVGYYYQASFSFYDLVFLNTSGRYEDFSTMSEGFFYPSVDVAFQFSKLLPKNDIFTFGKIRAAWGQVGRAAGAYTDRAVFIDNIAVGDAGWGSFLDPAVYGGGSRQGNTAPAILKPEIKTEIEFGLDARFLKNRVSAGVTYYMNNTVDVIQAINLSPTTGFLFRNANAAEIENRGLELEVSGDIIKTKDWSWSVNANYSRNINNVKSLQGTNRIFLAGFTSTSSNAIVGQQLGTLFGAVWDKNDDGSLILDGDGFPTLATESSVIGDPNAQFRVGFGTSVSYKNFTLRAFFDHSAGGDIWNGTRGALNVFGRPEATATTVTLTAAEAASLKTYSGSTVDQLIANGDYPSANRNADGSVTFRGSRADFGAGTVLLDESWYTTLGGGFGGADEQFIEDATWTRLRELSLSYNLNSEGFRTFTGLQSVQFTVTGRNLFLWTDYTGIDPDTNLSGSAVNGLGLDYFNNPATRSFLFSIKITY

SEQ ID NO: 19955 - protein, 729 aa, Wolinella succinogenes
MITRNTVFRVSSLALAIGLSFTASADEIARDPLLNVNEVIVVHGEGADAEQLATTHWSIDEAEIRALGAQTLDQVLKNVPGVYIRVGGDGTPRVDIRGFKTRHVTLLVNGVPMSSADDGQFDPSVIPTSQIASVEVSVGPTSVLYGPSGAGGVINIITKQGSTAPALSGRLEAGKDNTFNGDISAAGSGDDWQGLVSVSRQQTDGFPMSNDFEPTQYQDGELRVNSDKEVTNVYAQGSYWLSDKTQLIANMALRNGEWGKPSRDGTGSGKLKYERTDDYDSHTFQLGLAHQFDDTFTLRGFGYHNQSDTLEAAYADETYQALTQTQDGHSVVQGVNLQLITDFHKAGLLTTSVIAEEQSWKSVVDTYSSNAGSGTGNNSGTGTGSGSGSGSGSGSGTGSGSGSGSGSGTGSGGGTGSGGGTGSGGGGGTGSGGGTGSGGGNGGGSGGAENLNDSAWLYTAAAEYQYQSEHNYGFTLGGAYHSLDTSDGTDDNYSAMASSYWQLVPDSRLSLSVARKVRFPSMVNLYSQSSGNSELEAEESKHVELGLDQNLPASTDFSLYGFYTDAKNYIAKDTDGFYQNMGRYEFKGVDFQINNHAIEHLDLSFSYSFLDSKEMEGDDTLDALQYRPRHQLRWQMSYEFPFETQVHLNVERILDQVYATQVKVNGQNQYQQQSLDNYTLVDINLVQPLIADKLEVYLRATNLLDENYYQSEALPQAGRQFFVGVNWQI

SEQ ID NO: 19956 - protein, 419 aa, Photorhabdus luminescens
MLYNNVTVAAENNCHSYDTLLPRGPETPSVSSACDTVFPEWGGLRKEMADRGFYANFQLLTNLTYDISRSWKNTPSPNYMGQHLTTGNIAATELTYDLSRIGFTDKAQLRLGLTYAYNNFKNNGQDGHPFVSAFSINQPLLNDRVILNYGYTTLLSHFYGLFLGSSTASSALGPTSVMLSQAGLTISKPSPSIDIRFLSENKRWYDHIGVARSQSSEGLKTDSKYNTYGLRWKLPSAGTLVINELGYRVNANETENMIWLRGGSVFNKTPYFNYNNSEYENYTYSHYIAATHQITKPDTSMPFRGWYIDGKANYAPKDRNLFNADISLSLFSIGPFDSRPNDMVTFGLAYNKFSDDAKNYFARNGQLAESYSATASVAYSYRVYNGIYWTNSLSYTHHPSVTPKEDDAYNLLTQITFSL

SEQ ID NO: 19957 - protein, 673 aa, Vibrio vulnificus
MSEITVTAARLPPTAADAAFSVVRLDQRVLERSVRLDEALRTVPAVSLFRRTSSLAANPTTQGISLRAIAPSGAGRTLVTLDGVPLNDPFGGWVIWSQVAPESLDRVDVVRGAGAGPYGAGALTGVIGLTERDSGGVLDLSVAERGGARAAGSGSTMLGPVGVTLSGLYEASDGYTPVRGPAAGAADTPLDLDSRSAALRVDAPLDGLNLEGANLSLRAATWEEDRGSGLLNARSNASGHSLSATAAKAPDADGYGWRLQAWRIESNFANSSASVAADRSTTTPANDQYRTPATGWGLNAALRRRTSDFAGGRLEWEVGADARFNEGETNEFFSNPTGAGFARGRRAGGETSVAGAYVDGSWTGGDWLIAGGLRYDQWKNEAGFRYEYTLSTGVPILDETDVDRSGEVFSARLAARRDLSRLLGAGYAWRAAAYSGFRPATLNELHRPFRVGNDITEANSALEPETLRGIETGLAYDRDGITWGATVFWNEIEDAIVNVTIGEGPGTFPRAGFVLAGGVLRQRQNAGTIEAWGVELNGSIQATEALSLNAALSWTDAEVDGGTAAPQLTGLRPAQAPEWSATAGLDWRATQRLTLGLAARYESARFDDDLNSRTLDPAVTLDARAEWLAREGVMVWAAVDNAFDEEVEVSMTGTDVAGYAPPRTVRAGVRFSY

SEQ ID NO: 19958 - protein, 479 aa, Vibrio vulnificus
MEYMDMQHRINLSLISTAVLAALTSGTAFANDVDPNDIRNQSAAAVDLATEAKQAFYDGSTSRLHSFLYIRDREQKNMTTGEWSPNIENQTLQLAWDYKSGYFKDTIGLDIWANTNLQLGNTTGMSEILYFDHECQNNPAYDGKGCEKSYAALSVAALKAKFGNEDVGLALRGGYTQINIGTIRSSWGLNPHAYRGLEAKAHFGNLIVGYAIADQFKNDWRKEFLPMTTKWHQNQLKGADTTNTVIDHIQTLGAIYKFDQGQIDVGYGVGKDYRQNWQALGKYNFDLGSAKVGLSAFYHGSILEKSALTTNVVSNKEEAQSYLGLGANIKHGGFTWIAGVSSTDTGGQELSYNFRLTPWANSDNRNFQQTTSGLDDYNADGTKAVKLAVNYNFASWDLPELTAGIGGNYGTNVRSSLTEKEYDGSMHSFDWNIGYKFMDGALEGLNIRTFRSKFRGNDIVHKADRNDTKVLISYSVKLK

SEQ ID NO: 19959 - protein, 718 aa, Vibrio vulnificus
MTASKGKFPLSTMALAIIAASTALTAQAQETSTNDKMVVVSSRTPKAISDIPGTVWYIESDKIEQEYRGGKTLGDILASAIPSLDVSSGARTNLGQNLRGRKMLVMIDGVSLQSSRSISRHLDSIDPFNVDRIEVLVGSTSIYGAGASGGVINIITKKAHSEELEFESYVGGTSGFNSSEDFDYKVAQSISGGNEKVQARTSVVYTETQGFFDANGTIVTPDISQGSLQFNQTVDFLTTVGVDVSETKKLNFLAQYYDSQQDSPYGLYIVGRDFVDVRKGFESDREHGTKRIMLSASYADAQFLGQQLIAEASYRKEDQTYTPYYQSSGQQITDVISLKAALAKSFDKLNIVYGIDAYQDKLDSNQALYDPTIANNSGNLVNKTYAQVGRYPGVEVSSVAAFAQVDYAITDDWRVEGGVRYQYMLNKIDDFVGYNQQKKIAADSGTSADAVPGGETDYSVALFNLGTIYHLNRDSQVWANFSQGFDLADPAKYYGQGNYTLVGDHWQLNDSINVNQSKMSGIKTNSVELGYRLVSGDVNLQTAAYYSQSDKNIKYNKTTLLIEEIEDKKRVYGLEAMLSYWVHDNIQLGASGHYVVSEVKGDKGWEDYDAGYASTSKANAWAGWSDANLNVKLQSQTMFDYEDASNNKLNGYTLFDLVGSYQLPVGSLGFGIQNLLDKDYTTAWGQRAQLIYSAHYESAAYDYKGRGRTYTLNYQVKF

SEQ ID NO: 19960 - protein, 942 aa, Vibrio vulnificus
MKIITSLKLLVVTLLFTLNYSGLSAQEGIIQGVITDEYGINVPGAAVMIDDLNKGAVSNQDGKFTFVEVPEGNHTLTIKYLGFADFTKEVMVNAGKTTSVSILLASEETQLDDVQLVGFSAGGQARALNTQKNNVNITNVVSTDQIGKFPDANIGDATKRIPGITMQVDQGEARNIIVRGLAPQLNSVTLNGSRIPSAEGDNRNVQMDLIPSDMIQTIEVNKAVTPDMDADALGGSVNLVTRSTPQRFRLSATGGSGVNFITDKRILSGSFLVGDRSKNKKFGWMVSASINDNDFGSDNVEAEWTDTFEYTNAAGEEVEMEVNPYANVYENRKYLVQRVRRSFSANFDYNFDENNEIYLKTMYNWRDDRENRFRFETEVLDAEDIMEGDFEIVNGTPARFPVEAKRETKGGIPGGRIQNRRLEDQRMQNYSLGGNHLFGNLKFTWMGSYAKASEERPNERYLVYATEYGINNEINDTRKPIHTPAAAEDFSEFELDELTEEYQFTEEKDINFFANFELPADFFAQGDGSVKFGVRGRFKNKNRANNFFEYSPLTGALDNLAMVDQRIYNDNDFLAGTKYNPGVFASPEYLGSLNLNDAAAFEGEALPDEYLGDNFDVTENVYAGYVMTNQKLSDKLSVLVGLRVENTRIESTGNNFDVDEPEAFTQINDESSYTNVLPGVHFKYNASENTVLRFAWTNTLARPNYIDLVPYRQREDDEVSIGNPQLDPTTSMNFDFMAEKYFSSVGILSGGVFYKDLNDFIYTSVSEEESTGYELYQPLNGDKARIFGAEIAFQRQLDFLPGFLKNFGIYANYTYLNSEAKGIANEDGDMRGDLDLPGSSPNMFNASISYADKWFSARLSGNYSDAYIDELGGNAFEDRFYDEQFFLDFNATVFLSRNLQVYANLNNITNQPLRYYQGARNRTMQMEYYSTRLTFGVKYDLF

SEQ ID NO: 19961 - protein, 612 aa, Vibrio vulnificus
MKIRVSALASACALACFLAPAAHAADAQLGHVVVTATRQPISADAALASVDVIERDEIARAGHSSLLGLLSSRPGVQMARNGGPGSSGSIFIRGANSGHTLVLVDGVRMGSATSGSPVLETIPLELIERIEILRGPGSALYGADALGGVIQVFTRKGREGFQPSVRVGAGTDGAREASATLAGGNERLRYSLTAGHERSDGFNARPNSATAADADDDGFREDYLGASLVLDLGGNDELGANLLYSDMRNWYDAAQPFDSYLDKRAETFGAYLRKQHSADWASTLRFGHGVDALDNQSNASTRSRFDTTQRQLSWQHDVAVGGGSLMAAYEFLQQRVKTTSDFEKTRRHINAFLLGWGGEFDRHNVQLNARHDRNSQFGGKTTGAAAYGYRLAPEWRAHASIGTAFKAPTFNDLYFPVECYGAWGCFGGNPDLEPEEALNRELGVAWERNGVGVDLTYFNNRIKNLIDWSTGIASNVGRADIQGIEAALSATLGDYRLRASVDLLDAEDDETGDQLGRRARVGGALALERAVGAWTWGVEWNGKGRRYDQVPNAVSNRLGGYGLVDAYAHYAVARDWSVEVRANNLLDKDHELAKGFATQGRSAFVALRYAMH

SEQ ID NO: 19962 - protein, 174 aa, Vibrio vulnificus
MKTLMSAALAALSVAAVPALSHAQEVYGTLGYAGSRADGADTGAVQGRLGAKLTPHFGVEGELSGGVKDDNIDTNGVRSNLEQTHQAAVYGVGFLPVTPHIDLLARVGYGNSQFKQTVAGVESKFDADSVNYGVGAQYKVDDKNGVRVDYTRQQYRDNDAADANVVSVGYARKF

SEQ ID NO: 19963 - protein, 678 aa, Vibrio vulnificus
MAALPENDYSVTSTSAGTKMQMTQRDIPQSVTIVSQQRMEDQQLQTLGEVMENTLEISKSQADSDRALYYSRGFQIDNYMVDGIPTYFESRWNLGDALSDMALFERVEVVRGATGLMTGTGNPSAAIDMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSGWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNMEGSIVYGAPRNFSITGTYQF

SEQ ID NO: 19964 - protein, 1056 aa, Vibrio vulnificus
MKMIVLFLFVFISGVFAGNANSQETKVSISKNNKPIREILGEIERQTDYLFVYSEKEVDVNQRKTVNVSQQRVADVLSSLFRSTNVGYAMEGHNIMLMAKTTQTDAAQQKRHITGVVKDIKGETIIGANIMIKGTGTGVSTNIDGEFSIEAAAGEELIVSFIGYLTQTIKIDSQKTLNIKLLEDTKTLEEVVVVGYTVQTKSAVTGSVAVVKADKLKDVNTLEVGSMLQGKVSGVYVSGSSGEPGQASKIRIRGKGTLNSSVSPLWVVDGVIVGEDPGLNPNEIDNISVLKDGSATALYGSRAANGVIVVTTKRGEYDANKYSVSVNAGVSLLSTGRLEMMNSQELYDYQKSWNNQSWFTEELLKHNTDWFKEASKPGLYTNANITYTGSSGRMRSFVMADYYREEGAIKDFTLDRFTFRSNNDVKFTDRFTMSTKISGSLSRTDSQQRSVYNTYLYLPWDFPYNEDGSIRSGQEQDWRGRDGINDMYDLQWNWSRSKKLTVDGTINFNYQITDWLRFESNNYIRYISNRSESYTDKRSRSGQSDKGSLSNSNSLLTKQFTNQMIRFEKSFGKHKVNALGAYEYTRHFYESTSAEGRGIQPGREILDVTTGIKSIGGYKDAIATQSALFNANYDYDNRYMGQVSYRMDESSCFGKNNRMGHFFTVSGGWNIQNETFFESLRESVNQLKVRVSYGSLGNTPGAYYGHYPLYSSMMYNDEVAYFPSQMGNADLSWEKCYTTNIGIDARFFDRFGVTIDLYNKNTSDLLYYAPLPNISGYTGQYKNVGAINNKGLEISLNADVIRTSKFQWTSDFNIGFNRNRVTELYGGKPELKGLKRLEEGRDMDEWYLREWAGVDPANGSPLWYTTDENGKRTTTDSYNKADRVYCGSAAPKFTGGWMNSFSYKGFTLTANFDFVYGNLLYNQSRELLDSDGAYADYNSMKLKSGWKRWEKEGDIATHPKAINGGNKNSNKSSSRYLEKGNYFSLRNLSLGYSIPEKLCGKLGLQRVNVSCSADNLFTLTPFSGVSPQLSDSSTDGYAGTIYPLSRRIVFGLNVSF

SEQ ID NO: 19965 - protein, 331 aa, Vibrio vulnificus
MKKAAIAVAVLSAVVSGSTLAATVYDAEGTSLKVGGRLEFRGDFNGNDKGEEIEGTMLNKSRVRLNVAGETDIGAGMKGFGFWEAEQGVKSSAGTSTEQETTFKQRYMYVGMKGDFGSLSFGRQNTAGVQISDMSDIGTFTGDQKAFVSAGNEQINNTIAYGYDFESFKLKASYIADDQKNADGYGLSGIYSAPFGLDIGLGYAANDLGTDKGSADQIIAGLGYTMGDLYFGATYTTGDKDDKADTEFTGIEVSAQYKITKEFRLIAAYQNQEEETKNVTKDKADFFELTGRYDFTKNFRSYLAYKANGLDDKDAGYKVEDTIRLGLRYDF

SEQ ID NO: 19966 - protein, 348 aa, Vibrio vulnificus
MNKNILALAVASATFGTQAVAVEVYNNDGTTFSIGGHVSVALEDSKQGDLGVTAVSPRINFNATQDLGNGFTADAKGEWSINYLDGGENALSTRLGYIGLTHESLGRGVVGTQWAPYYSVAGVADMPIAFANDFIYQDHGNLGTGRAEEMVSYAKAFELGEAGKIGLGLGWQGRKTGELKLSETNTIKNNYGNRAQIALNYSIANVTANYAYNTGDVNYGGGVGTKTSESHVISATYGSYGKGLYLAGVYAMNEYMNSGDGNLLKDTSAYEALAAYTLNNGINLSVNYESVIDEELSKRVYSTSAVQAEYNFTPKFVGFAGYQFDLQGSGDYKEKADDKWMLGARYYL

SEQ ID NO: 19967 - protein, 211 aa, Vibrio vulnificus
MKKLAVAALILSSLSGGAYAHEAGEFFIRAGSATVRPTEGSDNVLGSLGGFNVSNNTQLGLTFTYMATENIGVELLAATPFRHKVGTGPTGNIATVHQLPPTLMAQWYFGDASSKARPYIGAGVNYTTFFDEKFNDNGKENGLSDLSLKDSWGAAGQVGLDYLVNRDWLLNMSVWYMDIDTDVRFKAGGEQQSVHTRLDPWVFMFSAGYRF

SEQ ID NO: 19968 - protein, 712 aa, Vibrio vulnificus
MYNRTFLSASILFALATPVQAQDAGLFDEVVVSATRTNQTMDAVAASVTVISDKDLESKMAKDLNDVFEYTPGVTINSTQRQGVQSINIRGMEGKRVKILVDGASQPGVFDGGPYSFINSSAVSVDPDMLKSVEIVKGAASSLHGSDAIGGVVAFETKDPADFLKNGKVFGGQAKLSYSSEDKSFSEHVAVAKRFDNVEALVAYTRRDGKELQNFSKAPYDDYPVESQDYVKNDLLIKLQSQLSDDHRLEFLGEVIYNQNDSDIASSSYKNFNSEDTTKQNRLGLKHIWLVDTTITDSITSRLTWTDKEENGLTNRFKEASAGVPPRVPPNGDNQQKKDYQYAENKIELETQFDKELETHYLVYGLSYKTSRISNTNREFNSDPNTPDKIYVYTPDAKEMSFGLFFQDEISVLNDKLVLTPGVRYDYFSTDPSDTVDESFIKFSDSAFTGRLGATYKVAQEGTLFTQISQGFRAPSFNELYYTYDNPGHGYTNRPNPNLESEKSLSYELGYRHNTIASTSEIALYYSDYTDFIEQTSTRGGGLTEYTYVNISEATIKGIEVSNTLDLNRIANLPLGMTTRFVAAYTVGEDGEGNPLNSVNPWNAVGAVNYDAPNTLWGTSIKVNYTAKKSNSDINLDGNNGGTANQVELPSATVIDLTAYFKPTQDVTVRAGIMNLTNEKYYLWNDIRGEKELSRDLTQAERNYNISVKYEF

SEQ ID NO: 19969 - protein, 237 aa, Vibrio vulnificus
MIYAQEPKKRDINSITSSSGSKSPFDFTTIIQGDIFHNFDSGLQTESDYMGRVHLIISLDTKKAGLWKNGKLLVNGVNAHGGNPTATYIGDFQPISRNEAAPERTGLLGYYLITDQLIFPEDTKTNQGLGLFLQVAAAPGNQNLIYFFYAFGVNYTGLFSKRTQDILFLGFLSDLKKIRCANSRKYIVLRQFKKTVHSRSYEAFFEQNEGNRYTLMAQIIYERSLKFGKHLTIQPDL

SEQ ID NO: 19970 - protein, 693 aa, Vibrio vulnificus
MNYKLLIINTLIILSFLKVVSQEGVDSTQINNLEEVILTATRTERQLSSLPLPVTLISKKKILQSGTIRSNEILSEQTGIITVADESGFEGVQIQGISSDYILILIDGVPLVGRSAGNFDLSRLTVGNIKQIEVVKGPSSSLYGSEALGGVINIITEKPKTEDLQGDVSYRIGSFVQQDINLDIKQRFKKLRYGFFVNRFSSEGYDLNPEEEGQTVNPFESYTVNGRVYYDFNDKLSLFTSTRFYDQVQDAGFTFNDVLFEGDSKEREWNAHARLDQKWNEKFTTAYELYYTNYVANERLANPITEEVLSDSDFDQKLLRPEIRGNYTFTNAGTLTAGLGFQYDALDRTFFDELVSFNSQYVYAQYDINPIERLNVIAGARFDNHSEYSNQFSPKLAMRYKLSDAFAVKGSVGYGFKAPDFRQLYFDFTNSAVGYTVLGYNVALDKLQELQEQGQILNVVVSGDDLNNPLEAESSVGYNLGLTFKEGKWNSELNFFRNDIKNLIDTRIIARKTNGQNIFSYVNFDEIYTTGLEINTGYKITEAFNVSAGYQLLYAYDKNKQQEVEDGQVFARDPGTNQTVAVTQSDYFGLVNRSRHNANFKVFYDIVSAKANINLRLLYRSKYAQFDTNGNGLIDSYDTSFIDGFVTANVAASKTFYTDFTVQVGANNLLDYTDINIPTLPGIQGYVKLNYQF

SEQ ID NO: 19971 - protein, 458 aa, Vibrio vulnificus
MKLTPLSAAVLSVLVASQVHAESKVFSMEEVVVTANKIDQPLSKVAGSVAVITNEQIEERGETELYDVLRNEPGVSVTGGAGRPQNITIRGMTGNRIMIVRDGIRSADGFGANDINDAVGRDTFDLSNFESLQIIKGASSSVHGSGAIGGVVILESSQPGDFLKDKDFYTDVSGTYTDISNKYKGTSNLAFRSGDTESLFNVSYWQGQETRNFDEDLYNRDLDGYSGAYTINHFLNEEVMLKAKAELYTQNQERLEGSPSIQPDGIWHIEDFAEDETSEEYSAYIGAEVTPISPTWFEELDTKVYWRHTEVVEDTNRLMRQVDHNGLITKRRELEDKTFIDETICFRGDFTNTIYAANAEHQLAYGVELSTDYYERTDSDSKIDWNGVTPSTKQPFAPARAYNIGLYVRDMVELDKWTITGGLRFDAHRLTPDDEGAVGGFPLKDMDSSEAEGSPQLA

SEQ ID NO: 19972 - protein, 808 aa, Vibrio vulnificus
MRSILSVFLLVGFSLAATAQSAKIKGSVTTTTNTPLSGATIELSQTTLGTTTDENGNFILSNIPSGNYRLILSYVGFKTKYVDLSVSENTTKDLGTFQLEEAQEMLGVVSINGKKHNKFTRETSVSVSKMPLADIENPQVYNSITANLLEEQVVTNFDDALKNAPGIDKLWESTGRGNDGAGYYSLRGFAVQPTLTNGLPALTNGSPDPANIESIEVIKGPSGTLYGSSLISYGGLINITTKRPFYDFGGSVSYTSGSYGLNRVTADVNTTLSKEKNIALRVNTAYHTQNSYQDAGFRKSFFFAPSLAYQVNDRLSFYINTEFYKGKSTNQTMLFLDRGAQLRVNTIDELGYDIDRSYTGNDLYIETPTYSFQGQMNYKLSDNWTSQTAFSRSNSKSDGYYSYLYEGTQYTTLDEGIALNRYISKQNSETIATDIQQNFIGDFNLGSMRNRMVVGLDYLKTNVINNNSPYITNGAIYIGNNLQEFNEEVLGITDPANFTDDSGILTQAGTDALLANGTINPSKTEQEIFSAYASDVINILPELSAMASLRIDRFSNADHAQTALSPKFGVVYQPILNKVSLFANYMNGFSNVAPVDEVTNGVTTNRALDPEHANQFEAGTKLNLLNGRLSATLSYYDIQVKNRALRVDVDATNYFYTQDGTQESKGFEASFVANPVDGLNIVAGYSYNDSKLTEGAADFVGLRPESAGPQNLANLWASYQLTSGKFEGLGFGFGGNYASENKIFNRNLGGAFTLPEYTVLNASVFYGTPDFRISLKLDNIANKEYFKGWSTISPQNQRSLLANFTYNF

SEQ ID NO: 19973 - protein, 490 aa, Vibrio vulnificus
MMMKKQKTIGTASKMLLAWGLPALAGVSLTGVAHADDAVPLTVAQAAPAAGTGTAVAQAPTQNAIVNAEATQAVTPPDEPSAQSKSKGFIADSHLDFLFRNYSDILDNKGGPHRHAWVQGVMANFESGYTAGLIGFGVDASLYAGLKLDGGAGAGNMVHVAKGGGGSNQLAWAYPGIYDVKARISNTVVKYGLQAVDNPFMEQHDNRALPPTFLGATIVSNEFKNVMLEAGSFTKTDARGHTTLTNLTTQYGGTRVNRLTYVGGTWDYSPNGEVALYANQADDVWHQYYASVKHSIGSPQTIKWTGFGNVYSTHDTGDALQGKINNNAYSLSVAAQHGPHELLLGFQQVLGDQFFDYLNETNGIFLTNSMDVDYNAPHEKSLQLRYTFYGKEAGLPGFKAMVWGVTGWGADGSAGAANDPSKSSIYWSNGAPVQGRHHEFGFIPSYTFQSGKLKDTKVTFIAMWHNGSSHYSDATNKEYRLVVNLPLHAF

SEQ ID NO: 19974 - protein, 724 aa, Vibrio vulnificus
MLRGFAPAFPSASNRPRFVVLSLRCGEILPSPLAAAANGPTLCYGTANSSAGVIGRVRKTVIIGILAGVVTTPAAGGGIVVKAPAAGGPAVFDWNGFYIGGHFSYVAGRSDWTAQPAGVSGTIDLFDAFDAFKGTGSYTLGLQAGYNVLLPSRWLLGLEADLTSPNRIGGNASISPPTGTIGGHDHQTQLAGTVRGRLGYALDGWLPYATAGFAWSYDRLRWPSEAAATEETALLWRLGWAAGAGVELPLSPAWTARVEYLATGFGRDTARFPIAGHQIESDALIHAVRLGLNYRLGEDLAKSDVFTKGIDALELDRFAVHGQATLTWQYAPPFRSPYRGQNSLLPNQARETFDMTFYVGTKLWDGAEFWVNPEIDQGFGLSGTFGVAAFPSAESYKVGSDYPYARLPRYFVRQTLDLGGATETIQGGPNQFAGKQSSERMVITAGKFSVGDIFDVNRYAHDPRVDFLNWGLADATTFDYAADAWAFTYGTAVEWYTGPWTVRGGVFDLPVTPNNTDLDPSFGQFQMVGELEHRHQFWGLSGKLLVTGFLNRARLGRFDEAVRRGQATGTTPEIADVRRYTSKTGVSASLEQQLTPDIGLFARAGLSSPNLETNAFTDSDRALSAGLSVSGRMWGRADDTLGLGGLINHISAARIAYLDAGGLTAIIGDGRLPNSGNERVIEAYYSLPVLSWRLTADYQFIANPAFNRDRGPVHAIATRLRTQF

SEQ ID NO: 19975 - protein, 334 aa, Vibrio vulnificus
MKKTLIALSVSAAAMATGVNAAELYNQDGTSLEMGGRAEARLSMKDGDVADNSRIRLNFLGTQAINDNLYGVGFWEGEFTTAENGGVDGNSNLDTRYAYAGLGGAFGEMTYGKNDGALGVITDFTDIMAYHGNSAADKLAVADRSDNMFSYKGQFENLAVKASYRFADRVEDNGEYKDNGEDGYSLSAIYTLGDTGLDLGAGYADQADANEYMLAASYTMSDLYFAGVFTDGEKEATFKNTVDYTGYELAGAYTLGQTVFTSTYNNAETNGETSANNFAVDASYYFKPNFRGYVSYNFNLIDAGDSMGSTTASNYKATKADAEDELALGLRYDF

SEQ ID NO: 19976 - protein, 1194 aa, Vibrio vulnificus
MRKSICGIFLLIGLLLASAAMFAQQTATISGTVTDSSGAVIPHASVTLTNNATQDVRRTTGNDSGFFVFTAVVTGNYTVKIEATSFRAWENKTISLHPGDHFNVNNIQMTVATANENVTVEAVSSQVQILDSGERSSTLYAKDIRNMALQGRDVTELTKTLPGFNNLTGGGNVNNASGYDPTIAGIGSSVGNGYNANGSPTRVGGAQLTSDGANIIDPGCNCNATQTVNADMVQEVKVTTSNYGAESQSGPVVIQAVGKSGSSQFHGAAYLHFRDHSMNSTDAVNKSLGTTKPDDRYWYPGGNFGGPVRIPGTNFNKSNKLLFWTGYEYYNQSFPDQIVPVVTSTVPTDSMRAGNFDMSAADNAHFCGVGGWLPQCTPITSINGTTVNNGDISSFVDPGGAAIMKMIPAANADPATNGGHNFITNAMNTKNGYMWHSRVDYSITDSTKLYVSYNQQNEVAGIPVMLWWAPPTEVPFPGNFVAPGDSKTISANLVKIFSPTLTNETIVTWSYLNNAYRYDNMAGVSRQALGYPYHGIFGNTDVMPSLSNGWWIPGYPMIYQQDAHDYYSKKQAPGVTDNLTKVIRTHTLKFGFDWQMAQNDQMNFVQQNGQVQFATWGASGNPVANLLLGSTTGYTESSKNTPQNMTYQTFGFYLQDDWKVTRRLTLNLGVRLSHDPGWTDHSGNYGLATWTQRQYNSDIAAGNSFLPGMRWNAVDGSVPLSGRDVQLIFAAPRVGLAFDVFGDGKTALRGGFGAYYYHDQFNDYQGPLSTAQGGRSCATTGVATLAQIDAQENVNCSQVGGTYAVNPNDDSEPLTYTYSFTFSQALPKNSLLEIAYSGNQSSNLIVPNQNQNIIPLGAFFKPDPVTGVINSVPDLEQGANGANKNNYKPMLAYTDLNLVQHGAFANYNALQVSYAKPSGAFTYSFNYTWSKAMGIIGQGPGGYNTQPDPANFHNDYTVSYINRPHVFNATYSYELGNLVKGNKLLGGLTNHWMFSGITSIQTGAPLAQSSTINFNLSAAGTTSGCTAGADNCFPNYYLDSTAVLGSSDYKLMPMVNCDVTGHGDHQYINGSCFGAPTTGDNGGFIPPTLYGPAYWSSDLAVQKTFKVSERQNVEFRLSAFNFLNHKLTSFYSNDTTNLTLKYMPAVSGLSDYTGYSGPYTQYMNPGYTFGNTARNGSNWVNGRRVVELSFKYSF

SEQ ID NO: 19977 - protein, 1155 aa, Vibrio vulnificus
MVFHKKQSAINSKQNLVFKKSMLAMCVMAFSAPGFAQTEQGPAVSDGSVEEIIVTGMRQNLQNAQDLKRNANTFVDSITATDIGSLPDRSVLEAMQRLPGVSIERFQAADDPDHFSVEGSGAVIRGMTATRSEFNGRDSFTADSGRGLSFQDVPPELMSGVDIYKNQSADLIEGGIGGTVSLRTRKPFDQDGRLVAFTADGTWGDIAEELKPSISGLFSDRWDTNVGEYGFLINIAHSELVGVSHGIQSDVYKKFDAAGIKGAEAFVGEDGQGTVWMPQGANLLMKEDQRERKGLATAFQWKDHDSKYLVTAEYIRSEANLDWWENALKYQGGYKDSDRNTRPYGDTAFSFTDNGLFESGFMSHANGAWRATSEIGPVIGTKENGDPLYLESVNTRYPNPYSGMPTTATGVGGISNFGHKFQLDTRGQSNNTLVEDMSLNLKWTPDDAWTIDLDYQHIKAETEVDDLAVHLAVAALQKYDLSGDTPHLTLINPWNGIRDANPDNYNNDVVRPGWTGDPEGDANYFSDITSYWYRSAMDHYERSDGTSDAIRMDIKYEFENAGLIKSIQGGYRFAERDQTVRSTSYGWGSIAPEYSAGTLYLDHVPEQSSYYSSVDWSNFHRGGALDIEGGNSLYFINRNVVADLRSNPDCNGSRYKKSPGGSYTPYACREGVDSQFGIFLPSEITNTIERNNAAYVRVDFGSEDTELRFNGNVGVRYVEIERRSTGYVRSAELDRNLTASDAIPASSGLPSVLTGTQVLAYADTLIAAGDYIDYPDFFSKNSWANQAWNYLPESDRRYGAMGSGWSTAKDTYDAFLPSLNIKVELTDDLIGRFAASKAIALPDMSLVRNNISIGTNGYDKNERQVSIVDRDDQGNINYDGDGNPLMRPFTYTESTYIGDWTGSGGNTYLKPMESVQYDVSLEYYFASAGSLTATYFYKDLSNFFVHGASRQAIPHPINTGEVRYVDVVSTRNGGDGSMQGIELAYQQFFDFLPEPFDGLGMQANYTWIEASGVPNNEEDYEDADWTQPGSENDTGARVNLTTVPLQGQSKHTANLVLMYEKNDWSARLAYNWRSKYLLTTRDVISKYPLWNDDAGFLDGSLFYNINDNITIGLQATNLLDTQSKTIMILDDGGTEAGRSWFIQDRRYSFIMRAKF

SEQ ID NO: 19978 - protein, 408 aa, Vibrio vulnificus
MTQNMRLFKKSLLAVTVALASGQTMAAGFQLNAQSATGIGRAFAGDAVIADNAAVMARNPAAMALFDEKALSLGFESITSMIEVKDARYQGLTAPAGKESNYDDAGDTSIAPNIHFIMPVNDKFAWGVNAYSNFGTKTEFDDSFVAREYGGLTDVKSANFGLAGSYRLNEQWSFGAGLDIIYGQGTMKREHALIGTLVDVDKADGWAVGFNVGTVFELDENNRFGFSYRYSPEMEAEDDKGQKITLPLPDMAEFSGYHKITDTKFAVHYSIQYIGWGTFDKIEFRNLKDNSPAIGASYDKAYEWQDGWHYAIGGTYYLNKDWTLRAGYMYDTSAQDSLTSVSVPDSDRQWLSTGFTYHIDTKSNIDFGFTYLMGDDVKVNESTAGVSSLTATTHADAILFGLQYSRTF

SEQ ID NO: 19979 - protein, 319 aa, Vibrio vulnificus
MKKTLVALAVLTAAGSANAGINLYDADGVKVDMSGAAEVQYFQGYAADSDAKIRLDDGDLAINTTIAVSDKMNAVAGIAFEMESGDVTNDELWVGLGGDFGTLTIGRQYLLVDDSGIGKDYELGGDGIDFVQANGDQVIKYVFDNGQFYGGAGALLTETNPAGNADEATVYEGRLGARFGNFDARVYLYSGDDVSTDKFDVFGGSAVNVNIDGYNLEAEYVMDAFAFSASFGQVDYELASDTSQKVDADTAALAGSYTMDKTTFALGYTYWAPEDEDVNVFYANVTQQLHSNVKVYGEIGTSDEKDSEFGYVAGMEVTF

SEQ ID NO: 19980 - protein, 725 aa, Vibrio vulnificus
MRINKILWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVVSWKLNPQQILDFEVGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKERLNWNTNATWMITSEQKDTGNPLSVIPKYTINNSLNWTITQAFSASFNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 19981 - protein, 157 aa, Vibrio vulnificus
MKKTLLALALASVSVTAAADSLIYGGVQVGSADYRSESSTVYGAHIGTGLLPFIGLEMGAWNLGSYDVAGQTTDVTSVNFAVKPSIDFGPLHVYGKAGMHSWEEKGAFKDDGVDPFFGLGIEYNIIPMFTVGAGYNNFTVDDKNIDFASINLTVHFL

SEQ ID NO: 19982 - protein, 738 aa, Vibrio vulnificus
MKKTVLAVAIAAVVTPLHANEQSKKQPTNLEHIQIISHHDRLRTESGSATLLTEVELEKFEYDDIHRILSSVPGVNIREEDGYGLRPNIGFRGVTPERSKKITILEDGVLIGPAPYSAPAAYYFPVTTRMTAVEVFKGPAAIKFGPQTVAGTLNMVTRQVPDLQEGGIDIATGQDGYQKMHGYYGNAFDDVSFLVEGVHLAADGFKDLDGGGNTGFDKNDLLAKVRYQFNGAGFEQNVQLKLSYADETSHETYLGLTDSDFSDNPYRRYAATQPALMETEHQQIMLSHNIHNSAFSLTTRLYRNDYERDWLKLNALGNTNASLSAILAEPQTYQAEYAVITGERNSVVSGETSHNLVMGTNAREYYSQGLQLDGTWQFNLFDFDHKLSFGARYHQDEIDRSHFEEIFVMQDGVAEQIVGSKYDTSHNIERTDALAVYIEDAITLDKLTLTAGVRGEFMDMHYHNKANLNDWQDKKARIWLPGISGFYQFSDSAGMLFGVHQGFVPSSPQQGNDIELEKSVNYEFGGRFNDGITQFEMVSFFNDYSNLKESCSQSNCGDDTLLDTEFNGGAVHVYGLESQFAQRYPLNMQLEVPYSVVYTYTKSEFQQEIFSDFVQWGHVKKGDELPYLPTHQATFNIGLNSDNWRVNVAFKYVSSMKEAAGRSWQSDAGQQVDVPLAGIKTDSASVIDVSASYDIGQFGRIYAKIDNITDEVNIISRRPYGARPSKARQFSIGYKYQF

SEQ ID NO: 19983 - protein, 349 aa, Vibrio vulnificus
MDKMFKRTLLGAAVAMASTGAFAASETGAIGVLSDFNVQAYGVAAISAFYQEDSNGYDYENESRIGFRASKDMFDNVNVFMQIESGYVGEDGKGSTLGARDTFLGLQGDWGKVRFGRMLTPLYEIVDWPYSNPGLGRVFDWGGDVAGHYDRKGDIARYDSPAFGGLTFNISAGRGDVGTKSSNHFGAAAHYNAADIVTFHVGYENNSNFKYDYKTKDTAGKDVDNTFLTDATAYIVGFELPLPAGFGLAGAYKYTEGASKTVKGQEGEQGQYSLIGQYWNGPWGFKVGYAANLESEVNGVEQKDDDEVLSAQLMYVKNGFVPYIRVGQHDAYDSADKKGFVRVGLEYGF

SEQ ID NO: 19984 - protein, 373 aa, Vibrio vulnificus
MSYLKKSLLATAVTGLMFSGAAFAEGANSDAAKNYLTKDSFAYEVYGVIAMQAAYRDYDSGDAKTDDNLGGMQFNNESRIGFRGKKNFANFGPTFIWQIEGGYVDPSFGGEGAGLGERDTFVGFESESMGQVRVGRVLTPLYEVVDWPGSNPGLGDVYDWGGAIGGAKYQDRQSNTIRWDSPMYGEAFSLDVAAGAGDKAGLGEGDDFWAGLAAHYKIGPIQLDAAYEGNRNIVAEGQTWDNDTYLVGVQGWFENGISFFAQYKMMEASANNGVDEKQNAMTAGLMYTAGDWQYKLGYAANFELERNGKTINNTDDNVISAQVMYFVDPSAVLYARARTLDFGDGATLLDDNTKTRWKSDDYTEFSVGVEYYF

SEQ ID NO: 19985 - protein, 862 aa, Vibrio vulnificus
MYKNTTALSVAISLALGTAAMSPIAFAEEQQVEQLQKMKVTGSRISTTEMEGPSPVTVITSKDIAAKGFNSAQDILNSLTQNTGGTLAQTNSFSFTPAAQSVNLRGLGASRTLILIDGRRMPQYPLAQNGVSNFQDIGQIPVSAIERVEVMTDSGSAIYGSDAIGGVVNFILKKDFDGVSVKARYGDATEGGYENGRLDIVAGKDMEDKRVLFVAQLAGNEMLQQSDRSWAGDDNSDRSAFGAYSSYGASFVEKGTGNVLTPAVNGKTCQDVVGEHGIDRADGKCGFNRSAYRSLKPENKQVDLLLRGEMDLNDDLTAMAEARFGYKSTSSIFEPNPYDVETDAKHSRGEGKYTRRLVEFGPRESNTEANAFGLTTGLTGLLANTYDWEVYASYSEQKVETDNPAVLNTLDQAVQNGYIDLLDTISAADVAKYSGRSTKEAYSKLYSINGSLAGDLVELPAGMSGFAVYGEWNRTDYNESIDAITKSGGFSGLGGTSGGGERDQIGLGVEVLIPVLEDLEVTLAGRYDHYFDDSATGGAFTPKASIAYRPTDTLLLRGSYGLGFRAPDLKRLFGEETKAFGSGFDPQLCASVGGTGPNDTIPECSTQYFDTVNGPNAELEEETSTNINLGLAWEPVDDLGLTVDWYHIKMENVVSAPSYQDVINDPSKYPGTQVVRNPDGTIKTVIYGPVNQAFETRSGIDLSLGYAYDTVSMGSFSTKFSITKILIAESQESSSEPVIDERDFLPEYTATLNLGWAYQDVNVNLFGKFRDEMCTSYANDYYFEDCDAAKKAGYETKISSMTTWNLTTSYQFNESGRVTLGIINMFDKEPPKDPLNDTSPFYADTYDDPIGRQVYVEASYDF

SEQ ID NO: 19986 - protein, 918 aa, Vibrio vulnificus
MRYRTIARCTASLAVMSLCATVASAQDAPPVQDSADSEGDAIVVTGFRASLQSAQSTKQRSDKIVDSIVAEDIGKLPDIAVSDTAARIPGVQVERRGGEANRVLVRGLDRFNYTTTYNGREIFTAETRSVALQDFPAGGISAIDVFKTSSAELVEPGIAGLVNVRSRRPFDFADSEIAGSVWGVYPDKSRDLEPNAQLLLSDRWDVGEGEIGALINFSYTRMHYRDSVRRHGFFIADLAGARSPDWPEIQYAEAERWRPSINGALQWRPSPDLEIYVEGLWQGFRERATDRMWAQPLWGGASYENIVLDGNQIISGTVNRPTACCGGNQTWGFQGATKRDTNTYQFAVGGRWDVGPLRITADVARTDSTFDLRTESVDYEINTNDYSVDWFTGKPGGSGLTFQVRGIDPTNPGIYNYRGFYEDHLTASGDDWQARLDFQYEPTGISFIPALHWGVRFVDRDASARAGDFYWNLRDRGIPISAVPLDYVLQPRGFRGDKNAPFPVSWFGPTFASVHDNLIELRQFNIDLTGAGSVDGPPIDAGRTFDINEKSYAGYVSANYELALGETTIDGQIGLRAVRTETKTSGTLFTTAGPVPVNFKNAYTDWLPSANLRVQFSPEVQARFAFTQTRTRPSFAQLNPALRLSPATPCAPGQTDCIRTGSGGNPFLKPLDSDNYDASLEYYFSRTGFASIGVFRRDMQGFIANRAFEFPEPDPETGRTLVISGPVNTRNARIKGVEAQISGFFDFLPGALSGLGAQANVTYLDAKADFGFFCPTTANADCVAGPGAPNAATLRTRIPDVSKWTYNLVGLYERGGLSVRLAYNYRSSFPEADRAERDGFFTLQGRGNSVSRLDLSSSYAFTDNFTVFFDWTNILDNPFQSDIVRINYPGGIPSDPEIFPMVTRFEESVLSGGVRFRF

SEQ ID NO: 19987 - protein, 662 aa, Wolinella succinogenes
MIRSNRTWDMVLAGTIAALGPLAAPAAAADLPVKARMAQTVFDWSGIYVGAHAGYTRDHAQASLIDPIGGAGAGSRFSGLTGGVQAGYNWVTRSGLLLGFEGDFSFPNSLTSNHTVAMLNRPGSSVSELWDYVASARGRIGYAQGDWLVYATGGLAWTGGRFINTTAAGDEKLLTTRVGWTAGAGIERAFAPHWSWRLEYLYSQFENGGVRFSNGASYTSTLEFQTLRVGLNRKLDFADGPDLKLKSDPSDPESDRWEIHGQATVIGQGYPSFRAPYTGTNSLTPARQFQETWSNSLFINARLWDGGEVYYNPELLQGFGLSNTVGLGGFANGEAQKSDFPYPHYNTSRLFLRQTFGFGGEQEQLGSGQLQLSGKQDVSRLTLQIGKFPVLDVFDGNAYAKDARKDFMNWSIWAPGAFDYAADKLGLTYGATAELNQKSWALRSGYFLMDAVSNSNNFDMNVFRRGSYVVELEMRYQLFSQPGHLRTIGWFNSVFSGSYRETLDNPALNADISQTRRGRSKYGYVVSFDQALSDEFGLFGRWSWNDGKTEIMAFTDIDNSLSLGASIKGNRWGRPDDTIGLAGVTNGLSRDHRAFLAAGGLGPLIGDGALNYRRESIIEAYYAYSINKYLTFTADYQFVNNPAYNADRGPVSIFSGRLHGDF

SEQ ID NO: 19988 - protein, 433 aa, Wolinella succinogenes
MKTIGLVILSLMIMSIDIYAEHNQTVDTFDINGSAQQPVKVKTLRGVLGENYPLEHEKGQLRAGYITFNENGNERNSAYALGGHYHIDSKRWNGLKVGLSAYTVLNLGINQDRNDINPDFFNAEGNSFIQLTEAYLDGKWGKTEIKLGRQLLDTPHADSDDIRMIPNYFEAYTLTNTDIDNLMLSAGFINRMAGWENGVDASKFVKIYETMGTDNEMDGIAYVSAVYEGIKDLTLSLWYYNYNNVANVVYAEAGYAYAFTENRSLTFGLQYDGSRQTGSALLGEQDANTYGVSMEFAAEDIGLHILTAYNLDNGNTGATGLSLGGGPFFTSMEDQTFDAIGSAGKAWMIGAGYHFDAIGIDGLVAAIAYGHFEADKDSLYESEETDIVIEYSWNEKLTLTAAFASVSFDAGVDENNDPLNDFDQFRLVANYNF

SEQ ID NO: 19989 - protein, 357 aa, Wolinella succinogenes
MGIEQERKSRLNGKLAAGAVLGIAITTTVQAQSSSGVSLYGIIDTTIRYSNNNQGDNKLAALTDGYFNGSRWGMRGNEALGGGLSAIFNLESGFDPSTGVSQQGTTTANYGQQSTGGQGRLFGRQAWVGLNHERFGRLTFGRQFTTGYDATARFQPNGHPNLDAVTIFNGYTGPRQDNMAKYVGQWGALSAGAYYTFGEVSGHMKPSSSYGATLGYKQGPVDVGGFWQQANALTTPESRKVWGVGGNYQWGIVKLTFGYLNNRFDVSPTRNDVFSGGFAVAATSALTLSVASHYDRQRNASGSRIMVTGVADYNLSKRTDIYAEIDFNRINGAYALPTFMGVKGSKVGGGIGLRHRF

SEQ ID NO: 19990 - protein, 1007 aa, Wolinella succinogenes
MKSAFNGASAAAILACLAASPAWSQQPAQVEEVVVTGSHIRGTPEDAALPVEVFTQADLEARGAPTALEFAKSLTISGPTTGESYYFGGPALTGSVTYNLRGLGSDKTLVLLNGRRMDINTANIPSIALSRTEVLKDGAAVIYGADATGGVVNFITRERFVGLEAQAQYKYIDGSKGDYSVGVMGGVGEGDVNFLWSAEYEHRSRLHALERGFTHDSLDPMRTGYNPAPWSTLTNLAGWQPRGALPAIPTATANGEFGAPVGGIVSDFTPASCAAVGGRYDNNFTCAYNYIPYYNLVENTDTYRVYAQLNARLTEDMEFHADFSYGQVTVPQVFGSPAQPMVRGPAMATGSVFQFYVPISNPHAAAFAARNGIVGAEGFTPVTWRLLGHGGNLALGDGEGFGVPDKIDNQVWRVSAGLKGEFGDWAGPASGIGYDFAVTYNQSTLFNTHPDTIGYRVQQALNGFGGPGCNAPDLDPARFGTQNPGAAGQNGCMWWNPFSTGFAEQPVRGLANPNHVAGTENPAELVRWMFDPRAAETVNHSVTADLVFNGRTGISLPGGEIGWAAGAQLRYFETRQTIDSPLFNGSTPCEWPSGTTSANGPGSPNLEANPLPTTDPNFRGCTPDSPGPFVLFAPDLPDYADRQQYSFFGEVDLPLLDTLNIQAAVRHEEFSGGLGATVYKVAGKWDVFGPLSVRGSYGTNYQTPPITAVPGQVSIAARNYTVAGSNWLAAQFITDDNLKPETAKAWNAGAIWQSRGFSPDHDFRLIVDYFDIRTKDQIGQIADPNQIANLVFNGPGGTITTCDPAAQPLLQRVTFNGTCAVGMSAVGAFSSISTRFGNGPGQTTNGFDIQADYNMPVGAGDLTLSLTATKITELKTGSTELDGVVVSTGDDRLGTLNFATFAQAAPEWRANLAANYRMDRQNFRLGVNFVSAVTDERPGIQYGEEGEDWITVDFTYRLELDDGMALTATVANILDRDPPPAQEEFGYDPWTGNPLGRTIEVGVRKAF

SEQ ID NO: 19991 - protein, 792 aa, Wolinella succinogenes
MAKKKKTIKPSILFFTLFITQFLFSQGYKLSGKVTDDAGLPVFGATVQIINPNRGTVSDQNGNYSLQLAKGTYRLKVSYVGFQNIEMELKLSSDKIIDFTLLSKTESLDEILITDNIEGINIRDPEMSVSKLDASSIKKIPVVFGEVDVIQSLLLLPGVSNAGEGASGFNVRGGSTDQNLILIDDALIYNSSHLFGFFSIFNPDAIKNLKLYKGGIPSNYGGRVSSVLDIQQKTGNSQSLKGEGGIGVISSKLTLEGPIQKDKSSFLISGRGTYAHLFLKLADNQNSAYFYDLNTKLNFNIDDKNSLSFSGYYGSDYVNINDSFTNIYGNAFGILDWRHEFNDKINSKLNFSFSRYNYELDLSLVGFNFQNSISNFDLSYKINHQINSELSLTYGLSSIQYTIDPGEIIPTSADSGINSRDLDNKYAFDNAAFISVNQSLTDNVNIQYGLRVSAFLRMEDETIDIYANDNPLLYDETRDIYVEAQPIDTQEGNTSSISESFINFEPRLGISYALDDYTSIKASYNRMVQNLHLLSNTSSPTPFDVWTPSGAYVKPQKLDQYALGFFKDFENLPFTLETEIFYKSIANRIDYIDGANLIANDAIERSILNGESRAYGLEFYLKKNTGRLTGWLSYTLSRSEQRTPGRTPDEIGVNNGNWYLNGFDRTHDISLTSSYELNPKWQLNANFVLQTGRPVNFPVGQFEFQDLNIPVFEGRNLNRLPSFHRLDISATYTPERQNKNWSTSWNFGIYNVYNRRNAASLNFEQNPTSGQNEAVRFSIFGIVPSVSYNFKF

SEQ ID NO: 19992 - protein, 712 aa, Wolinella succinogenes
MFKRHTSGQRFPAWALSFCSLLSAAPGAACAAGPEQELPAVEIRSRRHPHDPRPEHVSTATRADADPRDVPQTIDTVSVEETLSYGGRTLADALAGVPGISNASDTRFDAFRIRGFSGSGDLLLDGMRDDAQYVRSLGNIEHIEVLKGPAAVLYGRGSGGGVINRITKQPLAEDFGRLSAATGSYGRLGAAVDVNRALSREWSVRLNAGREHDGSFRNAVDGTRQYVAPSIKWQDVRRSWLMQFEYDSYERVPDRGMPASVAALDKAGKPLSFSLPPASREKFFGAAGRDSIRDANLNWRSVFKQQLGDAWQVQHTLSVLDLRSSFDNTYVTQSYLTKPRDYRRVQRTRYLQDMRHLNVQTDLELTGEFATGPLAHHLLFGIEYGWQRRAPKLWQADAAPVSIVDPDSNALAGSPPRPFAMNRHRVDDYAVYVQDRIDFGRSWKLLGGLRGDRFDVDSTNLLAGLRARRTTNAWSPRFGVVWAPVDAHHVYASYSKNFAPVGGDLIGITPGARGNANDLGPQYSNQYEIGVKSDWMGGTLSTTLAVFQLDLFNRRVADPVRPGFFDLTGLERNRGLELSVAGRLAGDWLVRGGIGWQNARVVEAEPKFAGKRSAGVSSTSGNLFVGYAPLFGFFAELGVIHEGARYADRDNLLRLPAYVRWDGKAGYRTRDLELTLAVVNLTDRDYYASATSLSQIMPGAPRTFTLTAAYKF

SEQ ID NO: 19993 - protein, 716 aa, Porphyromonas gingivalis
MKRLISRTLIRLLLILCIPMSLAAQRQIAGTVTDTKDRPIVLANVYPINSFDGMATDSLGRFRFTTSSTFPMRLVVSHINYHSDTLTIRKGDPMENIRIRLRETDDYKLSEVVVSVSAFGVGGKQNKTVLNPMDVYTNPSGNGDLSMALRQTPGLQDVGDREGFFVRGGASWETAVTIEGIRVKRFFGKNRFDAPARSRFETGMFSGLSLSTGGYGATEGGALSGLLRLRLAGKSPSSVGIGISPLFVNGGGGHLSRSNRFYIEQNASVSDAAYIRLLLKPEYKLPGTNRSYAYNARTIWNPTSQDEVKGLFLFVHDLSSSALRIPSPATAYMLYAGRNTYGFGMAVWRHDFEGGKTTSTLSAGYSEDHNRLHRQLEIEPDIESTFRTVERDANIRLRFDSRIKAWRLSYGSDYTYSEAKSSVREDKSSALPTLREHLVAAYAEALFPLSNRISATAGLRAEYSGLTESAIVLPRLSATYKLSPSSRITLDAGGYAAPGDYYLSHRIVPQKREHSQQYNLTYEWRPSRTQVLRFQAYDKEYSRLTTLAPDGTASNLGKGYARGLDFFWKASGLIRSFEHWFSYSYTDARRQYLFSPDQERPDFVAKHTLSTVLKYWCAPISSLFNVSMSWRSGMTYHDPNIASPAYLNASLPANFSMSASYNYPFKYKKAGGVLVFSVHNLFNSDPTYGYRFGGQNPSEAYIHRLESLPLTDSFIW

SEQ ID NO: 19994 - protein, 1000 aa, Porphyromonas gingivalis
MKRIFTKFSVLAFLCFLFTNVAFAQNVTIKGKVTDGGDNTPIPSVSIRVKGTTTGAQTDANGNYSISAAANATLVFTYIGYTTQEIPANNRTTINVALASSAQNLEQVVVVGYGTQRKLDVTGAVASVKGEDIGKQASQNAVSALQGKVAGVSIANSGTPGASPTITIRGTGTIYGNTAVLYVVDGVWYDDINFLNPADIANISILKDASAQSIYGIRAANGVVLVTTNRGKKGDPVINYNGSVGFQKVTNAVEMANATEYATAVNESYAILGQAPLFANTNLGKGTDWYDVILRDAMVTNHQLSVSGGAEKSTYNLSLGYLDQDGIVKRNNYKRYTARLSHDFQIFEPLKIGYNVTGTSSKSKDAPSSIFRALYAASPVIPVFKEDGSYGDPNDFSLGNGSNVNPQATLDFWNQTTSKYNFTGNIYAELKFLKNFTFKTSIGGDMGQEEVLGYIPVYRASASQLSTNSQLDVDRIETRNWIIENTLTFDKKWDDHSLTVLAGQTAQRRKSYTINAQTRDVPFTTDGDLYLKLGNASKSTITDLGSLATFASYFGRVNYSFKNRYLLNASIRRDGASQFFGGGNLWGNFPSVGAGWVISNEDFMKDQKIFSNLKLRGSWGKVGNANVPLNPTTRVIDQSAGLIAIIGGLPQTGANERTIVPPSLVWEKSTGTDIGLEMGFMDNRLSVEADYFSRKTEDAIFEIPVFGSLGTANSVILANQADIKNSGFELAATWSDQTESGFKYSISGNIGINNNKVLNVSSGSNPIDKGGATITSGYLSTRTVINRPIGNFFGYEVEGIYQTDAEALPFNKKAGDFKYRDLNGDGVVSPADRTFLGNPNPKYTYGINTNFAYKNFDLTIDIQGVADVDVFNANLSNRFGNENFTKDFFNNRWTGAGTSNSYPSANLAGNMNNAPNSFYIESGSYVRLRNMQLGYTLPTAITSKWKMQRLRVFANAQNAINLFGYKGFSPEVGGAPTNAGVDGNVYPLYATYNLGVNLTF

SEQ ID NO: 19995 - protein, 821 aa, Porphyromonas gingivalis
MAEKRRDVSCAAAARRLDAAARALLNWRRLGARALRARLNGKQGATSARAEPTCAAPATVSDRIGADPMPAALSMRRHGRDGRPPARCHCASRAGRRGGDVASPDTGRGGEADVFVSVMRRLRGSGRRSGSTGSSFMRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDAGDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 19996 - protein, 1092 aa, Porphyromonas gingivalis
MEIKSRVTRFAGLLCIAGALQGFPVIYSANPGGIISVARQGTYHLTGTIVDGYGEPVIGANVVEKGTTNGAVTDIDGKFSLEVAPDAVLTISFIGYISKEITLKGEKELKVALVEDTQTLDEVVVVGYGTQKKVNLTGAVEQVTSEVFDNRSVPNVTQALQGSIPNLNIQLTDGKPTRSASYNVRGTTSIGQGGSALVLIDGVEGDPSMLNPNDIASVSVLKDAASAAIYGARGTFGVVLITTKEPTKDKTSITYSGNFAMQKPVTVPDFVTDGYEYASHFYEAYHAWNNYSADPKNINKTQEFSLGWLEDFKRRKEQGITDEVTVDATGKYVYYGNEDYYDALYKKTTFAQDHNLSVTGNNGKLNYYVSGRFYGYDGLFRYNTDNYKMMNLRAKGSVQVFDWLKIENNMDFSNMDYHNPINVGEGGSIWRNISDEGHPTSPIFNPDGSLTFSAAYSVGDFIYGKNGIDTNNKVLKNTTGFTASFLENKLHVRGDFTFRNTDEGQTQRRIPVPYSTHEGQTVELSAKYNDLKESNMRTEYIATNLYADYEDTFGDAHYFKGMVGYNYEQSTYKSTYVQRNGLLLDDSENINLALGDAITTSGGYNRWRVAGGFFRLNYAFKDRYLLEVNGRYDGSSKFPTDQQWAFFPSVSGGWRVSEEAFWKVNPDLFSNLKIRASYGSLGNGNVSPYSFLELLSISTSGRVLNGLKNKYTSAPAVMPDGLTWETATTTDVGLDFGMLNNRLQFNGDYYIRKTTDMYTVGETLPDVFGASSPKGNYADMTTKGWEITLTWRDQFTLAEKPFNYEIRGTLSDYISTIDRYNNQTGNLDDYYAGKRVGEIWGYVTEGLFKDQADIDSHADQTLIQSSSKRITYPGDVKIKDLNGDHVIDYGNNTVDDHGDKTVIGNALPRYAYSINLSGDWNNFFLSAFFQGVGKQDWYPSSECIFWGQYNRPYNNMPTWHQGNYWTEDNTDAYLPRYAGYNASLKSTPQTRYLQNVAYIRLKNLQFGYTLPQPIVSKAKLQNVRVYISAENLWCWSPLYKHTRDLDVTNIYGSDPDLTDADMSSGLNGNRGSGDGNSYPQMKSVSLGLSVTF

SEQ ID NO: 19997 - protein, 646 aa, Porphyromonas gingivalis
MKSVVTKQALIGLLFFSISIYSHAANPPAQPTDTIVSGNIALEDIVVTGSRTARLLKDVPVPTKVFKAKDIKAIAPSSFIDVLQYILPGIEFTKHGSRDQLNAQGFDESSILFLVDGELISTGSTSGIDFERINPDDIERIEVLRGASSALYGSNAIGGVINIITRTAKDPFRVSASARYDSRDGQKYDVAAGVKRGIFTSQSGVQYRADKSYILADQFEQELNVAGNTTWNINQKFTISPTENLSFNLTGLVNLRKQHWTDKIDFLYNSYDVKAGANWRISETSDLDISYHYDKYSRDTCLIKTENQKKLPIFDEDMHHLRAQYNLNLAEVHLLNVGLEYIHDNVASPRLSSPNDPGEKSVNNKILYGQYIYKVTPKLVLSYGGRLDKHSGFGLYYTSRLSAMYKCSHVTNRLSYAEGYRAPSLQEMYFFFNHGAFFIYGNPDLKPEKSRMLSYSAEAHWNKLTLMGNVFFNHVRNRIDFTYKGTDLIYTNVSKEMRIFGFEGQANVVLPYGFGFRASYSYTYDRWKATDKAGTEMKLSNTRPHAATATLSYGHNFSKNYRLASNFSTRFLSDLKTGRMNSNELFEEITYPGYTICRLDIENHFYRNYTLHIGAENLFDYKPKALAFNSPTSPGRIIYGLVRITF

SEQ ID NO: 19998 - protein, 1012 aa, Porphyromonas gingivalis
MLCLFLFQGVIAQNKMLVGTVVDELGETLIGVSVLNKTTGEGTITAIDGSFSLSGKQNDLIQFSYIGYASVDYVVKQEENIRVVLKEDTQNLEEVVVVGYSAQKKSSLTGAIAPVNMDDMEKRRVATVSQALQGQVAGVQITQSTGAPGDDISMLIRGEGTIGNNSPLYIIDGVPSRTMTFLNPSDISSITVLKDASAAAVYGSRASGGVVVITTKEGEVGKGHLELNYYYGIQKVANLPRMLNTQQYMDVQEIAWNNAGYEGSNPYTIDKKRTDLADTDWLDELFTLGQTHNIQATMSGGSKGVNYLLSAGYISQDGIVVYDNDRYRRFSLRSNINAKYYDRLNIGANVQLTYSIQDKLNSKGDAPGIIRHAMLRPSVLSVYKDVNDPTYKANDPFTDLPFYKNNDRNGGWESSKYEWTSNPIALAYYTDDKRSQYTTFGNVFAEYEFLQDHSLKFKTNLGIDLNLYHNKAFNQNFGDDDGSGSDVDKGLGRQNRPSNLDESRGESFTLTWNNTLSYAKQFERHNINAVAGTEFISNYESSIGASRQRYDYTNDTFRYLDFGGTESDIWNSGSGSEWALMSVFASATYVYDNRYMITGNFRADASSRFASNHAWGFFPSVSAGWKMSEEKFLKNISWLSDLKLRGSWGQLGNQEIDNYTFMTLLKKDGDKYVISRYGNPDLKWETSEQWNVGVDLGILRNKLYLSADYFMKTTSDILLPISLPSYVGSVSPTIVNAGTVRNKGFELSLTYRDKVGDFNYSINGNIATLDNKVLKLHPNLPNIDGKVTRTTVGQPLNAYYGFVMEGIYQNEAEINEQLYATDNPTVQPGDIRFKDLDNNGKIDDNDRDFLGSPIPRFTYGFTLNGEYKGFNFSMLFHGVQDVQHFNDLKKILNYDTRPFNHTTEMLGYWHGEGTSNSIPRPSFTDNGGSRISSIFVEDASFFRLKNVELGYSFAKLLKKINSPISDLKIYVSAENLFTVTSYSGLDPESTDLIDYGTYPQARSFLFGVNVKF

SEQ ID NO: 19999 - protein, 638 aa, Porphyromonas gingivalis
MVLRLNFAVVASLSFISTLCCAPAFAESNAKEQSLEEIIVVANRSEVPIRQVGSTVSVLTEEDLAIRQNSLLADTLRSVPGVQVSQSGGLGKTTSVRLRGEEAHRTLLLIDGINVADASSVQIAPHFEDLLSSQIGRVEILRGPQGMMYGADAGGVVSLSSKASTKPFEADLALEGGSYKTHTQAGNIRGTTGALGYSLSASNLSNEGFNVREVDTENEKDGYQNTTLHGRFGVQLTDSTGVELVLRDVDAEAEFDGCGWPTSMDCLAESQSRAYRVAVHSTEEKYQQVVSLSKNTIERANIGLSDGSVSLDSRGEVSQLQYLGRYHFNNVLKFVFGADRKEEAFYNLLSEVEQDRGNNGVFVDAQVSLTDSFFYTIGARHDDNEDFGRHTSLRLTGAYLLPVSHGELKLKGSYGTGFRAPSLYEINYNNGSYVAEDAPKSFVEEQSKGFDFGLEWQLAGESYIEAVLFSTTIEDEIYFDLANFCCYLQDEGETDSKGFELSGAWEQSEHLLLGANYTYNRTSLSDSTTLSGAKGGDPRARRPKHIVNLSAQTFWLEKRLQLALFMRSISNSVDYPFGADSAKALDDYQVLDFSARWTFDSTAQAYIRASNVLDENYQEVDGYNTAGASAYIGMRLSF

SEQ ID NO: 20000 - protein, 766 aa, Porphyromonas gingivalis
MKKNFRRLPLAVAISLALPALALAQETTLGRVIVTAPEAAATNSGTVVNAPALQSLKPATSDAASLLRDVPGVSLYGSGGVSSLPSIRGLADDRIRIKVDGMDLIAACPNHMNPALSYLDPSNVGLLEVYPGISPVSVGGDSIAGTIVAESKAPVFAEDGKTLMTGEVGAFYRSNGNARGGNLGATFASDSLSVSYAGSTAESDNYEAARAFKTRTATGRVGHTLALDEVGSTAYKSRNHELGFAFKGGDHLFEAKVGLQDIPYELWPNQRMDMLENDQKRVNLRYQGKYDWGRLEARAYHEKVEHFMDFGADKRYWYGGSVANDVIIGSGGPTVLNGTPCSPLSPSCAAGMPMNTESKNTGFALKGDVDLSATDLLRVGAEIQRYRLDDWWPASGGGMWPNTFWNINDGERDRNAVFAEWEAQPSAQWTTLAGVRYERVKTDTGPVQAYNNAVAPATMLVPAFNSADRERTDNNWDVTLLAKYTVDPTLDVEVGFARKVRSPSLYERYSWYSRGMEMLMVNWFGDGNGYIGDINLEPEKARTVSATFGWHSIDRKWELKATPFYSRVTDYIDAVRCPTSLGGSCSAANLSATNSFVFLQLANQSARLYGIDLSGRMPLASTPYGEFGLRGVLNYTDGKNRETGDNLYNIMPLNVKLTLTHQHGGWDNALEWFAAQSKDDISAVRNEQETSGYNLVNLRTSYSWKQVRVDFGVENVFDKFYYLPLGGAYVGQGTTMTSNPVGAVPLWGTPVPGAGRSIYAGINYKF

SEQ ID NO: 20001 - protein, 858 aa, Porphyromonas gingivalis
MRERVSMSFAASRAVRLMLGASLACIAGVAHAAQNAAADPAQQATEDQGQLEQIVVTAQKVEQNLQDVPVAISAISAEKVATLGIRDARDISGLAPNVTIVQGTTNANAAVISIRGIPTPASETFGLDTSNGLYVDGVFIARSGGSALDVIDVARVEVLRGPQGTLFGRNTTGGGIAFISRAPSKDFRLSAEAGYGNYNAFNGKITLDPGEIAGISTSFTYSHRERHGVVDNLNEPSDARDPGARKGDSFRVAAKAEIGGTGSIQYIFDWSKIDASPINFQLTNVADGTVRPPLVVNGVPIVVTQQAPVSQYLAGVTFLDPRCEALAAPTREWRDTVCNDINSRSTDKAWGHNLQVENDFGAFRVKSTTGYRFWNNDSTSDLDGIGAFTGPAFTNASLFNGMPVGLLQYIPSIPEAARPFIAAATVPTIQQNLFDTNNKRRHKQFSQEVEIGHQGDMLDWVVGGFYFWEKGSEDNPQNSGYVLDTNSIFTQNFGPLGPLFVAANPAQYRLVQTKSVLRYTASAESTAIYGQATFYPGGKDSGIRLTAGGRYTWDTKKMIRFQNGATVPETPDVGNASYSKFTWNLMLGYDVADGINLYGRIATGYRSGGFNAQDPAVEGVLPSFKPENVTSYELGLKSELFDRRVRFNLAGYYNEYKDLAVNVPITNLAPGTFATKVTNAGKVTYTGVEAELTAVLTDNFTVEGNLGYVDIKYKQFLAGLPVEANQPLVDIAAYATPGYTSPFTANAALNAQFPLSANGMRLTGRVSYTYEDGKYSFTNTISSPYNDILKGDDRNIVDAQVAIDRIPLGGGEGVIRLWVKNLTDSHDLVRAIDFGQLGYGGGYYADPRTYGVTVGVKF

SEQ ID NO: 20002 - protein, 827 aa, Porphyromonas gingivalis
MKEAIPRKNKHIKLNGIYRLSFILLCSLLCSQAAMAQSVRVSGYVLDRGEKPIPFAGVKVRGTGTGATTNLKGYYEFRMKATTDSITIEFSSMGYQGVSRSFPSLTKDTRLNVRLAEAEMELSSVTVQATKRRLNTMERVNTRDLRVNAGPTGGVESLISTYAGVTQNNELSSQYSVRGGSYDENMVYVNGVEVYRPLLVRSAQQEGLSFVNPDLTQSVQFSAGGFTADYGDKMSSVLDIRYKQPQEKEGAVLLGMLQSSAYYGSSAGAFSQITGVRYKSAKSLLGTTDTKAEYDPIYADGQTFMTYRFSPKLSVSFLGNISQTRYKFVPQTRETSFGTQSDAKKLKIFFDGQEQDRFLTYFGAFSMNFVPDDKQRHTVTLSAFNSNERETYDIQGEYFLNDVQLGADGTASMASGSENSNGLGIGRNHEHARNRLNYRVLNMGYRGEIKLNEKHRLQAGVSAQMEKIADHISEWERRDSVGYNLPHSETVLLMYNNLYADTQMRGTRLSAFVQDRFNFSMGGGTFSLIPGIRASWWSFNKELLVSPRISMGYSPESNPALVLRAAAGLYYQAPFYKELRLTYKDAEGNNVVVLNEKIRSQGAFHILAGADYTFEMGGRKYKFTAEAYYKSLFNINPYIIENVKIRYLGENIGSGYAAGIDLKLFGELVPGVDSWLTASIIKARQKLDGYGSLPLMNAPTYNFSFFLQEYVPGNKRITATLRAALSGGLPQLNPSKGLSSPAFTAPAYKRVDLGVMYKWLDPDDSFAGRSKWLMRVKGAYIGADLFNLFDMTNVNSYYWVSDAYQQQYAVPNYLTRRQFNLRLLVEF

SEQ ID NO: 20003 - protein, 258 aa, Porphyromonas gingivalis
MMNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRHAEQLPALFNGMPMGTRILA

SEQ ID NO: 20004 - protein, 1017 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTTSGDPTAVASVEIHGTGSLGASSAPLYIVDGMQTSLDVVATMNPNAFESMSVLKDASATSIYGARAANGVVFIQTKKGKMSERGRITFNASYGISQILNTKPLDNMMTGDELLDFQVKAGFWGNNQTVQKVKDMILAGAEDLYGNYDSLKDEYGKTLFPVDFNHDADWLKALFKTAPTSQGDISFSGGSQGTSYYASIGYFDQEGMAREPANFKRYSGRLNFESRINEWLKVGANLSGAIANRRSADYFGKYYMGSGTFGVLTMPRYYNPFDVNGDLADVYYMYGATRPSMTEPYFAKMRPFSSESHQANVNGFAQITPIKGLTLKAQAGVDITNTRTSSKRMPNNPYDSTPLGERRERAYRDVSKSFTNTAEYKFSIDEKHDLTALMGHEYIEYEGDVIGASSKGFESDKLMLLSQGKTGNSLSLPEHRVAEYAYLSFFSRFNYGFDKWMYIDFSVRNDQSSRFGSNNRSAWFYSVGGMFDIYNKFIQESNWLSDLRLKMSYGTTGNSEIGNYNHQALVTVNNYTEDAMGLSISTAGNPDLSWEKQSQFNFGLAAGAFNNRLSAEVDFYVRTTNDMLIDVPMPYISGFFSQYQNVGSMKNTGVDLSLKGTIYQNKDWNVYASANFNYNRQEITKLFFGLNKYMLPNTGTIWEIGYPNSFYMAEYAGIDKKTGKQLWYVPGQVDADGNKVTTSQYSADLETRIDKSVTPPITGGFSLGASWKGLSLDADFAYIVGKWMINNDRYFTENGGGLMQLNKDKMLLNAWTEDNKETDVPKLGQSPQFDTHLLENASFLRLKNLKLTYVLPNSLFAGQNVIGGARVYLMARNLLTVTKYKGFDPEAGGNVGKNQYPNSKQYVAGIQLSF

SEQ ID NO: 20005 - protein, 617 aa, Photorhabdus luminescens
MNNKKVFFLSSVALSVMTSSFNLFAQADNTLSVTANRFQQPTSSILAPVTIVDREQIDRWQSNSVLDVLRRMPGIDVAQSGGIGQMSSVFVRGTDSRHVLILIDGVRTNQAGISGSYDMSQLPLSLVQRIEYIRGPRSAVYGSDAIGGVINFITKRQNDGLTLNAGIGSHGYQNYNGSIQQKVGERTTLSAAGGYTYTKGIHATDDSVPVAAPFHDRHGFMSKSYWFGIDHIFNDNFQGYMKGYGYDNRTTYVASYPGNTDQSKTYNRNYEAGIKFSGDSYFSQLITVYSQTKDYNYISTNGRDGKGSSVDNSKQYNVQWGNTFLIPSGMISAGMDWQRQTIEANSASVPHQRTIDNTGLYLTSQKQLSSVIVEGAIRSDHHDEFNWHTTWQTSASWEFVDNYRVIASYGTAFKAPTLGQLYADNPAWNTKGNPNLKPEKSKQWEVGVEGLTQGIDWRLSLYQNDIDNLIAFRDNTYINYNKAKIKGAEWVGEMDTGLLHHQLTLQYLDARDSDNKLLSRRAKQQLKYQVDWNIADIDIGINYQYIGKRYDTDFNQYPTKRIKLGGVSLWDLTASYPITSHLSIRGRIANLFDKDYETAYGYRTPGREYFLTGSYNF

SEQ ID NO: 20006 - protein, 652 aa, Photorhabdus luminescens
MMPKPLERKPLALCITTALLMSNFYCTTAHAETFLATTTLYYYGSGNSNGNNSDFTNYDEVNITTSDWGTTSGGLKGWAIYMNGENYKFNDLTVKTTGMMADGIHTKNGGGNIVIENYNAITSGYSSDGINLGRELNANYSRVTVNNETNIKATGMGVRANASINNANAVATITLNGPTTIETTSAGSTVAGYAVYAGQDTEANSTAVKGKAEIFLNGDSTLKTVGKSAHAVYARAAGTVSLGNVNISAMGDLANGLFASSSSAGQQAAIYLAKDAVINVGTGSAVYASGAEALVKSYDIDSGTEVAGVYLINGNIVADNDGQVSLHMADGSVFTGITNSNQLATSAANAGDIALQIDGSNSLWKMTGDSVLSSLTLNNGTVEWAGASAGNVLTVAGNYQGNNGLLRINTVLGDDNSVTDKLVVEGDTSGTTFVAVTNAGGSGDKTINGIEVIHVDGASDGNFVQSGRIVAGSYEYALRRGEGTAFNHWYLMNAATTPEEPVPEKPTLRPESGSYIANLAAANTMFTTRLHDRLGETQYIARLTGEQKVTSMWMRNVGGHTRFKDSSGQLSTQSNRYVLQLGGDIAQWSTNGLDRWHLGLMAGYGNSQSNTKSDVSRYHSRGQVTGYSAGIYGTWYANEADKTGSYLDSWIH

SEQ ID NO: 20007 - protein, 871 aa, Photorhabdus luminescens
MRTTASVLALLLAASAGAQAPDAGSPPPTDAGGPTGVLTRAPELKRQVEAPYPPEALARQLEGTVVMLIDISETGAVTDVQVTEPAGHGFDEAAVAAVRQFEFEPAEVDGVPAPVRIQYAYQFVWRAPAPVEGSPEAPVEAPVNFSGRALERGTRKPLAGAEVALPRLEQSTTTDAEGRFSFRGVPLGSHEVLVVLGGYERFRTQESFNEGQQTQATYYVRKRIFSPYETVVRSERERKEVTRTTLQAAEIQKVPGTQGDTLKVVQNLPGVARPAFNGGQIVIRGTSPNDSGIFLDGQRIPLLYHFGGLTSVYNSELLDSLDYLPGNFSAYYGNVTGGVINVRSRAPKMDGFHGTVGVSLIESNAVLEGPLTENLGIAVAGRRSYIDLVLKAIPENEDGPSIQVAPRYYDAQLKLHWTPHKQHTFTLQGLISNDVLGLVFDRPADDDPSINGAFEITTGFKQLRLGHQYKAGRFNLDSQVLVGNTLIEFIVGDRNLRISSLDLGLRSTAEYAVAEPLTVAGGLDIDFARADVRARLQSLPREGEPPAPLLLEEILTVDGNFLQYFPGMWAELRWKPVKDLLVVPGLRSESYVFENQEVRKRSLNPRLAVRYALTDTVTLKGGAGIYHSPPSQDEPSITFGNPELKAKRSKQYSVGSEWQPTPEYFLSGELFYNDLSRLIVRSDRQVERDGQQVPERLSNQGTGRILGFEVLARRVLTERFFGWVSYTFSRSQRRDRPGERLRLFDNDQTHVLTAIASYKLPAGWELGARMRVASGNPLTPVTGAVRDDGTDVFIPTFGPVNSERLPTFHQLDIRVDKNFVFEQWNLNVYLDLTNAYNHPAKEGILYNYNYTESAFLKGLPLLPILGAKGSF

SEQ ID NO: 20008 - protein, 728 aa, Photorhabdus luminescens
MEKKVNQASRRRIAPPTTHRALRALSASAVLCMASGAIYAQEATPQVEDTVVVKGKALTGEAKAKLKLNEVSGATNFISSEDAERRSVRTAQDILAYQPGVFAQAASGGGDGIKISIRGSAINRGGGNSFRTGTYFLFDGLPVSGPGGTPYELFEPLGLEYTEVLRGANAFDYGANTLGGAINYVTKTGRTADPFAVHVEGGSFGYHKVQLSGGKVIGPLDYYFSITEASRDGYQAQSRSSSNGIAANIGYQINPDVQTRFYLRYRETKNQSPGNLTRAQIDADPRQANALAIAQNALRDQPGSTWLANKTSIRLDGSSQLDLGLVYHNYPIDSRPSNAVATNATIQDWGFEDVSASAQYSRSDTWGGKVSNSKIGFVATKHLDGYRNSYAARTSVNYPAGSLVHKAEYGGSDFVIHASNDLELAPSLWVTTGLSAINTERDTVVTYPVTNQPYSTSRWDFAPRLGLRYNFTPDLQVFGNIGRSVEPANSWAFLTAPPNFGNLGATGPLASFAVRGYDLKNQKATTAEIGARGAVNGGQWSVALYRSELKNELQTVETFPGSNVTLESNASPTVHQGIEAGADLPLWQSAGQKLSLRQAYTYSDFYFRRDPVFGSNQLPAIPPHYYQAELLYVHPSGFYAGVNAQAASKTKVDYASTFAVKGYTVFGASAGYVHPTDGWKVFLDLRNLGDKRYAASVSPTFNAKGLDTASSVPGDGFGAVAGISYAFR

SEQ ID NO: 20009 - protein, 656 aa, Photorhabdus luminescens
MRKGLKISLALLGVASGFVYGDEPTEVRLDEVTVVSATGFEQNIKDAPASVSVITQKEMARRNHQDIESVVKDAPGVFGATLGAASRRGITMRGLGQKYTKILIDGRPATSDSAYRGLRAIGSAQNFLPPANTIERIEIVRGPMSSLYGSDAMGGVINIITKGFSNEFSGNVNGYYTLAGKSGINDDYQTGFYANGAVIPDVLGIALYGRYFHKFEDERAFTNRKNEDINFGAKIMYNATENDEIALDLRRVVNKYERTEGKTLNRTASDNTSVAFEKMSGYTASLSHTGKYDKLLLESFLMHDNMKESGQQDLTLKTTTLNTKGTYFFDNNTLSLGAEYRRERLNEKATTADAANVKRYDFSLYGEDDFDVTDALTLTAGLRYNHDKDYGGHVSPRGYAVYHLSENLSLKGGVSAGYSTPDIKMRTDGLALPFAGGMGAQLGKSDLKPESSLNYEAGVAYGDESLNVSAMAFYTRIKDGLGTKPVCVARPGVPCVHNGKTYRRGIWESVNIGKAEVKGVELASDWQILSNLALHSSYVYTRSKQKSGAYEGKSLNNLPVHTVKLGLDYDMTPDLNLWTQMNYLGKTRAVYGSPGDEEIKDYTLFDAGASYKITKNASVNFSVYNIFNEYVTTKSGRYEILIADGVKYRLGFNVNF

SEQ ID NO: 20010 - protein, 672 aa, Photorhabdus luminescens
MPLFLLAAFNGYAAETTSDSHEHQNGPKINDGDVITVTAPLRSPLAIVTSPKTPRQPVPASDGSDYLKTIPGFSQIRNGGTNGDPVFRGMFGSRLKILTDGSEMLGACPGRMDAPSSYISPESYDLLTVIKGPQSVLWGPGASAGTIRFEREHPRFDEPGVKVNASGLTGSNSRWDGNVDASIGSELGYLRLMGNKSRSDDYKDGSGYRVPSRWDKWNSDLALGWTPDKDTLLELTAGKGDGEARYAGRGMDGSQFKRESLGLRFEKSNISEVLDKVEAQVYYNYTNHIMDNITLRSPNMGMSSSTCKHMCGMHMNMNHGMSMQLDRRVVGGRAMGTWLWQDFKLEGGADTQTNTHRNKAGGAWQKDAQFRNYGLFSELTWYATEQSELITGARLDRTLVKRFAGNSEKERNDTLPSGFMRLEHTLADVPLMFYAGVGYTERFPDYWELFSPKYGPAGSASAFDGVKSEKTTQLDIGAQYTSERFNSWVSAYVGRVNDFILFRYSPHNARISQADNVNANIMGGEMGFGYQLTEHWKTDASLAYSWGENTTDNKPMPQIPPLEARFGLTYERGDWSSTGLWRLVSSQHRIAVNQGNVVGKDFESSPGFGVLSANVAYKVNKNVKVSAGIDNILDKEYSEHLNLAGNSTFGYSANTSVNEPGRTVWAKMNVTF

SEQ ID NO: 20011 - protein, 888 aa, Photorhabdus luminescens
MTGHFRKSTLAQAVLATIVTATAALPVAAQSVKESSSTATSEAREASTLDAVIVTVERREQDLQKYAGTAQAISADDTRALGINNELRNIQALVPGMSMANQEGNLEIFIRGVGSSNNTELGDPGAAPHINGAYIARPRGLGGMFYDVERVEINKGPQGTLRGRNALAGTLNIITKRPDLEAFGGYVQAEAGNRDHRGGEFALNLPIGGGAAFRVAGYKVEKDSPFKNAGRAQDLEPAGVQDDRGARLSFLYQPDDKLSIFAMADIGKEGGTGYPGANVYTAAKAGYLPDDVDLRKIIYRGAQGKLDSTNWGAQTSISYDFGKVAVEYNGSYRNVDYRQTNAQSEGILWPNRNIDPVSPSNPGGIDYDNYSTQYWLTESESQVHELRFTSDQDERLRWTTGLFHFNEDQRVGYLSLVDKGRWYSGTEFTMPKVNGKSSAVFADGTFDVNDRLRLKGGLRYSEEKKSRYGIGGNWSLGLPGQGGDFATRLGTPGFEPAFMSRPNFDVSNITSQAEMARFLLQGVLRHGRNDTLLQQIGAVPDGGPFGCVDRPDIGGDTVDCPYQSWAQVSAIPAQQFGKSKFSFTDWRAGFEYDVSDDSLLYGLVSTGHKAGGFNDTFDPKEIPETFKPESIIAYEIGSKNSFQMLGRTSTFNVSGFYYDYSDQVFQDLAVIATNPTTGEATGYALVNRNVGKSAVYGLEAESTLRLPHNFMVNINALWMDSEIKRGTVADVRSQNYDAGGATSLIDLSGNELPLASKLTFNVRLQHTTELRFGTFDWQLLASYRSAFYLTQYNNRDVEFIRQDPATGELVHDRTESAAAAGFPDRQKGETTLNAGIGFTSLSGNWRVEAWGNNLLGNDVSQKALVGSGINVRFLNDPRSYGLRLRYQF

SEQ ID NO: 20012 - protein, 1193 aa, Photorhabdus luminescens
MKRAERIVLGLLFLAAILPNAALAGLSAQNVDFGSVREGVSVTKSVTVSNSTPGFHYLLDPSGAGATVTVAPGTCPSGAASGTVGSCQVQVTVPAGTELGSGSDTASIAYKSDDMPFQSDDAGLTISSLMISVTYTVIAKADSDVDGVPDSTPDLCPNTPAGESVDITGCSESQSLYDVTATAGANGKITPDGLRQKTEGGRLSYVLTPDAGFTASVGGTCGGSLSGNFYTTNSITADCTVVATFSATTVNIVATAGPNGSISPSGSQAVTPGAIASFTVTADLGFTPTVAGTCGGSLDGSVYTTNSVTEDCTVNAEFSTQANPAEDDDDNDGVVNSLDKCPNTPSGEPVDASGCSASQLETDTNTDTDGDGVADNVDQCPNTPPGEAVNSSGCSASQLDTDGDGVSDDIDQCPKTPAGESVDAEGCAQSERDDDGDGVANDIDQCPNTPPGEAVNSSGCSASQLDTDGDGVSDDIDQCPKTPAGESVDAEGCAQSERDDDGDGVANDIDQCPNTPPGVAVDSQGCSKTEQDDDGDGVANDADQCPNTPAEESVNASGCSASQIDTDGDGVSDDVDECPSTPAGESVNASGCSASQIDTDGDGVSDDVDECPSTPAGELVNASGCSASQIDTDGDGVSDDVDQCPNTPAGESVDASGCAQSETDDDGDGVANDLDQCPNTPAGESVNASGCGASQLDDDGDGIANDIDQCPNTPPGETVDAQGCSQGEKDSDGDGVANDIDECPNTPPGTQVDETGCPTKEQVLDSLLDAAGGDDQLGATSEAISDACTSDELSGQLLADCQALIGASIEKESGVNQALNEITPERAVQANAQVQRANTVQDQNIGNRIAALRAGARGISVDGLSFSNGESRLNGGHLASAVDDILMPASGASSDEEPMLLANSRWGVFLSGELSKAERDESTNSSAFKMDTTVLSGGLDYRVSDNFVLGGAVSFTDGETRLADDKGNLDARGTSLSLYGSLYSERLYLDFSATYGDSEFDQSRRLGYVLGNGTQVKQSMRAEYDGETTSVHLGVGWDAIQTAWIVTLRASLDYLDSEIDPFTEQASDTNGSGAGWAVAIDGQSQDWLTGRLTGSVSRVVSASWGVIIPYVEFDVVQEFANDAAFITGNFAADLDGSKLIIAVDEPDKSYYRGRFGASVQLPGGFAGFVDYGRLFAYDRWSEYTISGGLRYEF

SEQ ID NO: 20013 - protein, 424 aa, Photorhabdus luminescens
MVMNQKNLFTRSALAAAVAIISSNVSAAGFQLNEYSAAALGRSFSGEGAVADNASVGSRNPAAMTLFDRPSFSGGFVYVDPNVDISGTSPLSGRSTSAKNIAPSEWIPNIHFIMPLNEQWAIGASGTSNYGLATEFNDDYVAGSLGGQTDLKTANLNLSGAYRLNENFSFGLGFNAVYADAKIVRHLGEAGGGRLPYSTEVTRMEGTKWGYGWNAGVLYEVDKENRYSFTYRSKVKIDFDGDFSSQLPPPGGTGGAVIPGALTLNLPEVWEVSGYNKVAPQWAIHYSLAYTSWSQFKELKATGTNGNTLFEKQEGFHDAYRIALGTTYYYDDNWTFRTGIAFDDSPVPADNRTISIPDQDRFWISAGTTYAFNKDASVDVGISYMHGQNVHITEKTPTALGGTTYEFDSKGTALLYGVNFNYAF

SEQ ID NO: 20014 - protein, 123 aa, Photorhabdus luminescens
MGVDHNAHTEANGSRIENDANNNIQTRLGFRTFIRTQEKNSGPHGDDFEPFVEMNWIHNSKDFAVSMNGVKVEQDGASNLGEIKLGVNGNLNPAASVWGNVGVQLGDNGYNDTAVMVGLKYKF

SEQ ID NO: 20015 - protein, 687 aa, Photorhabdus luminescens
MKFCSTLLALSIASSFASHADESKDIERITVSSDFRQQALMFIPASATILSDSQIEARQAQHLEDILNVGANINFASGASRGRFIQIRGIGERSQFSEPSNPSVGFLVDDFDFSGIAGVGTLFDVEQVEILRGPQATEFGASAMAGVIKVKTVDAGPDQSGKLSFSLAEQNTWSVGGAYGNAITDNLFYRVAVQQFKSDGFVQNTFLNRDDTDNLDEFTSRVKLKYLPADWLTFDLNYQYFDIDNGYDAFSLENTRESRADEPGFDRQKTHALGLKTEINTELTDVFVILSQSDSDMGYSYDEDWTYVGFHPDEYSSVDSYFRERDTDNVDIRFLSNDNSTLFNGSTQWLFGLYSKSMDESLLRQYTYADGDFTSRYQQDNLAVYSQVDTELSDTLSLRLGLRADRFEIDYSDISGFTQSNDKTLIGGKAVLDYSIDSASVYASVSRGYKAAGFNPDERVSSDKRIYQPEYNWNYEIGVKGNFINYDAFIRMAVFYMDREDTQVSDYDVQTREDGSATFIDIIGNADTGTNWGYELESGWQVNDSVYLHANFGWLDATFEDYTLADGSVVDKQDQAQAPNYTFNIGANVQLSEQVSWTIDADGKDEYRFSDGHDEKSPSYVLVNTAMRFDVQDWSCSVWVKNVFDRTYYVRGFGGFNNDPREGYATPEPYYQLGDGRQVGISAQYNF

SEQ ID NO: 20016 - protein, 427 aa, Photorhabdus luminescens
MKIMTKALNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQVVTFQPTVSYAFNDKVSIGFGPTINRIDGELTSATLNAATPGRNDGKVKIEGDDTAIGFNAGILVQATDTTRLGLTYHSKVDYKLKGKTKIEGSGFGPFGGQKYDASLDISTPESVDFSITQQIDENWTVYAGSTWTRWSRLQDITVNNDGVPALLGGSAGPIGTITEEQNWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 20017 - protein, 985 aa, Photorhabdus luminescens
MSQRTRARVYWVGGASAAAVILSAGLANAQAKPPTGNMVEEVVVTAQHKQEAAQTVPIAISAFSQKTLDAAKIEGGPDLLKAIPNVSFTKTNFSGVNLTIRGIGTQAVSVSTDPGVSINFNGTAFIRNRFFEQEFFDLERVEVLRGPQGTLYGRNATAGAVNIISARPTDLFEGEIKGEVGDYASRRLSGFVNIPLIGDKLDLRLAGASTNRDGFANNTTTGNKIDGRDLYSTRVSLGFKPAESVRANLVWEHFSENDNRARSTKQLCTRDPGIPSLGGMTLSPQTSAFFSQGCLNASLYSDAAYGTPNGLSIPFVLASVTKTAVLGLNPDGFSGSVDLLKAVDPYGGAMQSRDLRQVSSMFDPKYRAKADTLELNVDFDLSPTLTLTSQTAYNRDHYFSSQDYNRFNTQPGVFNDSTGLDNLVVAGTPAPNLTPGGVYCDPQLGCSSTIAGLDQSKAKSRQFSQELRLQSAFDGPLNFSLGANYTNYRTIEDYYVFFNIISAIAQSSGYGNNSLDPTKCGKNFDGSTPTITPGGTTGCIYIDPNPLDQVNGLGHNYFRSQNVYKVSSSAAFGELYYNITPDLKLTGGLRYTRDRKTFTPVPTQVLLSSGNGGTVDGGYPVGEDIKQHWGVITGRLGLDWSPKLSFTDQTLLYAFYNRGYKGGGANPPAIGYSDEPLAPGLPPLVQLTSYPDTFKPEYVNAFEVGTKNTLLGGALTLNTSAFYYDYKGYQVSQIQDRTAINENFDSKVWGLEFESNWRPTQALRLTLNLGYQDSKLADGSKSIDVENRTQGNPDFTVMKANPFLPSNCVVSKAYVTSLIAANVATNQPDYAYLGGVCPGSIASLFLVPAPTEADLPNGGRGFYADLSGHGLPNQPKWTQSLSAEYSLPLSDGWVGAIRGDVYHQSQSWARVYEDAIDKLHGWYNVNLRLTVAKPDSGLEFELYAKNLLDDSPITGAFINSDDTALTTNVFTLDPRVIGASVRKRF

SEQ ID NO: 20018 - protein, 1091 aa, Photorhabdus luminescens
MKKALFFIVCLCFAINMMAQTKTITGVVVDATGEPVIGASVLEVGTTNGTITDVDGNFTIQVPVGAKLDVSYIGYKTQQIVVGVPNTYKVILKEDAEMLDEVVVTGYGMSQKRSLMTNSISKLDDKVLQNAAMSNAAQSLQGTVSGLRVTNTSGKPGSSPNIVLRGGASINKNLEGPLVVVDGLVRSMDDINPSDIESIQVLKDAASTAIYGARANNGVILVTTKKGVEGRTQITYKFKGGVNFAREGYKYLDAGDYLYYQRLGWQRTNGGTSMENQKGFGVNSGVDLAFMTDANKHLLNEGWRSMADPVDHDKTLIFRNHAGELHDLTFRNAAFTQDHYLNLSGGNDKGTFSSSLGYYSEDGQIISTNYQRVNGTINGSYKLLPVLTVNAGGSFSWSKMPDLWTYDLKSPWNGETGEYELFYRTMSMFPTWNPWNEDGSPAAGWSNQDGNPYYWKDKLTRSTTNRKTSFNIGFALEILPQQLFLNGNSSMYYTDSQFELFEKKYQQIGQASNTNRNASQTNTKVFQQQHALTLEYKKGFSGHNINAMAGGEYFDYQYQNLEARVSGAPTDDIPTLNAGTNRTYTTSVKTGYRILSGFARVNYDYNYRYMVSLVARYDGISKLSDNRWGFFPGISAGWNVHEEAFFKDSKFAEVVSLIKPRISYGLNGNVNGIGNFDVYGKYGSVGAYNGNLGYLNTGVVNSKLRWEKSHTFELGLDLGFFNNRIHMIMDYYDRTTSDLLTDVNLPEYTGFPSFKTNLGTISNRGFELEAKVNLLTRKGWSWDVTANTSFVKNMVKKLPFNGNVNNRQGGEQVWDPKSNSLVWVGGIQEGKSLGDIIAYKQVRILRDWDDVRNHAGDFVDEVANLYGPNKAAEYAGKPGWKPIEPGDVLWDDKNGDNVINSYDRQVVGNIYPKWTGGFSTTLNYKNWSLYGRFDYAVGHTIYNDLKARILGQYNGSFNLITDVRNSWSENNTETSIPKFYWADQNAKKNITRSNNGTTNLNNNNSTFYEKGDYLCLREVTLSYKFPKNLINKVFLTDASVYVTGQNLFYITGYDGTSPEPVMDIQANGRGGIDNGRYPTPRTVLFGLQLSF

SEQ ID NO: 20019 - protein, 340 aa, Photorhabdus luminescens
MKRTLLSFAFLLSALIATAQDACLNDVVNTLKDRISLSGYAQVGYTYDDADGSSNTFDIKRVIFMAQGKITDRWLCYFMYSFANTGKILEAYTEYKFLPQLTARIGQFKTMYTIENPMSPCYVELINCYSQSVNYLAGINGSDPLYGSSSGRDMGLLIYGDLFGKLVNYNLAVMNGQGINLKDKNNQKDIVGSLMVHPLDWLSVGGSFVKGKGCAVAVSSLNPDIQVGENYTRNRWSAGAVIKTKPVDVRTEYLAGKDGRIKSDGYYVTASAHVFPKVDVIASYDYLNKSKVLDDKQSNYVVGLQYWFYPKCRVQAQYTYCNRHIGDNSNLLQAQLQVRF

SEQ ID NO: 20020 - protein, 383 aa, Photorhabdus luminescens
MKKISAAVAAFAGLAAATAHAQSSVTLYGLIDAGVMYTNNVKKGGSQGALVQATSGNINGSRFGLRGAEDLGGGLQAIFVLENGYNLQNGKLGQNGRLFGRQAFVGLSSKQYGTFTLGRQYDSLVDFVAPLSGTAGTFGDTGFAHPFDNDNLNHSVRMSNAVKYASANYAGLKFGGMYAFSNNTGFAVNRAYSAGVSYANGPFKAAAGYLQINGSNSSANTAGAVDLGESAANGTGGFQLGADVQRTAGAALSYGFGPVTAGFVYTHSQFQNTASFGATHGSMRFDNYEVNGKYAMTPALSLGAAYTFTDAHVGGTSSFGADPKWNQMNLQAVYSLSLRTDVYAEAMYQHVSGKGYTAFINTAGGASSTGNQVVGTVGIRTRF

SEQ ID NO: 20021 - protein, 841 aa, Photorhabdus luminescens
MRKKVLLALTASLICQESLFAKDKDYTLGKVSTVGKKDKSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIGLDIFPVTFQAIDRIDVIKGGGSVQYGPNTYGGIVNIITKPIPNKWESQAAERVTYWAKARNAGFAAPPDKTGDPSFIKSLGNNLLYNTYVRTGGMINKHVGIQAQANWVRGQGFRDNSPSNISNYWLDGVYDINENNGIKAYYQYYDFSIAQPGSLSEQDYKMNRFANLRPLNQKGGRSQRFGAVYENHFGDLDRVGGTFSFTYYGQLMTRDFQVSSSYNSANMVTCFSEAACKAAGLPAGYNLAVPYYATNYNGWAEVENPVRSINNAFEPKVSLVVNTGKVKQTFIMGLRFMTTTFLQRQYLNTNECATKQSGEGAGFLCEGANVMSGWKPHIKHGVYRNWNDWRNNYTAVYLSDRIEAWDGRFFIVPGLRYAFVQYNNENAADWMQIPEKDLKKIKHMNNWMPSANIGFIPVQGDHNVLTYFNYQRSFVPPQLDILSYGGAEYFTQHFDTVEAGTRYTYKDKFSFNADYFRIWARDFATGQYSVYTSGPMKGNVRPVNGYSQGVELELYYRPIRGLQFHAAFNYIDTRVTSHGPLTDLNGDVLKGTSYNKHFPFVSPYQFIFDARYNYHKTTIGISSYFYSRAYSGISNSAAGGYYGMQYYSGGNNYESVSNSGYQCEAWCMTQHEGLLPWYWVWNIQVSQIFWENGRHKVIGSLQVNNIFNMKYYFTGIGSSPAGLQPGPGRSVTAYLNYTF

SEQ ID NO: 20022 - protein, 224 aa, Photorhabdus luminescens
MQKLLLIAATSATILSSSLSFAEGMDNEWYLRIDTGAAMFNEEKDKATGVKLKSNTTVPVDLGIGYYISENCRADLTLGTIIGGKLKKSGAATNAPFTGTNVSASHKPTITRLLINGYVDLTNFDMFDVFAGAGVGPALVKEKITYNGITGLSSNTKNRTNISYKLTLGTSAQIADGVKVELAYSWIDDGRTKSKNVIYPGTSVPTGGMRYQSHNLTAGIRFDI

SEQ ID NO: 20023 - protein, 320 aa, Photorhabdus luminescens
MKKIAIAVATVLAGGVMSNVALADTYVGGKLGYNALNDACHLNAPCDDDSFAAGMHIGYNFNEYVAAEYGVDYLGNFTANFNKAGLNTVDGDLWALTLAPKFNLPVTDSWNLFAKVGAAYMMAGDEKDFVPTGSLGAEYQINYNWSLRAEYQRYQDMSDDIIDDMDADFFGIGFNYKFGSEPVVQEVVETRPATNIVDQEYPAQTTTVQFGLESAKLQDASAFNGTVELMNTYPQAQVEINGYSDTTGAAAYNQQLTEKRAQAVAEHFQAEGIAADRMTVKGMGEANPVASNETRKGREQNRRVEVVVPAFQYQTEEAAQ

SEQ ID NO: 20024 - protein, 365 aa, Photorhabdus luminescens
MKGRWVKYLLMGTVVAMLAACSSKPTDRGQQYKDGKFTQPFSLVNQPDAVGAPINAGDFAEQINHIRNSSPRLYGNQSNVYNAVQEWLRAGGDTRNMRQFGIDAWQMEGADNYGNVQFTGYYTPVIQARHTRQGEFQYPIYRMPPKRGRLPSRAEIYAGALSDKYILAYSNSLMDNFIMDVQGSGYIDFGDGSPLNFFSYAGKNGHAYRSIGKVLIDRGEVKKEDMSMQAIRHWGETHSEAEVRELLEQNPSFVFFKPQSFAPVKGASAVPLVGRASVASDRSIIPPGTTLLAEVPLLDNNGKFNGQYELRLMVALDVGGAIKGQHFDIYQGIGPEAGHRAGWYNHYGRVWVLKTAPGAGNVFSG

SEQ ID NO: 20025 - protein, 351 aa, Photorhabdus luminescens
MMKRNILAVVVPALLVAGAANAAEIYNKDGNKLDLYGKAVGLHYFSDNDGNDGDKTYARLGFKGETKINDQLTGYGQWEYNFQGNNSEGADAQSGNKTRLAFAGLKFGDAGSFDYGRNYGLVYDAIGITDMLPEFGGDTGVSDNFFSGRTGGLATYRNSGFFGLVDGLNFGVQYLGKNERTDALRSNGDGWATSLSYDFDGFGIVGAYGAADRTNAQQNLQWGKGDKAEQWATGLKYDANNIYLAALYGEMRNAARLDNGFANKTQDFSVVAQYQFDFGLRPSIAYYKSKAKDVEGIGDEDYINYIDIGATYYFNKNMSTYVDYQINQLKDDNKLGINNDDTVAVGIVYQF

SEQ ID NO: 20026 - protein, 716 aa, Photorhabdus luminescens
MKNSFLANSPSPQPLFRPLLAFAALTATMGTALTAHAQSAGATAPSTTTASASTLPSVRVLGDSDSDSRQVGDRSEITLNPQALPTTVQHIGQEDIANTNVGRDVSNIFRRVPGVLANNIDQGDTGNGFRMRGFATQGTHGADTAVYVDGVPQNIPSIQSIASHGAVFLEWLPPELIGGIDVIKGPVSALYGDQNRAGAVDIRTRDGGDATPSSVSVSAERYGLRRTALVLSNKLSQVDSLLVADLSRNDGYRYASNTDRESLSWKLSTQQDSGKYSLRLTRYVSDFQAAGYLALSDLQKGLDPRSTQFNNPGFGATRRTSVVVNRAPTAGEEGWYATAYGESLYRQRAVATSATRHLLGEDDRDMYGARVYHNTVFGDASLAVGTELRKDSGSAFRRIYVNRLPSANYANDVDLDLVTYGFFAQGQWRATRDLKLSAGARYDRFDYDIANLKLPAASTGYRKGVLTPKLGASWTVLPRLELFANVAEGMRSPATEQISSSGATGPLGASGGVISQVKPSKVRSYDMGFTANPTTDVMVSGSAYDILNSDEIVSQADGSFRSVGDTTRKGVELETRWQLGTASSVYASVGRILEAKVNNPAANTGAKLSVPGVQFKAGAQHKFGLGAGQMTLNADAYLIDDIPYYVGTPTTQERTMPLYTRYDVRSTYDYGSAQFSLYATFQPQRYGSEIAYGTAAGLLVSPVPKTTVGATLRYFF

SEQ ID NO: 20027 - protein, 715 aa, Photorhabdus luminescens
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 20028 - protein, 705 aa, Gloeobacter violaceus
MNKRHKTTRGFAKSLLATAIFATLQATVYAADLAKPTLETDEILVVTGSRSKEKLEDVAGAVSVVTAEEIDIQVSNSLSDIFRYDPSISSTGSQGQAQTLSIRGIGGNRVVYIKDGRRLNDAYAGGGGYLVGRGYLDVSQLSQVEVAKAAASPLYGSDGLGGVIVLTTPDPDDLLQGESNALSLQAGFDSIADERSLGVQAAKQFSGSQASIQLTARKGNETQNYEESLPEFDYDSVGVLAKWAIALENNNELKFTLDHYQQNNEQLQEPPEQTEDEDKQTAFSIDYLNNSSNWLTDTQNWQLYLSHYEQNSDQIVQGADQGGPYIDNNDYGFEQRIIGARWQGETLLSGNQVEQDLVFGFDVDYYDTERPRFKTRTAADGTLLQDNEPQKAFPGAETWLAGLFLQDNIQLKDSPIKFIAGVRIDHYRMTPQDNALYDMSLLSDVRETALSPKLAAIYTFSNDIRGYVQYAEGFKIPPHDQAYQNHGIEPFYAILPNPDLDPESSRSLETGLKFADNNTRWNLSAFYSKFDDFIDTQVVGTSPTYIPGVDRVEYQYVNKDEVTIKGVEASVTHWLNDNIQLASSVAYTTGKDETTDDYLTTLSPLSGNASVGYHGNDWYVRGVVTAVNSMSRVPTDESIQTPGYATVDILVGISLTNWQVNLAARNLTDKYYVPYQSVAGLQSEASTEQYSQPGRSFGVQVKYTF

SEQ ID NO: 20029 - protein, 227 aa, Gloeobacter violaceus
MVGVDTKIDGNNAKWIVGAAAGFAKGDMNDRSGQVDQDSQTAYIYSSAHFANNVFVDGSLSYSHFNNDLSASMSNGTYVDGSTNSDAWGFGLKAGYDFKLGDAGYVTPYGSISGLFQSGDDYQLSNDMKVDGQSYDSMRYELGVDAGYTFTYSEDQALTPYFKQAYVYDDSNNDNDVNGDSIDNGTEGSAVRVGLGTQFSFTKNFSAYTDANYLGGGDVDQDWSANG

SEQ ID NO: 20030 - protein, 696 aa, Gloeobacter violaceus
MTKNNLLTVAIRKAMVFAVAPTVAVVALSANAQDDVTAMETITVTAQALKVETPAAETPRSVSIISEDELRVRAPQKLDEALRYTSGVTAQPYGADNDTDWFKVRGFDAATYLNGNRLFRDGYYTWLVEPYGLESVEVVKGPSAILFGESAPGGIVNAVQKKPTFTPQGEVKVEVGNNQHQSVGFDIADEANDDGTIRYRLVGLMTSQDGELDGTNNERFYLAPSVEFDISDRTMLTVLATYLRDDGVPTNPFFPAAGTLIGSNFGKIESSTNLGQPNYDKYERTQFSLGYLLEHDINDTWSFSQNLNYGSNELYLRSSYAFSNNDPAKEELTQGIVFRDGKNQSITFDNNAVGNWMTDNAEHTVLVGMDLQFHKTDGDEQDNYAFGTINPWNPVYGNFNPLDPSKNVKREIEKSQASVYSQYQLKLHEQWIGNVGARYDWVKTENSGKGAGVDQNESRDDGQLSLSAGVMFLANNGLSPYANYSQSFEVISTIDAATNELYKPLEGEQVEVGVKYEPSFMDGFINLAWFDITQKNALVTNPSTWIATQTGEVTSQGIELESKAQLTDDLKLMASYTYTKAKTDESFGKGKKQAALIPEHQASAWVDYSAYSLIPGLNIGTGVRYVGESKDNPKSSNLTVPSVTLWDASVTYDITSQWQAQLNVNNILDKEFISGCDYWCYYGQSRSVMLNANYRW

SEQ ID NO: 20031 - protein, 913 aa, Gloeobacter violaceus
MVRTSFRAAALSTVASLTLLTGSDAAFALVQSDPGAQGNDIASSSELAVDFDIAEQPLQTALIEFARQSGQSLLYSPDLVEGHTANAVQGRMTPTLAFSRLVSGADLDMQRSASGAILLRQAAAVEARDTPSSQPTNPAPTRPEGAASESLIEPSAEAEPDVLQMDTITVTGTSIRGVNPESSPLDVYSREDFQRLGVLTTDQLLRAIPQNINTTSSIGGLAVSRELNARSVNAVDLRGLGAGSTLTLLNGRRLPLADVGETADASLIPLGAVERVEVLTDGASSIYGADAVAGVVNFVLRDDFEGAETSVSYTTRGDGGYSAGQFDQVLGTSWSGGGVIASLSAATSGPFLTDEVDFSNTPDTYLAPLDQRYSAFVSGRQDLGASAEVFADILYTDRHTKTSTREDGFFQATSLSNTQTEQVVATVGGRIQPVRDWQFELLATYGDYTNNLNIVRFFDDGRLRETNGAQDFSSLEVTGKLDGTLLSLVSGDVGFALGGGYLEQELGFGPMRADRATSYAFGELAVPLINEDMAVPLVQRLELNLSGRYTDTSDFGDSFDPKVGLLWAINDELKLRGTYGQAFRAPTLPDLIPSETSYVILPVEGPLGTFPDPFSNDQSTVYYVVGPISNPDLGPETSEAFTLGFDFAPARIEGLTLSSSYFNIDYTDRIAQPPDAFEIAADPETYFDLITDEVSPAIIADTLPGALGLFDARTGDYSTTLDPDAIAADVTHIIYNGLTNIASQQTSGFDVSLDYSAPTSFGAWNVGAAFTYMLENKERISAGAPVVERVGTLTYPVEFRGRLNAGFQHGGWSSQLQLNYVDSYTNTSVTPAEPVDRWVTVDLITGFSFQERHGDLLSGVRVGFNVRNLFNEDPPFARSNSASTIGTDLGVNYDPTNADPFGRLFTLSLSKEW

SEQ ID NO: 20032 - protein, 190 aa, Gloeobacter violaceus
MSGLRPALSTFIFLLLITGGVYPLLTTVLGQWWFPWQANGSLIREGDTVRGSALIGQNFTGNGYFHGRPSATAEMPYNPQASGGSNLAVSNPELDKLIAARVAALRAANPDASASVPVELVTASASGLDNNITPQAAAWQIPRVAKARNLSVEQLTQLIAKYSQQPLVKYIGQPVVNIVELNLALDKLDE

SEQ ID NO: 20033 - protein, 709 aa, Gloeobacter violaceus
MPTFRFHALAIAIAATTLSAAPLARAGETDGTAVETDTSIRALDAVQVQGSLLGRSKPEDVQRYAGSRQVIDREQLRNGGNRSLDDALQRVPGIKIFDETGTGALPQLMLRGLYESRSGRVQVLEDGIPLALAPYGQTSLSLFPVGLNQIDRIDIVRGGAAVQYGPNNVGGVINLVSKEIPSDWTTTLAHKITAGGQGQFLQDSALSSGGYVTDNVGLQVDANRTYGEYWRAHSDTDISNLRVRAEWWIDDTKLLKASVQRYLVDMDLAGALSPEDYRRDPRQSTRPLDSFNGRTTRASLSYEQVVGDWGPLQDVRLSWTNFSARSSRNFIVGMRQAATETWRSDLPPQLRQTAPRDFRVVGSEPRLTWRMGDVGGVQQQWTAGVRAVHEDIDFLVGNLRLRDGLFTSVRDWQFEDRALAAYVSNAITLPDARLTITPGLRYERLDSRYFNRTTGVSTLNQTRDVLPGLTVGFQANDQWFVYADGQRSMRAPQVTQIIFGNNLDAELAWNYELGTRYQPNERTRIQVGAYLIDFDQQIQLDNTTRVFRNLGKTRHQGGELELQWSPEQLRALTLNAGYAYLDARQESGAFDGLRVPYTSRNQITLGGTYALGHTTVALSSYYFSKAYSDAANTVQENAIASVGELPSYWVWNTQVSHTLLERGGQKLSASLAINNLFDRQYWFRGVDTSPWGRQAAPGRTVTAGLEYTF

SEQ ID NO: 20034 - protein, 638 aa, Gloeobacter violaceus
MHGHPMQRSIVKSRLFRLSLTALGATLSLDTPAIDSDPAELDTVVVTATRTETPSRQVGSSVTVLTAEDIKERGVYSVDQILRIVPGLDMAQSGGPGRETSVFLRGANSGQTIVLIDWTEMNDPSSANAGFDFANLTIDNIERIEILRGAASSIYGSEAIGGVINIITKKGSGKPRLKTSVDGGSYDTWRVMGDLAGGDPRFNYSLTASHREVRGFSAADQHFGASERDGYRNTTVSTRIGGTPADDLELGWSLRYDDGFTKLDNYDFLLRRPVDDPNYTGNANELYTRGFGTLKLFDSLWEQTVGMAYTRVDRQYDNAANPGDPFPFRAAYLGEKIKGNWLNTLRPHETNTVSFGIDDEEDTMTIMEPSQFVEGYNTLGYFLEDQLNPFDGWSTTANVRHDHNNSVGGKTTWRVSQVWTLPLLETRLKANYGTGFKVPALAQLYDPLYDTGNPNLRPETSTNWDIGVEQPFGQAVRGNAGIVYFNNRFKDLIQFDPVAFRMENVNNATAEGVETYVELNPLAGLDLRGTYTYMDSRDQDTGTPLYQRARNKGAFDLNYRFDNGANVHANIVMVGPRLSTGNRTAAGYVILDLAASYEVSDRLSLWTRVDNVLNKWHEEVYGYGTTGAAAYGGLTLTY

SEQ ID NO: 20035 - protein, 703 aa, Gloeobacter violaceus
MITNKHFLALTIAASLIPDFVSAEERIIVNAERVNPQTKGRLSQQANIGLLGNKDIQDIPFSIKGYTSKYIEQRQAKTLGDVIKDDPSVQVTSPSGGILDSFMIRGFPIGEGNIGEVALNGVYGVAPNYQLLPQYLERIELLKGPGAGLYGISPNGGVGGVVNAVTKRPTRQGTKQITTTWGSDNQLGAYIDVGKLWVTPDGEMWGVRFNGGGSGGDLALDNTHKKTALGALALDYGKDGFTVSVDLFDQYQYVKSPNRPFIVLAGIDVPKAPNGRRNIAQKGMWWNTRDQGVLLHSSYELNDNLTLFMNAGGGRSIVSRISEQTPKIINDNGDVESAITNYRFNVHRYIFETGVRSYFSTGAIDHQMTLQASYYHDRLAVAGNVGKQKVISNIYSPSEVDVTLPSSPASVPKVSSSQLTSFAVSDIMTILNGSVDIIPGIRLQRVQADNFMANGQRSASYDESAVTPMLGLVYHPLESVSLYANYIEGLSKGDIAPSFAKNAGQVMRPYRSRQYEVGVKYDNAGIQSSLALFQITKPSGAIDSTDNIFNANSEQRNRGVEVNLSAQVLDNLQISGNLSLIDAELIKSPKSDIRGNKPVGVSPLQANVGVEYDLPILHGLSLNSYVNYSAKQYVNQANTQSINSWTTVDMGASYKTRVYGAPTTFRFDVQNLFNHHYWSGVASYTTIAQGAPRTFLASVSVDF

SEQ ID NO: 20036 - protein, 3692 aa, Gloeobacter violaceus
MEAPEIKPEPNKPIEAPKITLPTINKVIIEELNITPPAALNVPGTPNINITINAPNAPTPPSVSVNVSEPSAPNAPNINIPITPPEIKALNIETPPTVNVAPPTVAAINPVAFSVAPTIDSKQYKFGGANINNGLNGLPSTIDVQSNSNTNRNYVTINASGSSVPTSVLLPDKKTINVSVNNNRALVVDEARENFDFQMKGTINLYGNQNMGIDLQGTHIGGSAKGSATNPAISTIRNEGVITGHATNKYDNNKATKEQVAFGFSNADASSNATMTHMINNNEITLNAPSSAGIQLKPEDPFYWDPNWGTLSSDNKMIINGLSGSRNANNFGRVLMKADNRKDINLNGSGSFGMITVFNPGVIELNTISVNRTTYPTGSYNLRAQRNIGTKVLPGGEIGRSALSDSKYTSGVYNSGNININGDESVGVGILHEIQEVKIGGTINIGVESVSQTTGISDTKSTTGNDQTTLVNNAVGVFSGVPTLPVKNNEYDTMGNKNTTGNIIGTETSEVDGTINIGRHSKESIGLLVGDSGETLNNGTLNGTPNQARILKRSGSITYKSSANNKLNINGNANYGFVVKSDSNKSVFGSALDDLQQSVDKTNYGIGINKGNIDIIGINSIGFVLLKGGNSKNTGNITVNESEDFWYPIVPPTPNYDYRQNSIGFYGEQDNFTNEGTISVNTPNRSGNKAVLLKGNSNGITFNNTGDVSVKGRNNIAIYAEGKYTFNHEKNAAGTNKISVGSNSIGIYVKDNTGTVNIKAPIELADSSNGTTIGVYSDGNAHINFENGSKLTIGKKAIGLFSQSTTNFKNTFKFNNTAGNELNVSLDENSAFAFFNGSGSTDIAEVLNKNIKFTAMKKGATFAYVKGGSIVTLSHDFDTTNTAKVVVAPESGTSVLVASDGSTVQVDANKKLTTNTNVGLVATNGSSSNKSKAINKGTIISKVNGGVGLYANNNSEATNDIAGKITMENKGSAAILGENNSILTNKKDIELKEEESAGIYAKDSLATNSVTSGSPAVKAKISLEKTKSAGMYSILTNLADGDKKILNQANGADKASIEIGANATSSAGMFGKVESNATKVLTLENAGNIQVGATSSVGMYAQNETVDEDKLLVNNTGLINVTKESSVGINASKRATITNSGVTADGNGIVLSAKKTAGIIGNNNSVVTNTGDITLNSTTQPTDSSEGLVGISVDKTSTALNNGTITVSNDYSTGISGKGGRITNNNKIILNNINSVGISSTDGSVLNSADTNNLIEVKNSNSVGIFAKLIENVPFSPFQAILNKGTITLNGGNSKSSSVGIYSLIEDKAVQNKSTQQIANTGTINVSTKGSAGIYVKDNRTSGTDVISFIRNEKDINVAEESSAGIIGEYSQITNGNPQNTNGKIELSAKKTAGIIANKKSEVINYGKIETLSSVTINNKTDALVGISVNNSKVINKNKEDSNGMIGAITLNTAYSTGIYGKNESTLINEGKITANKTDSIGMAGENSSLTNKNEILINEEKSVGMFGTTVGNKNTVLINEQDDIKSLTGKIITKKKESVGMFVSTSQASAINRGTILIEEEKSAAMYGDEANIENSGTSTNLIASITTKKDESAGIYAKNSNATNKKKMTVEGKKSAAILVEMTKDKNISGINDIADNSSDILNGHIEVKNQESAAMYGKIDSKVSVATSTLTLINKKAIDIDAKSSVGMMLINDSNSVNKTNVKAENSGVITLKNATNNTGNIGILAKKNSTGINKDNGIINVNSKKSIGMLAKEGSNVENNSNLPPNPLVVGKEYGINLNEEESIGMLAEGQNSASQVSTAINNAKISVTAAGKKSIGMLAQNEGDVKNNKEIEVFAEKGVGIFVSDTGTGENTNPNGKITLMNKEAVGIFAKNNGDIYTAKNSGKVILGSADGTTTHESLIGMFAQAEAGKKSSIKNIDTIDVNTKKSVGMYAKNDAANVDDVDLYNAGTINVNNKGSAGIYAPKANISKVGNIKLKNTTDTDGASAVYISQGGKVSDTDSAIIDLGTINQNRVAYYVNGANSILRDKGNNTIGKITGYGVGVYLEGNASKSTVGIAKLDGSTPKLHYKNSNLGTTGNGIIGLFLSGDTEIKNYTSGIVVGNTVEENSLKKYAIGIYADKQGTSTNKYEINTDITTGKEGVGIYSDNNSVINYKGKIAVGDGSVATKNDEVTAGIGIYITKSTGGNIGEVNLIGSKTDTSITLKGTGGVAVIASEGTRFNGGNATINLVGTNIKGVGVYAKRGSEVKIDNWTFNNNGNSAEEVRSEEGGAHITATIKQLKPKMVLSHVINGETSIAAGSKVVSVDDAPHRAAENIGLMAEGRKNPTAPAPLTAWTNGDFEIENHGTIDFSVAEKSTAIFSNSARAKNDGIIKVGKNSTAIYGFYDSTIRTYEVVPPAVALPNKLEIETTSNSKISLGDKSTGMYLINAEKVENKGGQITSEVGATKNVGIYAINGAVDKGNAKDNSIYNKSQNYKTLNMVTATNITLGNGSVGLYSKGQSNNVRNSVTNTGNITVGSKITVSKTENYPSVAMYAENTNLNTNSNVTVGNDGIAFYGKNSDITAKGSVNFSNNGVLAYLENSKFVSHLGNLGATKNTMMYLKNSIAQLDGAGTKVDVEVADNYTGAYIEGNSQLTGIKTIKLGENSTGLYLKDTMPNFISTSELIIGTKDKARGILGVNSNFTNNSKINLSGVESIGIYSNAGSDKTVVNNGELTLSGKQTLGVFLRGTQNFENKANINIANSVNSKYPTIGIYTATSTVGARILEGANIKHTSGTIEVGQKSIGIYSKTSSNVEVSAGKIHVKDQGIGIYKQNGKVSIKGILDIDKHTATVKDSEPTGVYAVNGAQVDDQASKISIGAKSYGFILNNTDSTKTNTYSNRNTGTVSLGNDSVFLYSNGKASIVNNRTINSNGSEHLIVFYIKNGGDFTNNGTINFSTGKGNIGVYAPGGKATNKGNIFVGKTDDIDPATGKVYSDVSKIVYGIGMAADNSGHIVNDGTIRIYNNKSIGMYGSGIGTVVENGVNGKILLDGSKATATDKIQSMTGVYVDEGATFRNFGTITTTDSYAGRNGKVNENVSGLTGVAVMNGSTLINESTGKILIDADNSSGVVIRGKRDANGKLVRNAVIKNYGEIRVRGKGTTAISWKDVSPADIAELQKQINDKITSDPSGRELGQASGTNKEYQGVTITVKNGKPVFTRNGKLISDSEVEQINKLIGSAPNLAMSDVGFYVDTLGRTKPVTFDGANPPVNSQLIIGTEYSEKTNKKEWFVSGNVIKPFLDQIQGRNFKLTTLAGSLTWIATPVLDNYGQITGVGMSKLAYTSFVKREDNVYNFTDGLEQRYNVNAIDSVEKRIFNKLNGIGKNEEVLLTQAFDEMMGHQYANVQQRVQATGNILDKEFSHLRGSLANASKDSNKVKTFGMKGEYKTDTAGVLDYKNNAYGVAYVHENEDIKLGKGTGWYTGIVHNTFKFKDIGNSKEEQLQAKVGLFKSVPFDENNSLNWTISGDIFVGHNKLERKFLVVDEIFHAKSKYYTYGIGVKNEIGKEFRLSEGFSVRPYAALKVEYGKVSKIKEKSGEMKLEVKENDYLSIRPEIGTELAYKHYFGTKSLTASVGVAYENELGRVANGKNKARVAGTTADWFNIRGEKEDRKGNVKVDLNVGLDNQRFGVTGNVGYDTKGSNVRGGVGLRVIF

SEQ ID NO: 20037 - protein, 776 aa, Gloeobacter violaceus
MRSHSAARRAAWLLAASPLALSGLAAAQTAGESVTLEELAVTGEGTPQSQAAAGSGAPGFGVSGPPGAAALGIERPTGQVVTAVGREGTIANRPATSIGTVLLDSPGVTLRQGNGGRDVVISIRGNNARATGVTRNMVVLEDGFPVTQPDGASRFDLVDPRAYSRIDVFRGPQSALFGNFATGGALAFRTRTGREIDGYEIGVDAGSFGYLSNYFSVGGVSGPFEISLFASDVRANGYQDHSSYDTQTINLLASYTPSPDNRFTLKVINNEVTANIPARSSLDQFRINPYQRGCEAAATAAPGCTTFGLLANGAFGPRVPVTASEGAFRRNDRRTIIAGRWEHDIDAQTAWRVQVGFDERNYNQPFYTTSGRGSLPSYFVQTDLTRRGELFGLPAVGSVTLAYSAVDIAASVYNRAPYGGARLGTLIGLQEALQSNLGGRARLELELAPQWTAVAGLGAEESSIIGRNRTFATTAAGTGSTLAQADRRFLNVAPELALVYRPDPDWALRGRVATGYATPSFSSMFVNATGLPGNNTDLKTQENLGFDLGTDFMPLPGLRLSLTGFYEFFHNEFVTQSPGAGLLNYTFNAPASEHRGIEVGADWTFAPGWRGVLAYTFDDQVYTDYVEQLSAAALTARFDRAGNRIPGVPAHQLLARIGYDVPAGALAGLGGFAEVVAQDGYFIDNANFLKVPGFAILNLNIHYAALLPNGYARRIDLYGEVRNVLDTTYVGSANPLANTLNAATGAQSGRAALASTTGSIFAGPPRTFVAGMKLSF

SEQ ID NO: 20038 - protein, 799 aa, Gloeobacter violaceus
MRFRTSTALVALALTTAALPAGAQQGGVTAGQEALEEIIVTGTRGTQRTLYETLSPVDVISGDTIDSTVSSELVDSLAQTIPSFNVQRLPANDGLAFVRPARLRGLSPDQTLVLVNGKRRHRSALLGSRGSQGPDLAQIPSFAIKRIEVLRDGAAAQYGSDAIAGVINIILDDQPGYRFFTQASQYYEGDGENYQFGAQGGWEIGNGGFLTATAEWSDQNATSRTRQRPDAIAFQAANPNLSVPNPVQRWGQPDLETVRLAVNGELPLGESVQAYLFGTYGEGDGWTDFNWRNPDSTSNVYKTTPIFPGWDARSLYPTGFTPRFGQEDQDYSIVGGVRGDVTDDLTWDLSGSYGRNRIDYKMRETINASLGPDSPTSFDDGSLIQEEFNLNLDFVYSLHTGLLEAPVNVAFGGERREETYKIVAGDEASWVVGPGASAGLATGSNGFPGYGDAQAGSFDQESYAGYVDVEVPVTDIWTIGLAGRYEDFSEFGSTTDGKISTRVEVLPNLALRGSASTGFRAPTPGQAYSTRTSQGLDTVTLNTFTSGRLEPSNPVAQYFGAKPLKPEESVNLSAGLAFQTDTGFSATVDVYQIKVTDRFSQSSSFTVTDTIRQQLIAQGVPGANTFTSVSFFTNDFDTRTRGIDIVGSYATDAGPGHLTLSAAYNYNKTEVTGGSLASNPTQALLFEEGLPQHNATLSADYRLGPVNLMARLRYYGEWTDSSGNATGDIFQTFGAESFVDMAVTWDITDAFSLRVGAENVFDNYPGEATYQSNRGLIYSRNAPYDTDGGQYYVRLDVRY

SEQ ID NO: 20039 - protein, 1114 aa, Gloeobacter violaceus
MQPQFGKRRAAFVSVLLFALIFAVSAWGQTSKGIIAGTVTDTSGAVVAGAQVTASNTDTGETRTVQSGPTGAYRVEAVTLGKYRINVSFQGFQSQVINGVEVAGSVMTAVDIKLQVASAASTEVTVSADNNQVQTENGEISSTITTKELTNLPLASLNPIELALTQPGVIDNAGRGSTNGMGFSVNGSRPQSNNFLIDGQDNNDNSIQGQAYQPQNPNAVQEVAIMTNSYSAEFGRGGASVTNVIYKSGSNQFHGTLSELYSGSGLNAIDAANGLTGMKDGGDCNRAPNFFPCKTRFDSHTFGFTFGGPLIKDKLFFFGSGNWERTYGQEQNSNILIPTETGIGQLQAYGSANATLLTQYLGSLRGSTVGATCVNTGISSLPCVEMGNYTPTAPQQNTDTQWNIKADYLPRQTDTITFNYLHDRGYFAPDWFANPGSVLPGFETFQGGPSWIAGASWTHTFSSNKVNEFRASYGHLGFTFGPTAATTGNPLYLMPSLALSSAGLDAFPLLGTDSAFPQGRSHRTMQLQDGFTITKGSHTFKMGADVARIWVTDQIPINTRGTLTFTDGGGYTALGNFLDNFTGTSGQALDLQTGNPTVKPTLLQSGYYFQDNWKVRPNLTLNLGVRYEYQTNPENSLPYPAVSNIYGGDNNFPTVVKADQQFSHIAPRIGFAYSPNFLPSIFGNGKTVLRGGFGIFYDAIYTNILDNTASSAPNSIDEPLFGSDSSNARGFANATGQFSGLSGTLSPFNTVTSIAKDLTNPRTTQWNFNIERELPADMLLTVAYLGSRGQKLLVNDDYNPFGGYDASGNYIPRFNSNRGAMAIRTNGGDSYYNGLAVTVERRFSHGLMLRSAYTFSKSIDDSSNIFVITGGSSYAQDPTNRQADRGLSAFNAFHRWAFTYVWDVPGFKAQDNKVLNGLAYLSRHWEWTGTTTLQSGLPDTIYDSFDSSGRGHSSSGRPDLLNASAPMNAIALPAAWGACAPGADYCDLATLNSLSASDLSNYHFLVPFGAPGTVGRNNYILPGQVNFNFGINRNIPIPRHESQVVTLRVEMYNPFNHPNQSALPNQGMWSTNVSDMFLVGQDSSGNLNNPSHLFDTYWARQGARNIKLLIKYQF

SEQ ID NO: 20040 - protein, 714 aa, Gloeobacter violaceus
MYATHPPLTLVAATISALLAGPVQAAATERPTQTLADETLTVLGETYRNTATKTRLDPLETPQAISVVEGETLEQRGVSSVSEALRYVPGVNTELRGGAVNRLDLFNIRGFDNYQNFYDGLLLQYNDWNLQPQIDPVAIEQLEVFKGPTSVLYGSMPPGGMVNLIAKRPQRESRHSVSVASGTGTLKELTLDSTGALNDQFAYRLVGLARQKEGQAVTSEEERYVLAPSLDWQLSERTLLNLNLYYQKDPQAGIYTTVPASGSVKSNPLGQLGSDTFLGDENWNHYSREVTLLGYKLSHDFNANWQLLQNARYMDASANQQNTYNAALAADNRTLARNAYLTDEESRGFVIDNQLAGKVQTGKAQHNLLLGVDYQYLDARILYRDTLDYSAPAIDIFNPNHQQIVPADLAFNYQDNRTIRQYQSGLYLQDQVRLDRLVAIGGARYDRYRMDTDSQTLYQGAASNSLAQIDQDNLSLRLGALYELDHGLSPYVSYAESFEPVAGADKQGQAFKPATGRQWEGGLKFLSEDMSKTFTASVFHITKQNALVTDPDNVYGPKLQTGEMVSKGVELEGRVDLTSRWDLALSYTRQDMEITRDTTSLQGKTPVWVPKQMASLWSNYLPAGPLAGARLGAGLRYVGEAQLDAANTDTVPDYLLMDMAASYDLAQLSQRLQGVEVSLSASNLFNKTYYSCYDQNNCWFGAERSVEARLKYVF

SEQ ID NO: 20041 - protein, 468 aa, Gloeobacter violaceus
MIHAYQNQPLSTKVVFQLVKDLTEVLYRSGYVTSAIGLKNSKISNGDLEFIVLWGRTRDLLVNGEKPTRFRDKTMLSVLPNLIGNRLSIHDIDQLIEILNTTNKKATVNVVASEEKGSSNLNIERQYDVFPQVSLGFNNSGVENNANGRNQVTLNVAWSDLLGTNDRWNFSSSYRLYKDRHANQQRNYALSYSQPIGFSTVEVKASESSYEKELRGITVNSSNGKTRNLAVKLMHVLVRNKESILSAYTEFEFKKRISYFSDILIGKYHNNKVSVGLSYMTNFAYGKLYSDIAYANGLRWFGANYSAYDANREKTLKLLSGSINWQRPISLFERAMNYQLRIGAQYGFDSLYSENQFSIGDEYTVRGFKGGAVSGDSGAYLSQTLTVPFYPQKAYLSQVSPFIGFDMGKVHIKSKHKTATLVGFALGLKTQIKLFSLSLTYAQPMNGVSGVTQHRQKPIYYFSGSLSF

SEQ ID NO: 20042 - protein, 971 aa, Gloeobacter violaceus
MRSAFAGFHSIRPRASALHLTASALALAMALPAVAVAQTASQTEDGATEVEEIVVTGLRRGLADSIATKRRETSIVEAVSAEDIGKLPDVSIAESIARLPGLAAQRVNGRAQVISIRGLAPDFTTTLLNGRQQASSGDNRAVEFDQYPSELLSGVVIYKTPDAEVSGMGLSGTADLQTVRPLAFGQRALAVNLRGEMTEGDKLNDDVRNYGGRFSISYIDQLADGTLGLALGYAHLDSPSQNKHYKAYGYEAFGGVCEPIAPQTVCVREDGTEREESVQPDSADAALLLNGQEIFATSRLNQRDAVIGILEWRPTDQLHSTLDVYYSKFEQEETTRGAQWFSNAWADDAYFTDVVTEDRGGSLIGRSGTIHNATPIIRNDHNTREDEIFSIGLNTEYEINDRTRIVADLSYSNNRRRETILETYAGYGRGTGGVTPGTPNIGRTLDVIDFTVNDDGYPTYSEGLNYADASQVTLGDRAPWNGWGHDGAIRFPDVEETISSADLKIQRDMDGFFNTFTAGVNYAKREKSKRVDDYDLFLKNGRQQVYVDAQYLEAPVSLAWAGFGDVLAVDMSRALDVYYDRAPILDANYFDKNWDIEEQVTTAFVKLDFEGGRWRGNVGMQAVVQNQESTGVVINGTEPGAPIDPISVTKGADYLDILPSLNLIYDLGGGHRLRFAASRTMARPRMDEMRANVTPGFNALVCSTQACPQGSTVNPWSASGGNPELEPWRANAFDLAYEWYVDSTTYLSIAGFYKDLETYIYVQNGTFDFTGIPLPKGGQALLDEGLIISPIGQISLPANGDGGTVQGLEVSGALNFGTVWEPLDGLGMLGSISFTESDLNPDAEGREVRIPGLSGMVYNITGYYERGGFQARISKRFREAFKGEVVQLFATRGYTEILDDEQIDAQIGYTFEQGPLEGLGVLFQVNNLTNSPYRTRLGLDSGGTTTADGGSLPETYEEYGRQFLFGVNYRF

SEQ ID NO: 20043 - protein, 190 aa, Gloeobacter violaceus
MSTDFAAARLNMVESQIRTADVTDLPLQDALRVVARESVVPASKAYLAYADADIEYAPGRWLLRPREVGKLLQALKPREGETVLAIAAPYAAAVLEKMGLSVTRHDGEDLKTVPAGAYDVIVCEGAVAVAPKSWQDALAHGGRLGVVERTGPVGRAAIYLRAEDGVGRRAAFDASPPLLAGFEAETGFSF

SEQ ID NO: 20044 - protein, 882 aa, Gloeobacter violaceus
MRWGGGMILRVGQGLCESTTVRRQVRRFSSQTSASALALGLAALALGTGSAKADCTPAAANNVTATCAGTTTNQGAGAPGTSGSTFGYGSGAETGVTINVATAATVSGTNAGIRIQGGSVLNAGSISGFEGVQGASLAIINSAGAVITGTNNGIEAFSTFAIANSGTISGSAGFISPFGSGTLVNLAGGVISGTNAGVSGGNGVLTVLNSGTISSSSGGGVVLGTNSLIFNDGTISGAAYGMSAAGSSIINAGTINGGINFFGPGNTLTLAPGSVINGLVGGSTNNALQLGGSGTASFDLSQLGSTAQYRDFSTFNKVGGSVWSLTGTTTYAGAVNVDGGTLRVDGNLASAGSTTVNAGGTLSGTGTLGHTSVANGGILAPGSGAAGTSLSISGNLAFQSGAIYLVQVSPTNASTTNVSGIATLGGATVNVAFAPGSYIAKSYTILSATGGISGTFVPTVSANSTTLTRSLSYDANNVYLTVALGYSGIPGLNGNQRAVGDALTSAFNAGGGMSAIYASLTPAGLAQAAGQIGSSAQQTTFSAMSQFMGLVSDPTQRGNTFGGPSTATGYAEEDGRAAYAARRRDDAFAMVTKAPAAPFASRWSMWAAGFGGSQTTDGNAAGGPANSASSLYGTAVGADYQLSPNTLAGFALAGGGTNFNVTGQGWGRSDLFQAGAYIRHVQGPSYVAAALAYGWQAVSTDRVVTIAGSDHLAATFNANAYSARIEGGTRFVMPWISGMGLTPYAAAQVTTFDLPAYAERVVSGGGAFALAYAARTPTNTRTELGLRSDKSFAMQNGVLTLRGRLAWAHDFNPNRSVAATFQALPAASFIVNGAPQAADSALTTASAEVNWVNGWSAGASFEGEFSNVTRSYAGKGLVRYAW

SEQ ID NO: 20045 - protein, 254 aa, Gloeobacter violaceus
MVPIMKKRYLVAGILFAQIYAISASASDTKLSYEHSWGTMNRYHGDEIGMRHFMDNGLYVGVKLNFYNKNKDLTIDDVVSNSYAFYTGYAYSLTPELTLTPNLEARFYSGGTSGEGTVGDIADSQTSGARYTPGLKLTWAVTDKTDLHAQYRYDLRKITRSKRTSTDDDTHRQRYEAGVAYKGFDNFTLAYTAYYYHADYVLQNNKKHDYQQDFDVSYTINDNWTVHVGVEDVASGRDVKSREGKGKVGFTYTF

SEQ ID NO: 20046 - protein, 168 aa, Gloeobacter violaceus
MEMLKFGKFAALALAMAVAVGCSSKGGDASGEGANGGVDPNAGYGANSGAVDGSLSDEAALRAITTFYFEYDSSDLKPEAMRALDVHAKDLKGSGQRVVLEGHTDERGTREYNMALGERRAKAVQRYLVLQGVSPAQLELVSYGKERPVATGHDEQSWAQNRRVELKK

SEQ ID NO: 20047 - protein, 906 aa, Gloeobacter violaceus
MEMNNTFQRKLGSSFVWAALLPALSTGLMGAAVYAQADQIAGLPQDAVARATEAKSQTLSIEDARQLLDKTSAKAADLEYRPPLWDWTALAVQDNGRQRQTAQATPATAPTAQAPGTSDEPDEQGDVLDEVSVTATRRATRARDTPSVVYAVKKEDFQAVRATTATDALTLIPGFTTLPSLGGVRGAGGIFLRGFDDQRFQVLRDGLSIQRSSNNRSDLSSFVVDDLERIEVVTGGATLRYGSGAVGGVINLITETPKGPPKLTLQYLVGNYGNSRYLAKYGGGDDTFSYNLVYSGVAAFNDYPFSVTLPNQAQFYGPTTNPNSIDPFLGPGFNSSGLPGADPDNSGDLDLYGFMKPEVGPPLTVSGVNNSSINASDTYTGKITFKPDPDNKLTLRVGQLNSQFRFASSGNAYGTLCTGSNGLGTPGANGTLLGERYLPLNPDGTEAPCPQQRYFVNTPSNFYSSPYFRYSNSLSGVTVAPGQAYQVEPVITEGFFYQTNNQSQTEAALQWDLNLSPTTTLNSYVQYFQFLGNAYNLSPVFNFNTNIDPILFGLTTPGQATVNPPAQPYFEGRKFEAQTAINTQISPGQNLQFGVNYNEDRSYQQKQGGRRFFDQTISRTSIFLIDDISFSEELKLNVGFRYTYSTQFGSVGTPGAGLRYTPSNFISLRTNWNYIFNAPSISDLNVSGGIFVANPNLKPESGVAFDAGVDVTPLPNVSLQATYFNIYLDGVFGNAILPNPNFLVPGDPTSNFAFIQQRVNRDTQISTGFELLARWQVTPELTFQANYTNSDSRLVGRTDSIDTTLFIYQLQNAGIPFNNAGARLTYANKGWLAALVFRYQDGFTLDYTTFTPSWATLDINVEVPLTPFFTVLGSVRNVTNTTYENPVLVPAIGTNFLMGGRFEIGG

SEQ ID NO: 20048 - protein, 454 aa, Gloeobacter violaceus
MATLTRATRACRELQSRWHELPRSGAMAFLESIRGAGPRQPHDEQETPMPRLHPHPCGLHALGLLCLAGAAAAQAPTSVTLFGVMDAGISRYSVRSDSWDAGPARSARQSTWALSPSGNLASRIGIRASEDLGGGLMAGLWLEAPVANDTGGGALNFGRRATISLSGRLGELRMGRDHTPSFLNDWAFDPFTVNGVGTNLIAVVNSNLAIARALATGGLLGGGLSAGTDTYLRAGNSIGYFLPPGLGGVYGQAMYAFPENSSKRGRYAGARIGWAMGAADVALGYGENTLGTSGAGAEKIRSLNLGGSYDFGPVKLFGEWSGVRNERRDAGTLAAINDRYLGVLAGVNIPVGQGALRASYARVQFRNGQGLADGDSSVNKLALGYVHPLSKRTALYATVSRISVGNGRNNPGVMGVTPLVVSNPAILPQPGYLTTGGMQPAGALGLDLGLRLMF

SEQ ID NO: 20049 - protein, 1125 aa, Gloeobacter violaceus
MNTSSMIRIVISSLLMAIFSQTCPAQVAVEIKGTVRSVTGESLPGATVIVEGTARGVITDVEGRFTLKARKGQMLKVSFVGMKPRLIKASSGIMNIILQDNVQEIEGVVVTGYQQIKNRVFTGAAASVKLDEIKLNGVSDVSRMLEGRIAGLSIQNVTGSFGAAPRINIRGGASIMGNVQPLWVIDGAVYEDLVSLTLDQLASGDAVTLISSAVAGLNASDIEDIQVLKDASATSIYGARALNGVIVITTRSGKRNAPNRFSYSYELSMRSIPSYTNFDLLNSQESMSVYQEMGRKGYFSLQNTLYGRRSGVYYQMYKALNTIDPATGQYYLENTDDVKRAFMREREYANTNWFKELFTHRPIHTHTVTFSGGGENSAMYASIGFYDDRGWTLADHVKRITANIKNSFYWNEDKIKATISAQGNLRNQNSPGTIPQRRNTVIGTFERDFDINPFSYALSTSRTLRPHNADGKREFYRNNWAPFNILNEYENNYLKTEVLDLKLQGELSYRLNDHIEVKGLAMVRHAVTKSSHFIAEASNVVQAFRANETPYVARENIYLLKNKDDPMQLPGVALTHGGIFNKTETSLRSYLGRLALDYNRQLSEHNIRAFGFTEIRYADRSMNPFQGYGIQYDRGNQVFSNPLIFEKLANEGDTYFSLTERYERGVTLSGSATYGYAEKYIFNGVFNYEGANTAGKYSRSRWLPTWNIGAKWNLDQEKFMRKHTTISRLALRTSYGLTAKMNEQAVNSTTVFKHVMVNRTLLKDRENALRILHLENRDLTWEKMYELNFGLELGLFGNRISATFDVYQRNSFDLIDLIRTSGVGGQYYKYANFGDMRTRGVELAIQTQNILTDKFSWSTTVTISGMKQKITRLLNTPNTFDMVAGTGRGNIVGFPRGSLFSFNFQGLNSNGLPTFDFGLYPSNKGANSEISGADFLDAQYSKSYLIYHGPIEPQYIGGISNTFKYKNWEFSCFVTMQAGNKIRMNPSFDPAFADLNVFSKEYYNRWLNPGDERKTNIPVIPSQDLIRNIGKENIEKAYNTYNYSQNRVADGSFVRMKNISLGYRLPQRFLSHLKIKQMNVKVNVTNPFLIYSDRKLNGQDPEFYRSGGVSLPTPKQYTMTLNVEF

SEQ ID NO: 20050 - protein, 733 aa, Gloeobacter violaceus
MEGNVMHNKFKANTLAISIAAILLSVSFNTLAVVCPPEAPAGSSCDAFIANDGKAVSLANDLYITNGNALTYSGNTPFVAQYLRKNIIATGTDAHAIYADANTVFNNNINLERGISIISENGTAIKIDGSFSHTAAAPNFGIAVKDGSIVRGNGAAIDFRDAQTAIRMDINGSIYGDILGNGVTGNKINFAYQGAAANALFDGYTISGVEKLENWGNLSIIAKDRTITWSGDFTNKNNASLDFKIGDEVDLASPILLVEGKTVFNTGSKALFSYVGSNINDIVNKDIILIQSNGGMSGPIDVAQNEITVVSNLSPLLAQTDSWVTTTDPIVNGGISGNQLVVRYGVNYEGTDNFLDLALQGGANQYQLNAANYIVSYALSQYNKTQSEASGELLALLTSAGNSSAGIASIADQITPNAEGGEVRAALRMVDKMRDQIDNRSLYLRNQSAATPWNFWAQTLYAHSRQSSGTYTPGYQTNGYGINVGVDRRFNDESLFGVSLGYQNANINIHSYGNEKDVDSYELMAYTGWFDDRYFFNGNVNMGYNSNSSTRNIGENTGYQGNTKATADYNSLQMGYQVKAGMTFDLDVVKLQPSVAYNYQWLRVDDYAEFGSPASLEVDRQSYSVKHLGAGLTAFNTYELGMGLLTPSLTLMGYRDLNDTEIIVKKAGLTTDQGKGKGRFIVEGDSVGNNIFEAKMNSNLQLKNNLSLDGNINYYKRGDYNEGYIGLSVSKHF

SEQ ID NO: 20051 - protein, 854 aa, Gloeobacter violaceus
MHKGFPVKSRAMKARSAMLLAGAALGAGIAPHAAFAADAVEQAAEGSAPSSAEIIVTANRREERAQDVPISITAITAESIRERGLTQLQDLQASVPSLVVGPNGQASRDVMSPSIRGQSASFQGSPAVVVYMNEVPLPSAITLSGQGGPGSFVDLQNVQVLAGAQGTLFGRNTTGGAILLTPARPTDRLEGHVQGGFGNYSMTELEAVLNLPISDKVKLRLVGASRDRDGFTHDVQWNKDRDDTHWRMARLGLLIEPTDGISNYTMAYYGKSHSNGSGSIARSFNTDYFVGLATRPVPIGGGISYPLGALVPTYNFCGAGTGPADCSYYTNLIDKQKALGIRQTAHGVDDFAKIESWGVNNTTDIELTPGLKLRNIVSYAELKSYYSNDQDGTIAPIYNTGTTVESRTAPRDWYKQFTEELQFQGTALEDKLTYTVGGFYYKQSPRGTMESYSINVCALQTEAGCSIGKSQIAVTNESKALYAQASLDFGALTPSLDRLRLTAGYRYTWDTVDGTTASWSYVKLPNGTPLATNCSWKQGSVTNPLVDCAFGAKLKSSSPNWTFGLDYRPNRNIMVYAKVTRGYKAGGFNSYAVYDNTRTFGPETVTDYEAGFKSDFNVGGMTGRLNVNGFWLDYKNIQRAAGDYNRTTNGNGAITLNNASAEIKGIEVEAMIRPVEQVELGGNYSHLNAKYKSFKFDSNSGVWDCTAQSISSPKVFAGADMTCRPLQYLSPNILSVYGRFSLPMPENVGQLSLFVSYNWTDKQPTAPFSTETFPDGTVNEPGVLLPSYGLLNANLDWKNVMGAPVDVSLFATNITKKNYLISNTGVFQTIGAQTVMYGEPRMFGVRLKYSFGGE

SEQ ID NO: 20052 - protein, 1089 aa, Gloeobacter violaceus
MNMKLVKYMLIAILVLGTGEVAAQVQVVSGKVTEMLGNQIEPIVGANVNIVNVQNRSVGGAVTNLDGDYRLQIPAQENNLTLVYSYIGMKTKRIKYTGQKVLNIKLESNVETLDEVAITAKRIERNNMGIGHKENVSATQKVMMEDLIAAAPIATVEEALQGQLSGVDIALSADPGARSSIRIRGTSTLNGSVEPLIVIDGVPYTQELDDDFDFSTANEEDLGALLNIAPTDIESVEVLKDAAATAIWGTKGANGVLSITTKKGKTGKTTFNFSSKFTAKFEPNSIPMLNGSEYIAMVQEALWNSANYTGLNADTYLKYLYDTPEINYSPNWNYFNEYNVDTNWLDEVRQNAFTTDNSFSMSGGGEKATYRLALGYLSEGGTTIGTGLKRFNSSLRVDYNFSDKLRFGADFYFTQSDKDDNWAPKDSNVRSEAFKKMPNKSPYYMDENGNRSSQYFSYQTKDWEGEFKASNSSASNFNPVAMANESYKNTMSRDSRANFRIDYRILPYLTYSAYVSLKMSTTTTDKFLPQVATGVAWTSEYANQSTAASSESLTLQTENKLIFNKNWKDKHNLIATAVFRTTQATSSSTTSTSYGNASSGLADPITGSSVYSLGSGESEARSISGTGLINYTLLDRYVFHTSATMDANSAMGKSERLGIFPTVGISWNMQNEPFMKNAEDWMDEIKLRFSIGQSGNAPKGTGAYYGAYSSRGEYMDMSAIYPSRMQLNNLKWETSTEYNLGGDFSFFRGRLRLTFEWYNKYIKDLLQKEPKMPTTTGFSKNKWYNSGRMENKGWEARIDGVLYEKKDWRVSAYVNLSRNTNEITELPETMNPEPYTFKNGEYAIRIEEGRPFGSFYGYRYKGVYQNQESTYARDKEGNVMNDVSGKPIVMKNGAKQVCPGDAIYEDVNHDGVINEYDIVYLGNCNPILTGGFGFTIKYKRLSLNASFYGRFGQKIINETRMNNESMYNANNQSKAVLRRWRNEGDNTDIPRALYNEGYNYLGSDRFVEDASYVRLKTLSLSYSLPKKVCNYLGINMLNFFVTGYDLFTWTGYTGQDPEVSLPTSASKLSKDSANTPCSRRFSCGLNLNF

SEQ ID NO: 20053 - protein, 481 aa, Gloeobacter violaceus
MARRRDHRERRAGLACRACGTRRAVTADIGIGAVRRIVTIQRRLVTGSAKNGFVFFANGIRLCAGCATVVGVVRRFRNSRGFACATRESLFLSSEQGGVPTMKKSNVAVMSAIALAIGVAPGASRAQSSVTLYGILDAGITYVNNTGGSHVFKFDDGVSYGNRIGFKGTEDLGGGLKAVFVLESGFRLGNGQLGFGGAEFGRQAYVGLQNNWGTLSFGNQLDMTEEMVYLNNISAWASGYAIHQGDFDRFNGDRLPNSVKFLSNDFSGLRFGAMYSFGNVAGDFHRNSAWSAGANYTHGDLSVGAAYTQLNNPSGIYAFDPYAMIGTRTFLGQPTVSVDPATGKVTDLFANTPMNVDSQGTFGVGASYTIDKLTLSGNFTYSTIKGFGNTSHMQVYEGGGLYQFTPALSFVAGYQHTRFEGHHWNQGSAGVHYLLSKRTDVYLSGDYLRASNGVDAVIGYSFTPSTTQTQADIRIGMRHSF

SEQ ID NO: 20054 - protein, 625 aa, Gloeobacter violaceus
MRRVSRTLLCVVALSGAVLPLVEPTSAQTTYSRIQAFGDSYADTGNLWTFTGGIGKLPLYPTGRFSGGTNFVDTTSALLGIPQLNYAIGGATSGATNVAGPGIPGFFQEWSGLTGFSGKISSTDLVEVSIGGNDARAYYRAGGSFAAAPTAAAVTAQQAMAGINALVGAGARSIVFTAGDVSTLPEAVGNANAPTGKLYSTTYNALMQASLANVARSGVRVEYVDTALIGTLIQANPQRYGFSNVGACPVACIGNPALQQQYLFYVDGVHLTSHGFDVLGQYIVNRLNAPLTFAPQGEVASISAMGFAATLIGKLDMFRETSGFAPSTMNSFAALTKAPSTKAPPLAPVSPWSFYMQGNGGLSNRQGNVASTGFNLDSIGGTIGVDYRLSPNAMIGAAFDYSNPKAKLFNNAGTTDANSYQLGFYGVWANSNLFAEALATIGKQDYRNTRLGVVDTITSNPGGTTFVVAGKTGYLFDAGTAKLGPIAGLTYARARVDGFTEAGDPALTLTVGPQTAETLVGSVGVQLRTPFQVQGATVHPYLNLTLDDDLIGNGRLIQYSATSAPLIVNNWNVPSASSHNVYGRVSAGIVAPFWSNVALTANVSRTIGRTGGDDFFGSGGLKISF

SEQ ID NO: 20055 - protein, 711 aa, Gloeobacter violaceus
MRFQSHLLAGLIASLTAGISCAQTTETESGKLKAVKVEASALGSTTEQTGAYTTGNMSTATKMDLSIRETPQSVSVITSAQMEDLNLFTINDALDTATGVNVKRSETDRTYFEARGFDINNFQVDGVGIPLHWDLLEGDIDMAVYDRVEIVRGASGLMSGLGSPAATVNLVRKRPTADTQASASITHARWDDTRGVADVSGALGSAVRARVVASEQSRDSYLQDYHKDLSSTYGVIEADLGTDTLLTAGISRQKSEADSPMWGGLTLSYEANNGETRPTHFRRSMSSSADWAYWDVKDTRSFVELNHTWSNSWETKATYNRTKTRGAQELLYVYGTLLEDMSGLGGWAGKFNRETDLKLFDITTSGEFSTGDLTHKFVAGFNRADSDLHERAFYDYTTGNGFPVINNMAEWTGDTPHPSFTNEDPGEITNDTQTGIYLAGQFSLTSRLKLLTGARAASYESNSTSYGTNLSKDDDVVVPYAGLTYDLSQQLTLYTSYTETFTPQSEAKLSGERLDPATGVNKELGIKGEFLEGKLNTTFAVFETAQENLATHAGFNNNASLGPIGDYYIGDDYVSRGFEFEIAGQVNEQLNVVLGYTNLTIDDNDGEVARTFTPKQSVKLTVNYNPLWLPGLTLGSFVEYRSDTYLRNNSAVKQDALTLLDAFASYDINKNLSVALNLGNITDETYLTSFEYGQAYYAEPRNISATLRWRY

SEQ ID NO: 20056 - protein, 532 aa, Gloeobacter violaceus
MKMRIAPLWLALAGVCLAWIPPAGAQMANDLTIGNPKAMALGNAVTADETGIDSVHYNPAALTRMKGRQATVKLLTGVMDIRAGFKAPPNYGEGTFGLRDDPVANSHSRTLTPTMYLPGLGGMTDVPLLVAPLAGISINPPGSKFTFATNVYTPQALGYSRDSDSDPARYQGREVSLQRLTYFSPTLAYQVNDELSVGLSVGFSHQAVALNEDFRAPNQLLGLLQQTKEIGCLPGMQEILEVFFNVCGGNIGPFQNLANIDLDMQQSLSPSFNLGVLWEPTDWFAWGATYQSESRMRLKGKYRVDYGQGWQGFWTGVHKSLGGAILGQMFPYGNVDEEHGNATMNMVYPDAFSTGVKLRPFKKWQFNFDLKWNGYSDWNEFKIEFDRELDLLRIAKYLDSKDATSHSITLDRGYRDTWSWAMGVQYDVNDRLQLRAGYEYRPSAIPKGQADILVPIGDANLYGLGLGYQWDKDTVIDVGFNYFVTKQSVKADTSCNLNCTGLDNLVYNPYAGLDVDTTVKAYIFAMTYRTTF

SEQ ID NO: 20057 - protein, 330 aa, Gloeobacter violaceus
MLTMKMKTLAVAVAALACGSQAFAAEVYNSDGTSMSIGGHFTTDIGDNGDNVEVGEVSPRINIVGKQDLGNGLTVEAKGEWQTNLVDGGDTTFSTRLGYLALHSEMGKVTVGTQWSPYYSVASLTDMPIKYANDFLYDGGRSGSWRSIGTGRANKMLSYSNNFDFGNDMSLYFGVGWQGETNAGGSQFDDRGQIAASLSFSDFNVGLAYTGGDVDSEKLTSTAIAASYGSYGKGIYVAGVYGLNENLYGMTDSDQISGLLAYGLDNGLNFILYYENVDRDDNVLDPNRDVLAPQVEYSVTSKLKTFAGFRTHMGDDKSDDEWSLGARYYF

SEQ ID NO: 20058 - protein, 702 aa, Gloeobacter violaceus
MSRNWKLARLVAALTLLPAPGAAEEPAAEPRTEVLLEEIVVKSRREPRADGLEVREVRETPARDLGEALEQTLGLGKVRKAGIASDVVLRGLKRDDVNVLVDGTRTHGACPSRMDPPAFHLDWAEVDGVEVRRGPFDVSQPGGLGGVVDVRTRGARPGPGAEVNLGAGSSGAMESSAVASYGGGRASLLLGGAFKRSDPYLAGDGRNITEVIPATSTGRYRDTSDHQTAYDVRSGWAKVGLTPAEGQQLEVAYTRQEADDVLYPYLLMDGIRDDTDRVNATWRAGALGPLASARAQLYWTRVAHDMDDRDRCSSAADPAACAGGLAEAWSMRTEARTRTLGAKLEAGLGGADAAVEARIGADLVVRNWDNETIRVRRAMPGQPYVGEASIPDVTQTTGGAYAELRHALAPSVRATAGARLDVAESYAGVDRRDFYATWRPDTTPERSRTDLLFAGNVQLDWDAARGLTVFAGYGHGTRLPDPQERYMALAGLMGKPAWVGDPSLRPTRSDELDAGLRFTADRLLAKAQVFHAWVEDEITLVPLALASGATARTYAGVSARRVGGEASARLALPLRLHAGAAVAYVWARNDTAGTPLAEVPPLRASASLRWDDGRFFAEAEEQWAARQDRVDPALGERPTAAWFITNLRAGAGWRGVKAFVGVRNLLDKTYAEHLSYLRDPFAAGVKVPEPGRTLYANAQWTF

SEQ ID NO: 20059 - protein, 1236 aa, Gloeobacter violaceus
MIASLFSGNGAAAVIDSCQGYDIKASCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEMSIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGDTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAISLQNSVAGDTLTVNGDYTGGGTLFLDSELNGDDSASDQLVLNGNTSGNTTVVVNPITGIGEPTSTGIKVVDFAADPAQFQNNAQFSLAGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQGDSRSNMTGTRADNQNHGYAVGLTSSWYQHGNQKQGAWLDSWLQYVWFNNDVSEQDDGVDHYHSSGIIASLEAGYQWLPGHGVVIEPQTQVIYQGVHQDDFTAANHARVSQSQGDDIQTRLGLHSEWRTAVGVTPTLDLNYYHDPHATEIEEDGSTISDDAVKQRGEIKVGITGNISQRVSLRGSVAWQKGSDDFAQTAGFLSMTVKW

SEQ ID NO: 20060 - protein, 936 aa, Gloeobacter violaceus
MPTAVVLAATSFALDFGFIPQALAETSDLSLTAQSVQNSQTKAPTLAFNISPQPLESGLVAFSKQADINIIGVTAILRDHRVAVLKGDFTKAEALDRLLEGTGLSYEMINDTAVSIFVKPQVPETLDEEPFLQEIFITATGRATDLQKTPIAVSAFDQVRLDFAGATDLRALSYMVPGLEMTNTAPQAATLVQLRGVGSTNITEIADGPVSIHVDGIYSPRSQAAVALLYDVDRIEVLRGPQGTLRGRNSPSGSINVYNQQPLLDVLEGNISLGYGNYDRREYHGALNLPVSDTLSVRFAGASLRHDAYTELVDNYLGLGSGYPTNSTELSAFDQAVDYGQDGPEMADKHSWRVSALWQPTEEFRAVTSLERYRDQGTGLAQLAPDLVAKGIRAVVSDSPSFLDLTNTALRTELDYKTDNYSLRYLYGQSQMRRQQIVDADNGRSSSFEQQRTHSSDFTFSSHELQLMNDDTERLRWLLGAFFSREKNEIVFAVDQQNAGGGRFANGATSWINDFDGAAVSFAIQPDRQVESMGLFSQVTYDLDELSSLTVGARYTKDSKSDRDGRAINCRVTSALGSYVGADSIGPGAPSPEDIYADTATQQAINAGTFHDNGTSEGIGDQPCWIRQVNDLNISWENVSGLIRYDYRPSDDLMYFASLSNGFKSGHIQDAGNHVAPETVTNFELGFKAQYLDDSLRLNGALFHADYRDLQFSNEDRLDINFDGIADTGGSTVVRNASAATIQGLELELDWVMTDVDQLQLTAAFTHAHFDQFEIPDTLFGDLFNPYVSDQSLSPEDPVVLSGNSPPRVPDWKLTLSYSHNFIFDRGVLTPRVVLKASDSYFLDIYNRDKLAPGIFDSLPNGGESLGVQQSYKLFDLSLAYQPNSKNWTVAAYIHNLADKNIKVDSGNVLTSAGLIATYMEPRTFQIKFNYSFSGS

SEQ ID NO: 20061 - protein, 819 aa, Gloeobacter violaceus
MRSGAERRLVTEAWADASNGCAIVLLLSTVLTTGMVGVANAQTPGSSAPVAAPAARSASYSFSIPPQPLAGAISAFSRVTGIDVVGDGGIGRGVGSPGVAGNLTPHQALTRLLAGTGLSYRFTNASTVAIQRPNAGGGIGAAPSGSISLDTIDVQGETAWGPVNGFVASRSATATKTDTPIIEVPQSISVVTQDQMQTRQAQSVNETLNYTPGVLAGSNGNQFNSTGAQIRGFNASPTSGSLYLNGLRSINVGDIDPYALERVEVMRGPASVLYGQNEPGGVIGLVTKRPTERPFHEVRLQGGSFGQRGGGFDFGGPVTEDRSLLYRFTGLMREGGNGIDFSNDRRALLSGAVTWRPTDVTELNAFAMHQRDDSKWNYGLPARGTALPNPNGRIPITRYIGEPAFDYSNTETTAIGYNFQHRATDSLVFRQNLQYSHEIWDYRDVAPVGLQADLRTLDRSASRVRYGWDTFAVDNHAELKATTGVLHHTVLFGVDYRMRKSTQQGTWDGVVGPIDVFAPVYGSPVFMPADNFGSVQTQNLTGIYLQDQIKLERWILTLGGRHDWVDTRTVGIFNNAVNNQNSSAFTKRAGLGYEFDSGMVPYISYSESFVPTSGTTFDGTPFKPTTGIQHEAGIKFQPKDTNLRMTAAVYDLRRQNVTTIDPAHPGFSIQIGEVTSRGFEFEAVASLTSNLNLTAAYAYNDARVTRSNGADLGKRPFRSPPHLASLWADYTIREGALNGLGFGGGIHYVSASVGDALNTFYAPAYTVVDAMIRYDIDNWRFSVNATNLFDTQYVAACFFIDQCNVGRVRTVLGRVSYRW

SEQ ID NO: 20062 - protein, 109 aa, Gloeobacter violaceus
MSAQPVDIQIFGRSLRVNCPPDQRDALNQAADDLNQRLQDLKERTRVTNTEQLVFIAALNISYELAQEKAKTRDYAASMEQRIRMLQQTIEQALLEQGRITEKTNQNFE

SEQ ID NO: 20063 - protein, 743 aa, Gloeobacter violaceus
MMIRDPFKKVSKRAHYLCTAFIIFALLTIPAVGQTGPTATLRGTVTLGDSDKPIHNVLITILQLKRTVGTNEQGQYEFQNVPPGRYDILAHLDRVPDIVQRIDIAPGTPASLDFQVQLSGLQEQVTVTATGTAQSLTSSIQSVEVIGSVDLAKKSPVSLGEALDGELGISKRSFGPGTARPVIRGFDGDRVLVLQDGNRIGGLGFESGDHAEPVNVLTVERIEVVKGPATLLYGSNAIGGVVNAITGHDTAHKGINGYLTGLGSTNSSQAGTSGGVEIGTEKWLFWANGGGQRSGDYSTPIGDVPNSFSREVNGSAGFGYYPSKGFFSFNYNYDKRRYGIPYDPNEVDPEIVFLNPRRHSVEFKGGFKEANSFLDAGTFSIQYNDYAHSEINSLTNEVNTAFKNKTLLFQGIFDQKKIGKLSGRFGSWGSHRDFSAAGEEALAPPTKQRSFALFALESLDFERASIQFGGRLEHNQYHPDATTSRGVLPSRSFTGFSGAVGLRIPTWSGGSFVTNYSHSYRAPSLEELYNNGPHPGNLAFEIGNPSLKRELGNGIDFGLRHSSKRLRFEANGFYYRISDFIFLAPTGAVEDDLIVAEYRQAVTRYAGTEAQLDVSLHPAVWLNLGADYVNAELTDTQTPLPRIPPLRAKAGLEIRYKGLLLNPEVIVANAQNRLFPNETRTAGYTTFGLSGSYLFARQHAAHIISFNGFNLGNRLYRNHLSFIKEFAPEMGRGLRVTYTLRFF

SEQ ID NO: 20064 - protein, 754 aa, Gloeobacter violaceus
MRVPSPSLPSVSMPVALLRSVRAHSRLLLALQCAGALCATAAHAQDNAPAPTANTLDQVLVTGRTEGYQVRGTNTATKLPLTLRETPQSLTVFTRQRIEDFNLITIAEVLQQTPGVTVQSYDSNRTLFAARGFAISNFMFDGVPTNYTTGAGGNSILSDTSIYERIEVVRGASGLVTGSGNPSATVNMVRKRPTTAFQASTSLNVGSWDYRRAELDVAGPLTSGGRMRGRVVGAYTEKDSWVRFQQDRSPSMYGVLEADLTDSTRLRAGIDHLATHSDGGAWSAAPLFFSDGTPARLPRSYSAAARWNRWERESTNVFATLEQQFAGGWSGRLAYNHRATDTDSLLFAGSNSASFADARTGLGLRVSDTYGVSETRENALDLYASGPFQWLGRAHELVVGANHYDRDLGTLRTAITARPYSLTAFPSIFDWNGDVGRPTTTNAGIPSSITNTQETGYYAAVRLNPTDALKLIGGGRYSSWNTATDNYSPANQFTGRSADYDADALTPYLGAIYDLSRHLSAFVSYSDVFQAQNLRDRTNQQLDPVVGANLEYGFKGEFFGGALYAALNGFHMQQDNVAEIDPEVAPNSLPDGSSAYRAVSGVETWGGEFEVSGAITPDWSMTGGYTYAYSTDQRGARVFTTSPMHLARFNTTYRFGDWTLGGGISWQSAVYQNQTIPTGRFTAAGAPITRSGRVTQGGYLLVDLMGRYRINEQLSVGVTVTNLFDKVYYRNVGFFNSGYWGEPRRLLFNLRANF

SEQ ID NO: 20065 - protein, 740 aa, Gloeobacter violaceus
MQRKYLSSLLQILVGCFLTAAVSTDAFAQQDTTSLKDIFSQFSLKNLMDVRIVTVSKKEEPVFEAPLSSTVLTAEEIKNAGATSIMEALRLVPGVIVREQTPGNYDIHIRGFDAVNPYQPQFTRFNTITLVMINNRIVYNPLFGGTLWDLLPVSIDDVEKIEVVRGPASALYGPNAAAGVINIITKKPNLDAGWHGSTYSQVGTYHSYLLNAAANYASEDKKWGVRVSGYHDYRRRHYVDYYTFPDVYAALNGDENYFRSAYRSTPYLGSDGQPNSNASTLFPDLDKSMDRYSLHADATYKDGALDLNFSSGFTRSWVQRPYLAPSSYMLTTEENENEYVHIYGTFENLTFSADYSSLRNNTLGALDYSLHSWNATVDYNLILSESASFKPGAAIQRYTAISNQSSAYVSYSPIVDLEDFEDGDGSEASNTFFSVFGRFDYSYKRFRFVAGLRADKYEYPDRIFVSSQLLTTVMPSNDVLLRASYGRSGRAPFATSLFANLNPTETIGAQLISNPDKKELLTVDVFEIGSRIKLSDKWLLDAEVFYALADDFESVAVNAFVDLTEEGEVKDIVPQFEYINGSYNAKQYGGTITLKYIPNETIQLSGFVTVQETRVDNYDYQNGFFENAILPASTTDSSFVVQATPTFYGGMNMTFKPVKKWQLNLNGYFYDSQVFTIAEASLKTFKIKGNFLLNTVVSYELTDKVKLFVNARNLIGGNKRQYAMSDRIKMTMLGGVSAQF

SEQ ID NO: 20066 - protein, 659 aa, Gloeobacter violaceus
MGVFNKRKIALGIIATISSGSVFAASSSNDTILVTTAAGFQQKIEDAPASISVVSREQLETKAYRDVTDALKDVPGVVVTGGASSSDISIRGMAAQYTMILVDGKRVDTRGTRPNRDNSGIEQGWLPPLAAIERIEVVRGPMSSLYGSDAMGGVINIITRKAQKEWKTSFRADGTLQERSKSGNSHQSSVYTSGPIIDGLLGLKVSGLYSHRNEDKFIGGFNKQEMRNGSATFSFTPDEQNTFDFEAGRYEQDRDSTVGKTKTSSWRSPGNSESRYKRNNYSITHNGVYDFGTSTTYFQRDESRNPGRDMKYYDNLFNTHTVFMLDDHSLSIGGQYRYEDLRDEGNQLASAKNINKLNRWSWALFAEDEWQMTNDFALTGGIRMDKDENFGDHWTPRLYGVWHVDEQWTIKGGVSTGYRSPELRQAASNWGQITGGGGDPAIIVGNPDLKPEKSFNQEIGVIWNNRDNFNVGLTIFNTEFKDKITELRRCTDPSGKSQGKCVIDGTAYKFISDRVNIDKANMRGVEATMNWDIVDNWVLAANYTYTDSEQKSGNFKGKPLNKMPKHMANATLNWQASPEMQAWTRVNYRGKTSNYLSRTSMGTGTPSYTFVDIGVSYYLAEGLRLVGGVYNVFEKQVTEDTHDIVLDGRRYNIGINYDF

SEQ ID NO: 20067 - protein, 393 aa, Gloeobacter violaceus
MEPASSWLNYGKLRFSWGQNGNRDIGQYDALAKLNSGLHPYIDQNGNIYVTSQIYVDRMANKGLKWERTSSYNIGLDFSLFNDRLRGSMETYMTETTDLLVDRALPSILGFASVKANLGKLANKGFELSLNGDIIRTNDFTWTSSGSFSFNRRKLKSLYGDMEDVLDENGNVIGQKEKDDPKNGWFIGHDPDQIWDYEFGGVWQLGQEEEASKYGCKPGDFRFIDQDGNGVLDDDDKTFQGYKTPRFFWSWRNEFIYKDFSLSFMLYSDIGHYDYYNHASNSGGMFDRYSTYDQPRWTPENPTNEYGRIGSYRFANYYKKKTFVRMDNISLSYAVPKDFLKKFKVQNMRISLTARNPFTITGWDYFDVEATKKNRDDGLYGMRSYNISFNFTL

SEQ ID NO: 20068 - protein, 1072 aa, Gloeobacter violaceus
MDLKRLAKRALATLSLSMLCLVALAQGRQVTGTIIDSTGDPVIGANVLEVGTTNGVITDIDGNFRLMVQPNAKLQISFIGYITQVITVGNQNNIKVTLKDDAQALDEVVVVGYGSMKKNDVTGSLSSVSADKLAARGALRIEDALQGSVPGVNITQSNSRANGSFNIQIRGQASINNTSGPLYVVDGMVVSSIDFLNPEDIERIDVLKDASSTAIYGSRASEGVVIISTKGTGAGQNKAQPVEITYDGYYGIRKVARMPDFMDATEWMNYRFARYTTGSSDETGRGAYKITDSDLQSVFQNGTEWKGSPLYNSWLNNEGYDWADMVLRTASQQNHFISASGATEKTNYRLGIGYQGEENVFKKNDYNRINIKGSFDSKLSKVVEAGIAVNLVHDVQNDWITDTSNAYSPYNNAFWFAPVVSPWDEDGNLLAIPAKVGNMSLTSTPSPLVDFELDAYENETRKFHVFGNVYMRFNIMDGLKFTTTLSPNYYHGRQGIFMGTGVSEKYPLGTAYYQNQKHNQASVINTERLDWTWDNQIDFSKTWGQHRLNAMGLFSMYASNRETYTQTVTDISDDKLSYHSMEKGSGTKTIKSTYTESSLVSVAARLNYAYKERYMATVTMRTDGSSRFAKDNRWGWFPSAAVAWRASEEDFLKDVEWLDNLKLRVSYGITGNNNVGDYATASSASGPNYSVIGGQEYQGYYANGLIDRNLIWEKIKEFNFGVDFSVLQNRINLTADTYRRLSDGQIMKATVPLETGEGSITTNIGAVRNTGIELGLNLGVIRNKNFTWDVNLAFARNWSKITELPNGDDVSNNWFIGERLNVLRDYTSAGIITTDGITMRTKDGDRHYTLQEVYDTFGPGGQGLKWYEGQMAVNDWNNDGKINDEDKQIFGCTDPKWTGSLSSTMTYKGFDFSFMLYTKQGQWSRSYFHEQYMNYGDRGRQKVNFDYYIPAGTPVLDKNTGDVTYLSEAHIGKYPYPNNTEKTGGGYFSSSSAAVRYHKTSFVKVKNITLGYTFPKAWLSKIAVKHLRLYVNVINPFCFTDYEGFDPEWASANLTNGGPASVTYQIGANIKF

SEQ ID NO: 20069 - protein, 359 aa, Gloeobacter violaceus
MDKRLSALCGLGLVSAGACAQTSVTLYGVADAYIEYATNQTSANGEPAALARMGSGGKSGSRWGIKGTEALGDGWRATFRLESGTNLNNGAGTGAGGFDRSAWIALEHPRWGTLRFGRQYTTLFDIMEHYSPTGAYSTLYEPDGAIVGINFRENNVVKYLATAGPLTFEAHYAFSNAPGAFQASAAHGAGIEYTGGALSFAFAYDDVHTPQAGSFAHFRRYAAAAMLTVEATQLIAGVAHGQGGVATPSVVTRYAFWWIGVREAITPVVQLVGALYAQRVLAQNPASAPTARHASGTPQQATLQLNYFVSKTTTLYAAAGYARHAALDFDDYNYGFLHYSLAGGRCGSAGVAVGVRKLF

SEQ ID NO: 20070 - protein, 793 aa, Gloeobacter violaceus
MVLGMTVAAPVQAQAQTQQYDFNIAAQSMTAALNQLAEQTNLQVLYSPDSVQGLRTQGVQGRLSVAQAVQQLFNGTSLRYSLDGNTLTLLAKTDDGALNLDASVISSTLVSDSPYGETPGYIARRTLTGTKTDTPILENPQAISVITRERMDDLGAQRLSQALSYTSGVRADSGGASNAADNIFLRGYAISFTYRDGLRLRPLGFFGMIGEEPYGMERVEVLKGPTSILFGQNEPGGMVNSISKRPTDYERGEVAISGGSGHRRQANFDISGPLNEDKTLSYRLVGLGREADGVYDHTDDDRAYVAPSLTWRPNEQTSLTVLTAYQKNKALAPTTIPWAAVNGSSPYGKVPMDRFIGEPGFDTEEVESTSLGYEFSHEFNDTWTVRQNLRWSTFDNQENYLARVSGLVTGPDGVPNASVNRDYQIRHAYGDLFTVDNQLQARFDTGPIAHTTLMGVDYSWSKSIRNERWGRATPINVFDPSYGAPVDTSVYTAWVNTVQRNTQVGYYFQDQMKWDRWVLTLGGRQDYARNRTEDRFTDVETADQDWDAFTGRAGLVYLFDNGFAPYVSYSESFNPIAGTGAPQRGSKTFEPETGKQYEAGIRYQPPGTETQLTLSVYDLTKQNALTPDAEFIGYSIQTGEVRSKGVEFEAITTVAEDLKLTGSFSYSDVEVTKSNSGNEGKQPFKSAGKLASVWADYSFPFDPLQGLSIGVGARYTGSTYGDAMNTFKVPSYTLYDAAVRYDLGKLDPSLRGAQASVNVNNLTDKYYVASCFFSLACNMGEGRSVVAEVSYKW

SEQ ID NO: 20071 - protein, 1090 aa, Chromobacterium violaceum
MVYFAPKYKQKKRFQMKKLLLGLFLVMGIGIYAQGVTTSSINGKITDNIDQPLPGANIIAVHTPTGTRYGVVTDFDGFYRIPNMRVGGPYTLEISYVGFNDITLSNFFLQLGDSERISKQMSESDNALDEVVISASRNGIFDSGQTGSNTNISQRQILNLPSATRSLGDFIRTTPEAQVGENGSISLGGQNNRYNAIYIDGAVNNDAFGLAGSGTNGGQTGVSPISIDAIESFQVNLSPFDVRQSGFAGGSISAITRSGSNNTEGSAYYYLRNQDLAGKTPTALNEDDRERLTDFSAKLFGARVGGALVKDKLFYFINYERQDEETPQPFEFNRYQGDTQNRQAFTNLRQGLINTYGYDPGVFDNNTSSLVSDKLIARIDWNVNDKNSITLKNSYVNAENTSPNQSSDRNINYTNAGVFFPSRTNSTTLEWSTTNGSNMSNNLIVAYTDVLDDRNPTGNPFPSVRIFDGPGSINFGSEAFSTANLLEQKTLNITNNFEVYSGRHKLTFGVNFEYFDSKNVFFRQNYGQYAFNSLDEFSTYLDNIDGNEAPARFFDRGYSLLGGIGDDSLGAAEFSYSQLGFYVQDDIDLSDDFKVSLGLRVDVPYFDDGLVNDDFNTRTVELLEANGKDLQGARVGKAIKSQIHFSPRLGFSWDVGGNKLTQVRGGVGVFTSRIPLAWPGGAYNNNGLTAGFVDERAIDGDIFFNGDPFSQPVQPGAEPGTGARGGQIDIFSPDFRLPQVAKYNIAVDQKLPIWGLIASGEFLYNDVLNAIFYENLNIKGPVGNLNGADNRPYYDRRDLIDDAYSNIILGTNTNEGYSYNATFKLTKPFENGFAGQLAYTYGESYNVFEGTSSQNSSQWRNIETVNGKNANPGIQRSNFALGSRITANMSYEYEWNDNVKSTVSLFYAGEEGSPFTYVYNNRPSNLLNDDSRDNALIYIPRDASEITFIGTPAEQAEQWEAFNGYINSSDYLSERRGQYSARNGERGPWSHIVDLKFLQDFSVDLNDKNHTFQLSFDIFNFTNLINKDWGRRPFIPGGVGILNVEEGGPDPVFSFNADQFQTEADIENFDDSGILSSRWQMQVGVRYIFN

SEQ ID NO: 20072 - protein, 851 aa, Chromobacterium violaceum
MALFLGLTTEYDRVVSVRCVLKPLIVLVLLALMGTHAVYAEEEIEFNTDVLDVQDRARIDLKEFSRAGYIMPGDYQMAVRLNNSELPEMPVTFMVPPDDPKGSVACLPPELVKQLGLRAEWESKMTWWNNNQCLEIKTLPGMTVRGDLSSDTLYLSMPQAYLEYHSPDWDPPSRWDEGIFGMMFDYNVNAQIAKPAKGSENQNVSANGTTGINLGAWRLRADWQSQYNHVTGRAGSTEKNWDWSRYYLYRAIPHWQAKLTLGEDYLNSDIFDSFRFTGLSLVTDDNMLPPNLRGYAPEVTGVAKTNARVTIRQQGRVLYETQVAPGPFRIQDINDAVSGKLDVRVEEQDGGLQEFQIDTANIPYLTRPGRVQYKLAAGKPTNWKHHSEGSGFGLGEFSWGINNGWSLYGGILGAGNYNALSLGIGRDLMVFGALSFDVTESRAHLPDEDQTLTGGSYRLSYSKRFEEYDSQVTFAGYRFSERDFMSMSQYLDRRYHDGDAESNKELYTIMLNKQFTHIGTSIYLNYSHQTYWNRSNNDRYNLSISRYFDIGSYKNINLNLSAYRNKYEGKNDDGMYMTLSLPWGNSGTISYNAMANREGNSHTVGYYDRINENSNYRLAVGSSIDGKAAANGYLTHYGDRAQLTTSASYQDGRYTTGALSIQGGMTVTPKGAALHRINMPGTTRLMVDTDGIGGVPVKGFGAITHTNMFGKAVISDVNNYYRNSASIDLNKLPDNVEAIRSVQQATLTEGAIGYRKFQVISGEKAMGMIRLSDGSSPPFGATVLNKDQREIGIVSDGGNVYLSGINPAEKLDVRWDGELQCVIELPQELPKVEEMASLLLLCQLADDNKQP

SEQ ID NO: 20073 - protein, 401 aa, Chromobacterium violaceum
MNKKLGLAVAGAVLAFGASAANAGIIIPAGDWTIDIGGNVNTYYTNTRYSGEAFANNARKNQVSTGLLPSAIGIGGKTRQNDLDIAFQFTFFVGANADSGFGTTGTAQGANGNWQSRAGDGNSINIRQAYMTFGDASWGTIKAGRDLGLFGSDAILSDMTLLGVGVGAGRPGNSTLGRIGSGYVYADWIGQIQYASPNWNGFSFAVAAREGLRNDGVAAGTALADDKTELGFDGKVSYEWTGDVSGKVWAGYITQKHNNTKTGDYRSRGYDLGGKINVADFGLVGYYYDGKGLDMQTGGQLGGLQFLGGNKSDDKGGYVQATYKLPTVGTKLGVSYGVSKSEERTNAYDIENKSWIVGAYHPLTKSLNLVAEYAQQKIENNVVGGLDGKAKTVSLGAILFF

SEQ ID NO: 20074 - protein, 335 aa, Chromobacterium violaceum
MKKSLIALAVVAVSGAATAQSSVTLYGIADASFGVVKNGSVTQTKVDSGLLNTSRFGFKGTEDLGGGLKASFLLEQGFNVDNGSSLEDSQDGQTKLNQMFSRNAYVGLSGGFGEVRLGKVWSAFDEMKGASNAAWDSGLSPNSGVFYGGAIGGYTYNPRNSVIYFTPNVSGFSGAASYSMGENKTATVNAGRVAALNVKYAGGPLYVGLGHQTERVNGSVPTKKFTMLNATYDFGMATLQASVGRQSQNDLKTRDWTLGATVPVSGLLSVSGGVAGSTDNVAAGDIKRKGVSLAAQYALSKRTFLYTGYHATRTTYPVLPRLNTSLYAVGVSHLF

SEQ ID NO: 20075 - protein, 825 aa, Chromobacterium violaceum
MNKKALLLCTAAVTMALMNFNFNANAKTLVVEDGRTENVSDETYQSTSPAMEDSAIYVTNGTVTGTNITLTSDRNSTGVYVDGANSKVEVNNITITGKITTTGKITTGFFVTAGGQVTINGGSINVGAIGIVASSNNNVQQPTLVTLNDVNITANIGLYSSHQNTKIIMNGGTVTGNMFAFSASTGGTIEVTGVSAVAGQIGIEISDVSSKVNLTNTKLIVENGVGIGATGNIVSGEVNLKNSEIRADILLKSSTFNENPSNFKLKTENSILEGGVQAEEHDKISFDLTNTTWYLKISNQNNGALFDLQDRSRSQISELKLKDSSIIFNEPTGDDYQTLVIGSKKSASFVEETNNATATYIAEGNAQIHLNTEWSNGEKIEDQKTDRVLINGDVSGTTIVYVKLKNDGDESKSEEEDTQENTSIPRNQKGVSLIQVSGKANENSFKLAHGYTTLNNTPYKYMLYAYGKNSSNGVADADQNLVGEGDDFWDFRLQEEYIDPHSGVQALVPQTASYLVLPNALFSAGITDMNNQNTFLSNRRSVPLYMIEDKKNIFLISSYSDSLTLSSNRSALEYGYGAGMYYAALQAGLALTTLEHKNSTTLFGLLGTYGELSFTPKDMEDSDKSKLNKWSLTAYGSTQYNNGIYLDTLLSYGILNGYITNALIGNTAKLDGTKILSLSATIGKPLQTGVENLAFEPQAQLAYQHLSFDTIADIDGFDVKVGSPEQWLMLIGGRLIKTINSVEKREAFSFYSKLNLIKTFGDEGSLWIGDEFQRDSIGSFIEGGVGMSAQLSQHVSLHSDISHRHKLQKAGISGNSFSAGMRYRF

SEQ ID NO: 20076 - protein, 75 aa, Chromobacterium violaceum
MQAAPQREETEWRVQSKRGLMPAYRGEAGQQVNIKIMEYSERNVRQLASNEQEEYIPRKINVGVINTPTLIRSDY

SEQ ID NO: 20077 - protein, 350 aa, Chromobacterium violaceum
MKKTLIALAISSFAVTSVSAATVFDKEGTKVDVSGSVRLLLQRETNHRTDLKDKGSRVTFDVTHQLGEGLSALGQVEVRFSDKGIGDQTKISRLFAGFNHEAVGKLTFGKQLTIGDDIGLSDYTYNLGGVNKLVTSGEKVIHFKSADFAGFRFGADYVFDEDPSKTEAVNEKNINNNAYVLGVLYNRTVGDLGFALEAGYSSKKIGDAMLSVNQKAWTVGGELSYQDFAVAVDYSQVKSGDVSTILWRGQKHPGQPNQDDSFHKVREVELGLKYQFIPESKIYTDFIWGKAVTAYDRTVRLRAYIAGVDYKFHKNVVTYLEGGVFRYKHDNDLDPTLRDKKLGVGLRVFF

SEQ ID NO: 20078 - protein, 286 aa, Chromobacterium violaceum
MKLKHLPHCFALSAGLLAGQQALAGDLLYWQDNSLSYLYGENFQRMNFNGEEQRTQTTFTFEHASGWVWGDVFYFLDYIRADNVQSRGSFDNGTFRQHEKNSFYYMEFSPRISLSWLTGQKLAAGPIKDIYAAFTYEKGEGGPGPENYLYGVGLDWEIPGFNYFKTNLYRVKINNHTFFNDADSNGYATQLTVSAAYPFSLGDQDFVVDGFVDWRSPSRDAGTQTSVGSSIQVKWDAGKALFGKERQLYVGTEINMWRAKYGVKPVDGSGDRFDQTAVQALVKYHF

SEQ ID NO: 20079 - protein, 373 aa, Chromobacterium violaceum
MCITGFRNPAKPMRFRCNAGGKARHHLHTPNRPAGWGIRERQEGNIMKKALIASTALLLTAGVAAADVKISGYGRTGVIYYENDSDVNESRVQSRLRMNIDASSSTDSGVDFGARFRLQWDQGEEGEARLQWDQGEEGEAQTNAGKLWVSAQGFTVEVGNVDTAFASNGLIYETGLGSYDRSVGFSAVTGAFFAYDSNGYGIDEVDRVGIRALYTLGDLTLQASYVDPDQSGTVIGVEEEFGFSVDYTWNERLELSAAAAFNGAGIDGNDIYFLGARYAVMDNARIGLNFVDAGDEEDGYDGKTIALYGDYTLADGRTNLEAYIANNDRDSNETDNAFGIGVNYDLGGARLGASLQRDYAENVTADFGVRFEF

SEQ ID NO: 20080 - protein, 453 aa, Chromobacterium violaceum
MKKINKGKSLSRLQLVCKLSALGAMGLAGSVHAAEPFAADSPWMTGDWGGKRTELLDKGYDFSLEYVSEMASNLKGGYNDDTTGRYSDQFALGMKVDLQKVLGWQDAEFKLAITERSGRNISNDRIGDPRAGTLSSSQEVWGRGQTWRLTQMWIKQKYFDGALDVKAGRFGPGEDFNSFPCDFQNLSFCGSQVGNYVNTWYNWPISQWALRIKYNITPEVYAQVGVYEQNPSNLETGNGFKLSGSGTEGMILPVELVWTPSFNSLPGEYRVGYYKSTPNANDVYEDVNGQPQALTGAAFKSHSSKHGWWVVAQQQLTTHDGDASRGLSIFANATVHDKATNFVDNYQQIGFTYKGPFNSRPKDDIGIGFARIHVNDDVQDRVRLANQISGINDYDNPGFLPVQSTEYNSEIYYGFHVTNWLTVRPNLQYIKHPGGVDQVDDALVAGIKIQSKF

SEQ ID NO: 20081 - protein, 627 aa, Chromobacterium violaceum
MQKKMSPVQILSGKELEKLNVYSVADALRYFSGVQIKDYGGIGGLKTVNIRSMGSHHVGVFYDGIELGNAQNGVVDLGRFSLDNMEVISLYNGQKSAIFQPAKDYSSASAIYMQTRKPLFKGEKKNNLNIGVKGGSFSTINPSLLWEHRFNERISSSISTEYMYTSGRYKFTYAKKDGYDTTAVRQNGDVRMLRLENAFFGKVPKGEWKAKAYLYNSERGYPGAAVREEPGKFRHQDRQWDTNLFVQGSFQNYFKPWYSLLANGKYAYDYLHYLSDPRLDVTTMYVDNHYRQQEIYASAAHLFTIYPWWSMSLSNDFQWNALRADLIDFVYPTRNTILTSAATSFDFNRLMLQASLLYTHVDDNTRTKGANAGTKNKYTPSVIATWQPLTKLPLNVRAFYKKVFRMPTLNDLYYTFIGNKDLKPEYTTQYDVGITFSHTWNNHWLKSLDLQIDGYYNEVDDKIIAMPTSNQFRWTMINLGHVEIRGLDAAIRGKWGFGKVELSTLFNYTYQKAQDFTDPTSEWYGGQIPYIPWHGGSIILNGSYQTWSCNYSFIYTGERYEAVANIPENYAQPWYTHDFSLSKTFQWGKTGIRVTAEINNIFNQQYEVVQCYPMPGTSFKIKLNVML

SEQ ID NO: 20082 - protein, 1072 aa, Chromobacterium violaceum
MRKKQDPISLPKRIVLGTSLILASTYTVAWAGNTQNETPHHHAIESITQVKTVTGVVTDQYGPVIGANVHVKGSTTGTITDIDGKFSIEVPVNSVLEISYIGFLTEEIQITGTTKNLNIHLKEDSETLEEVVVVGYGTQKKVNMSGSVSSVNVGELTESRPITNVSQALAGVAAGVSVMSGSNQPGNDNATITVRGQGTLNESAPLVIIDGAEAGINTVNPQDIESISILKDAASAAIYGSRAANGVILITTKQGKAGSIHIDYNGYISCTSTTIPHHMDPVSNYADYMELINEGYEQSGMAKPFKDQALIEEWRADAGKNPLKYPNTNWLEETFKSSVAHNHVISMNGGSEKIKFYSSFGYQNNPGVMENTGFEKYNARLNVSADVKKWLNLAAQVSGYVSNMDPAAKYQSEGSTVSDVFKFASATTPGMVFRAPDGRYGAMNNSEDSSQSANNNPLLRLNSVDGNIHKTNVRSRFIATLKPFKGFTLTGSYSYEFVDEERSSKPVFLEGWDFRNEIVTFTNKKKSSIMNYDGKIDRFFNDVVARYETRLINDALGINAMLGASQEKYRSHNFKATKYDMIDTSLGVLNGAIGDASASGSSAEWAMRSFFGRVNLDWQQKYLLEINLRADQSSRFLKSKRTGYFPSASFAWRLEQEKFMEGLRDKGLSTLKLRLSYGSLGNNAVGNYDALALYANKNDDGAFNYSLNNLVALGLAQARIANPNLTWESTYMTNVGIDFGLFNNRLTGTMDYFHKKTKDILINLPAPAVHGIASIPKQNSAEVWNQGVELTLGWQDKIGDFSYSVNGNFTYVKNEVTKYKGKDKGGITYSGANIIWEGHAINSQYLLRCDRIIQTDEDLALVQQMIDNAPVVDGKKVDPFAAFGTPQKGDLLYKDINQDGIIDMDDREIVSDGPNPKFQFGLNLNASYKGIDFAMLLQGQAGAKIYWQNDLANTPSVRHGYQLNKEVADGRWYEGRTDATYPRLLEYQDQRNKQMSDFYLENLAYLKIRNIQLGYTLPAKLTKKISLERLRFYGSLENFFTFTSFRGFDPEIGGSIDYPAMKNVVFGINLSF

SEQ ID NO: 20083 - protein, 904 aa, Chromobacterium violaceum
MGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGQRLQLRQQQQQLSQQIVAAADEIARLAQGQANNATTSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALYQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSNVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDMPCALMGDPRRIRQVITNLLSNALRFTDEGYIILRSRTDGEQWLVEVEDSGCGIDPAKLAEIFQPFVQVSGKRGGTGLGLTISSRLAQAMGGELSATSTPEVGSCFCLRLPLRVATAPVPKTVNQAVRLDGLRLLLIEDNPLTQRITIEMLKTSGAQIVAVGNAAQALETLQNSEPFAAALVDFDLPDIDGITLARQLAQQYPSLVLIGFSAHVIDETLRQRTSSLFRGIIPKPVPREVLGQLLAHYLQLQVNNDQSLDVSQLNEDAQLMGTEKIHEWLVLFTQHALPLLDEIDIARASQDSEKIKRAAHQLKSSCSSLGMHIASQLCAQLEQQPLSAPLPHEEITRSVAALEAWLHKKDLNAI

SEQ ID NO: 20084 - protein, 724 aa, Chromobacterium violaceum
MRTPYRPAMRHAWRLLPLGMVVASPLLAAEVLSLDAVNVTGFSEPESTGDYKAERASMFGFDQASLLDTPASVSVFNAALIKDRQAKLLSEVLRNDASVGDGYAPVGYYENFVVRGFSLNAANSYRINGRSIAGEQNVALENKQQVELLKGLSGLQSGVAEPGGVINYQTKRAQDVRSVTVSTNEHGERYIATDVGGWFGSEQQFGLRANLAHEDIRSYVEHADGQRDFASLAFDWNISERALLQLDVEYQSKEQRSVPGYQLLGGTTLPHDASPGKLLGYQNWSNPVGIDSLNINGRFEYRFNDNWKGSLSASRSRVVIDDYSAFAWGCYGSASCAGQAVPNHFSAEGGYDIYDFRSPDDTRRNDEVEAAMSGTFTTGSLGHELTFGSSAYRRTVDTRGTFNEFVGSGNIDEAPEQVAPSTQALPHTERRLDSRQYGLFATDLISLNEHWQTVLGGRGVRLDEQAFNEDGSDARHTERYVFLPQAALIYKPVDNVSLYTSYSKGLSLGGTAAWFTTNASEILAPTVSRQLEAGIKYDWQRMSLTAAVFQARQAYQYSRPNDDGTFTYVQQGEQKNTGLELGASGWVTDRLQISASAAAIRARVEDSGTEAYDDHQALNVPRYRGTLQADYSLPVPGLALLGGVQYSASKYADREGTVQVNDYALFNIGSRYSTRISGYDTVLRLTVDNLFDKRYWRDAGEYLGDDYLFMGAPRTARLSATVNF

SEQ ID NO: 20085 - protein, 717 aa, Chromobacterium violaceum
MPFRQRAVPRAALPSTLLVSGLVLSAPVLAQAPPESATLSEISVSGTASPATGRPAGSAETAGSLTVPSVAAQRAAVNATVGSVAFVDAATFQNRYANTVRDVLKDVPGVFVQERYGQEMRLSIRGSGIARGFHVRGIELLQDGIPLNLADGSGDFYQIDPLSLRSAEVYKGGNALTFGATTLGGAVNFVTPTAYTALSPNSVRIDGGSFNTIREHFQLSRISGPADVLISGTATNSDGFRDHETQRTRNVNANLGYRLAPGVETRFFLGFYDTDQKLPGSLSLFDALNHPRLANPAALAGNQSRKVTTERIANRTSFELEVGRLDIDSWAIHKSLYHPIFQVIDQDGWTYGVAPRWAGTFDLGGFRNDLILGLRAFAGINDARQFVNVAGFRGAQTLDARQSASNYEAYAENRFWFRPDMALMTGAKLFSANRTFSDRGGLPASPTARFANVTYEGINPKLGLLWQPLPEIQVFADVTRSRDVPDFSDLVQANLLGTTFVPLEAQRAWTYEAGSRGRIDRLAWDVTLYRAEVRDALINFTPNPGLNIPAATFNAPRTRHQGVEAAVTLDLATDLTGVGDRLAVTQIWTHNDFRFVGDPVFGNNRIAGVPVNVLRTVLGYRHPSGFHLAPTLDWVPQGAFADHANTLKVPGYALLGLQAGIDFANGVSLFVDARNLTDERYVSDMSTVTNAATVAGGPVAFFPGNGRSVFGGVRASF

SEQ ID NO: 20086 - protein, 210 aa, Chromobacterium violaceum
MKKIVFYMSMFSIFFSATALHAQEIKVYAALEAGTYTVKYVESGISRGFSTVKSGIPAGILRVGLDYGYFGGELRFGLMKTSSSSYSAGTLGHAAPFTLDFRNGPFFSYLGKVQYPVTRSFNVYALLGGTLSKFSINPLGNGTHLDYNAVKTGLSYGFGVEYKPRPLFAVGLEWMQYWTNVETSLSNGNRSNTTFGGFGLSFRRSFDLGL

SEQ ID NO: 20087 - protein, 1106 aa, Chromobacterium violaceum
MKNKRKAILLVGALLCLNLNIFSQNIPLKMNKVSVKKAMTELKEKSGYSFVYIAGDLDTKKIVDIDAEQLQEVIEQILEGQNVSYEIKDKNIIIRKKEVEQSMLNEKKLQDISGLVMDVMGEPIVGVNVMEKGTTNGTITDMDGKFLLKAPANATLIISFIGYKTLAVNLEGEKNVNITLKEDLEQLDEVVVVGYGTQKKSSLTASVATVPAKELSKQMGHSVAAALQGRAPGVEILQKGGEAGADIKILVRGAGTFGATEPLYVIDGAFSNNGLNSLNPSDIESIEILKDGSAAAIYGSRAANGVVLITTKHGQKGKAKVEISANYSLQTPSKYLDFLDANEHREYTKQIVANSTNQTQAPENIHPTNPDINTDWQDAYLRNAPMYNLNASISGGGEYSTFNTSLGYFDQQGIMEFSGFKKYNARVNGTFKKGRLTVSETLSAAFTNKEPQVRMVMGIPTVPMTDVEGRYVSAGKDYYVNEGKVTNPFASYSNTVRRNKTVNVTGSLNIGLNLYKGLDYKLLLGGDYISTNNISRSIAFDSNWDENGNADPDYSRTINSLSESRGQRFSYTIDNILTYKNMFAGHTIDAMVGTSWMREYYRTMGIGSGSTDLGGPNITIFNGKGDITSEEYNSALLSFFARLNYDYKERYLVSASIRSDKSSKFAKGNRVGYFPSVSVGWNIHEENFFNIEWISKMKIRASYGELGANFIDSYSFLSTAYGPIPSVFGENQIGQSSVMNGYVTKFAQENLTWEKSISKNVALEMAFLNNKISFTAEYFWKDNNDLLAPLLPLASSGQTIMTNGGDLPVFNSASVENKGFEFTVGYRNNWKDWSLDVTANISALRNKVKSLGEGVQPIKAEVMMSGSFNDRPTITKPGLPIGTFWGYVVEGFDNDGNFIFQDNNGSVNGVLTGKPDGKIDENDKTDIGNPHPDFTYGLNINVGYKNWDLTAFFQGTQGNDIFALMKYDWYFGGANSATLKDAFYNSWTPQNPNAEAPKLNSKNSSGINSLPSTFYVEDGSYFRCKNLQIGYSFNKKLLQKFHIESFRIYAGVQNLFTITKYPLYDPEVSSNVLFDRGVDGFWQAQESPHEATMNSRVYNLGVNLTF

SEQ ID NO: 20088 - protein, 804 aa, Chromobacterium violaceum
MSAPKSSRFRFRLRLRRTAVFHACAGLVLGLQLQLAAAQSVSFDVPAQPLAQALSQFARQAGLQLTYSSELVQGRQAPALNGSHDVRQGLAALLQGSGLQGRIEGGTLTLLPTAANAPENAHRLSEITVTAGDQYVSLLPAPYAGGQVAKGVRLGVLGNTGNMQAPFSTTSYTSEAVRNQQAGTIAEAVNRDPSVRYTVLPGGNVDNLYIRGFPIWEGNSGEIAFDGIYGIAPNYRVRTEYVDRIEVVKGPGALLFGMSPNGSVGGVINIAPKRANEDVARLTTGWTSDSLWRAHADVGRRFGDEAQYGIRVNASKYGGDTSMDHQSTDGHVLAVALDYEVERFRATLDLLSQDERIDGVGRPIMPTGLTSMPAAPDGRRNVTQPWEWSKNRERAVLLRTELDLTQQLTLFANIGQSRADVDRIYDSAPRLTSAAGATSITPTYAVFDVDRSTIDAGLRSRFALAGVKHSVTLQLASYREDFHRALQAGSTVVSNIYAPIAHAPQSIARPSVIPRIHDNRNTSLALVDTLSLLQDRLQLSLGLRHQAIKSTNYNVLTGGTANVYDESVTTPAVGVVWRQAPNWSLYANYIEGLSKGDIAPPAASNYGEVLRPYKSRQYEVGSKYDFGSFMATAALFSIEKPSGGLDQGVYKTNGEQRNLGMELYAYGEAARGLRLLGGVTWLKPEITRSATPALVGNRPIGTSRLLANLGVEWDVPALEGLTLVGDLAYTGAQFVDQANRLRIPGWTRTDLGLRYATRIAGRKTTLRATVQNVADRKAWAGVTSWGAVSPMIPRTFVVSASVDF

SEQ ID NO: 20089 - protein, 1085 aa, Chromobacterium violaceum
MHRWFALPGDCRCAASANRRQCLTRLDPCLKEQAPVTADPCCCSCGCCCLLSLCSTPKRASHCTASRFTPGRGKVMKNHRTVSTLPPRSLLYCTLAASLLAANPAMAQSSNATLRGQVASAQSGSEVVVTNIATGSVRRAPVNANGNYTIVGLQPGTYKVESNGISRTVTLSVASSATVDLGNETAAAPAGDATTLDTVTVNAPMMREVKTSEVGNTVSLRQIQQLPQATRNFLEFADTVPGMVFTIDQDGNTKLRAGASNASSSNLYIDGVSQKSYVSGGGIAGQNETQGNPFPQLAIGEYKVITSNYKAEYGQISGAAITAATKSGTNQFHGEAFYRFTNQDLRKERPDEENGKVDSQTKEYGLAIGGPLIQDRMHFFFAYEGKDNVAPKSVQPSAEASPFVGLLPSNLRDQFGASNMPFTEDLYFGKIDVEPTDNDRIELATQYRDETQVSNVGGQNAPDRAVDKINKDKRTSLRWQHSADSWFNEAIITTEDSSNVPTPRGTGNGSIYTYVDRTEADPRQWVFLNTGAASGEDFKLRSQKGWSFQNDLTFNALEWHGEHTIKTGVTYRDIKLTSRESSSLNPQFSYEVSQNGIAPVPFQVRYIRAFDNPGQVPVVESPSKQYGIYLQDDWAVNDKLMLNIGMRYDYEDTQAYTDFVTSQPFINALYSDDPDNPGQPWANRLVPSGINVADYISTGNNRKNFKDAWAPRFGFSYDFFGDESAVLHGGAGRSYDRNLFEQLALESVKAALSPVVVYFSDAASRQPCFRDDRVCTAWNPGYLNGIDQLNTIPGTNDSSELFMFNNKLKTPYSDQYSIGISNQVGDWLTDVTFQRVLAYDGLVMSLVNRYPNGAYFDSTGSVPWGEPVPGYRNTILGYNGLEQRSSQFLLSAEKPYTKESGWGLNLSYTHTSARQNRTIDEPFAFDKATIRDYPFVKSDAVAAHRFVASGSIDGPWGVTFGAKLILATPEPINTIACYGFTDPDGGTCQAVGVTPPGNGKFLVGGKIWGYRTVDLQANKEFTVVGDFKLNARINVLNAFNFKNYTQYQYNSFGSDGRLQPDITVVDNGEISYVPRSVVLEIGAKF

SEQ ID NO: 20090 - protein, 420 aa, Chromobacterium violaceum
MRNRLISMLAAAMLLTATTITPAEAAFVIGGENGWQLSTDGIVDVFSVYQSTSPAPAGADGSKRFTSFLSGSTDQFQNFGVKVGLLPSLIAFNIKAPTVNGVDSNVRVGIYPSIQNKNQDTRFEVNPNIDFREFYYTAKGTYGELLAGRALNLYQAKNILTDMTLLTAGVVPAPGTSTTLGHIGYGYLYTNFGPQIRYTTPDLNGVKVAFSVNEPYKISSDTAKTNTPRLETEISYATVLNGGTTLQAWASGLFETATRSKAAGVARPGEQNQSIGGAAGIEAGFSGVDLMASGYAGEGLGMISAQDGDAFGSSSTDAAGKERTHFGFLVQATYKLTPDIKIGANYGQNRQVESDDDKTKRGVGGSFSPMKKQEAAVGMVTYNFNKFTQFIVEYAYAQNTWHDRATQHSNSVAIGTMFYW

SEQ ID NO: 20091 - protein, 781 aa, Chromobacterium violaceum
MTIRTRVSSAALLLFAMAAHAHAATDESSVTGAVTDAAGQPVNNATVIVQNASGAAVTEAKTNAEGRFAIAHVTPGTYAIVVTAPGFASGNSITTTSAGAESTVSVSLAKSGTLDVQVNAKRLDRARNGLLPETGSSVYRFSQADIEALPAGQDTPLNQVLLQAPGVASDSYGQLHVRGDHANLQYRINGIIIPEPISGFGQALDTRIIDQVNLLTGALPAQYGYRTAGVVDIRTKTGDAGNGGTIDVFGGSHQTLKTSADVFGTQGPFSYYFSGSLGVNNLGIENPTASASALHDHTRQGDAFGYMSYIINPLTRVSLMFGTTSNQFEIPNTPGLPTNFTLNGNNAFDSSQLDETQSELNNFAVLALQGTNGGALDYQVALFTRYTRTQFNPDPVGDLLFNGVASQDFHSNSANGAQVDTTWRLNEKHTIRAGLFFQQEHAVFDDSVDVFAADSEGNQLSDQPFNIHDSSSRTGYLYSAYVQDEWKITDKLTLNYGLRYDKMDEYVSASQLSPRIGLVYALTPTTTFHAGYARYFTPPAFELVSGSTISRFNGTTNQSPSSQNDQVQPERSHYFDLGVTQRLGSNVTVGIDAYYKKSTNLLDEGQFGSALIFTPFNYQYGRVYGLEFTANYKQDNASAYLNFAYSRAQGKQIDSAQFNFEADELAYINDHWVYLDHDQRITASFGGTYDLGRTTFTFDGLVGSGLRSGFANTDRLPVYAQINLGVIQHFNQPLVGKFDARLLVVNAFNRVYELRDGSGIGVGAPQYGPHFAVYAGITKHF

SEQ ID NO: 20092 - protein, 1146 aa, Chromobacterium violaceum
MKTYPVPPSLRALVAATLLSTSGSLVAQSAPGTSPEVADDEPLVLSPFVVSSERDTGYQASSTLAGTRLRTELRDVGAAVSVVTSQFLADTQSTTAKDFLIYTTNTEAGGAGGNFSGVSSGNFSNPEGMFASPHQSTRVRGLAGADLTRDFFPTNIAMDSYNTERVDISRGANAILFGLGSPAGIINNQLKTADLRKPAYTVQNSVGRFDSHRELVDLNQPLVPGTLALRIIGLNDLRNYQQDPAYERDRRLFASVKFEPKWLKSGSTEFLVSYEMGDQDSNRPRVNPPQDGLTVWYSVLDKIALDPTAYTVPSEPLLAAHLAQPGRWYGQVAAVFTDPASSAQGGNGVPASMVNSVNTAGVPFGTWVATGAYTAMGNNPNFFLNRQYAPAGQAFSGLWKYQEISDPSIFDFYNHLLDGPNKWEGADFRAFNAVARQTFFHDRVGLELVYDEQNYDRRNFNTISYDAATLLVDMQTKLIDGSPNPNFGRPYVASDSVGNNLGHTARESYRATAFAVADFRQKENFLRYLGRHVFTGVYSDLDVYTLNRTYSGYGYERDLNAYANNSSVVTYPQYAAIHYLGSSIADLSSPAGAHIQPLTAVHTPQPTATALVFDARTNQWAHPTVTVLNSEHDIDKLYSNASKQSNRTKSYSAVWQAYLLKDLLVGTVGWREDEFALRDAGGAKTVAQTGQTNPFDPAWVLPDAPTIYAKDDTVSWSVVAHSPEFINRRLPAGMRVSLSYNESENFRPSATIADVYGRPFSPPSGSTKDYGVTFSFADNKFVLRVNRYETRQANDAATFYNTYWPGNDVVRAMNGLRSNVVNEHIINKWFGFQPGDSRYLPIRASLDNPAQANNPNPTLTAAEIAFRNEWFKQRTREEWLRPVDPLLASAWDFRQPTAGGNWTATRPPNVGNIADTVSRGMEFELTFNPLRNWRITANAAKQEAQKSNVGADFQEFIAANLPLWTDGDGVLAKNTRSMNGFEDIPYYSSFTGAMLGRDAINNMYVPYLNALAAEGSPVQEMRRWRFNLVTNYDFREGRLKGFAIGGAARWGDRIAIGFPVKQNEAGKWVYDVSHPYYGGEELNFDAWLRYGRRILNGKVGWSIQLNVRDLFTSNELIAISAQPSGMTASARIPQPNRWTLTNTFTF

SEQ ID NO: 20093 - protein, 213 aa, Chromobacterium violaceum
MKKIHWIVATAIVMAAFFSASAMADDATGTWAIGLKAGYNNVLDDNKFESTGGDIDYVYDETAVFGVFGTYYFNKYCSLAFGLDYSEYSFTEETAGVSLDVGDIRQIPVYFTVRGHWANDSICTPYAGIGMGYYFNEFDQKVSAPSIELKNDFGFHAVGGVETRFTDSFGMDVELKYTDHSSEYEFDYGAITLHESTNLDAFAATLGFKYYFK

SEQ ID NO: 20094 - protein, 976 aa, Chromobacterium violaceum
MFKLKPSVLTLALAAAGLPLAMVHSAAFAAEPQQSEPQQTSDPTEKETDNQGKLNPEDVERIEVTGYRRSLIDSLNAKRFGDTVSEQLSADDLGALPDVSMADALTRLPGISAVRTGGQAAEINIRGMSGGFVFSTLNGREQVSTSGSRSIEFDQYPSELINSAAVYKSPKASLIEGGLAGTVELATASPLAADKEHNVTLNARGMYNDRASEVYGAEEFGHRLSFSYQGKFLDETLGVALGYARLEQPSVATQFIGLAYSDNKDVDGLADDTNGPEANPANEYISEGFEMQHLGGVEVRNGYMGAIEWAPVSNFKLKADAFLSRFDSEAFARGFRVKLGGPTTAVANPVLDGNSVIGGTFNRTTQSYTRVELVNDDNQDFDQVNSFGVNADWQITDRLNVAADVSYSSAKSDFRNGLLWSNVAVDANADKPIFDENVSISYLLNGLDLPDLGFNQADAFSDINRVMVSKYGIYPYENEDEVTAYRLDFKYDLDSDWLSSVEFGVRWSDRTYSNDRSVFEYGNDGGFSSTQPPLRLTQDMVTVVDWSGDFSYFPSYLAIDLDKALNAWFPEGIPQPVQTWGNADGVLDPMGYTTNYSWSVLQSGEVYEKVLASYLMFNIDTEIGGLPLTGNIGLRVVDTDQSATMLQNVGGDPAQGAQYIVDENGIVNDLYAPTVVGTTYTDYLPSMNLSLKLTDDSQLRFAAAKVMARPPINRLAGDVSASVNDDGEINGSSTNNPFLMPFYATQYDLSYEYYFEEGALVAALFYKDIDSFIDTVAIDDFDFRGHGFNVPDYIVDPVSGEQIETTNGTYTTAVNNTEGGYIRGLELAYTQVFASLPSPFDGLGVNTSYSYTDSEVQKLTSLGGDSVPQTLEGLSKHVANLTLFYGYEGFETRISARYRSSFVSEQVAINSQVVNYDAETVIDYQASYQINDNLGVLFQVNNLTDEPTKSYFGTEAKTGTLQYFGRQFFLGVTYAM

SEQ ID NO: 20095 - protein, 351 aa, Chromobacterium violaceum
MHQFTRHLLAAAAVSLVAPVALAQSSVTLYGLVDTGIEYVSHAGANGSGSVYRVSPGNVTGSRWGLRGKEDLGGGLNAVFVLESGFNSDTGVSGQGGRLFGRQAYVGIEGRFGLISFGRQINTFYDLFVPFDPVRYTSYSLLSQDSQFANRADNAIKYTGNFGNLTLTAMYSAGYDATIANGGEVPGAPRVGQEISTGVTYTIGQIGMIAAYDQRRGTSLATQDIIERRYATGLVWNSGPYTVTAGYRYQQGALTQPSLHANLYWLGGSYTITPALTLRAGVYRSTVRNSPNGATSYAVSTLYSLSKRTDLYVNASYMNNKGASTLGVVNATTAAPGVSQTGVVAGIKHIF

SEQ ID NO: 20096 - protein, 398 aa, Chromobacterium violaceum
MNTRKKLFFACGIGLAAASAQAEVTFNGFATLAGGVASIDDEPGLDLSADPFSSQPSRLFGYDDQLDYENNSLLALQASSDLGDGLSATAQVIARGSDQWNAKLAWAYIGYEINDNVKLIAGRQRMPFYVFSDYLDVSYAYHWITPPEGAYSLPFDSTNGIGAIITHQLGSADSTLHFVTGRIKEDLQLDRPRDADLSDMYSAAWTLNFSDFSLRAGYASANLQYSVPELEPLVANWQTAVGQDFSEQILASDEDNKGSFVGFGATYDNGNWLAITEYTEITVEGTNLPAKQTSYYFSLGKRFGDVTPHITYGVDENEASSTSFIDPYRSNAGLAELIFTTDGVFNNKDLIVDNDYVTAGIRWDFHSSAAFKVEYTVHNANHYERTDSLLRFAISTVF

SEQ ID NO: 20097 - protein, 843 aa, Chromobacterium violaceum
MRVKRHSLFAYLWLSYTISIFNTFPAYSQEIAIKDIPQLSEIQLPHTSIKELFAQQQNTVIQVTGVRLNQTPNSLEIILETPASDKLQVTNKSEGNNFIIDIPNAQLSLPNGNSFRQEKPFAGITEVVVTNQDANSIRVKVTGETAIPKVELDDSDAGLIFIVTPVISPTSETPANEPIELTVTGERDTYSVPDAITATRTDTPLRDIPQSIQVIPRQVIEDRNVVRLSELADNVSGVQPERGYGGVSSQGYRIRGFLTNFETLRNGFPDYGYFSPRDVANIERVEFLKGPAAVLYGGSPTQYAGGSGLVNTVTKKPLETPYYNASLTYGSYNFIRPTLDITGPLTDDKSVLYRLNVAYENADSFRDFVRNDSFFISPVIEWKVGEKTKITFEFEHQKYNLVFDQGLPIQPESLRLPRSRFLGEPNFANGNFTFNSFTYTLDSEFSKDWSFRQGFNVLGAKLDDAKYTYYGSLEDDRRTLNRFITASEEEHKNITFQNQISGKFSTGSIRHNVLFGVDLAYNLFNYIFAPDEELPIDIFNPQYGGTPISVGGEPFGRRIVSQNVGVFAQNLVELTPNFKILLGGRFDFNEYSREDRVTNELLNEQSDSRFSPRVGLVYQPTKTTSLYFNWTNGFSPQFQARGRTNEQFEPQNTEQFEVGVKQNFLNDKLSATLAFFQVTKQNVLTPDPVDSRFSVQTGEQESKGIEFDIAGEILPGWKVIANYAYIDGTVTKDNRIPVGDRLVGVPEHSLGLWTTYEFQTGSLQGLGLGLGLYYVGEQEVRLPNTFEVPSYVRADASVFYRRNNFRYALNFKNISNVKYYDLDGYNIDPAAPFTVLGTISVEF

SEQ ID NO: 20098 - protein, 171 aa, Fusobacterium nucleatum
MDYFTLFGLPARYQLDTQALSLRFQDLQRQYHPDKFASGSQAEQLAAVQQSATINQAWQTLRHPLMRAEYLLSLHGFDLASEQHTVRDTAFLMEQLELREELDEIEQAKDEARLESFIKRVKKMFDTRHQLMVEQLDNETWDAAADTVRKLRFLDKLRSSAEQLEEKLLDF

SEQ ID NO: 20099 - protein, 190 aa, Fusobacterium nucleatum
MYVAMIIRKYFLIIALLVMPWLAIPSVSAADKGWFNTFTDNVAETWRQPEYYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 20100 - protein, 779 aa, Fusobacterium nucleatum
MVGLSTRVCALLLSVSVVSLATGPGYAQSASPEAQAPQAAKPKPAKRKRAAVPPPVATSPLEARAQIGQPTYQSLDIITVAASKTEEKAIDALAPVSVVTMEQIQGIQPNRLADVFRAVPGVSFQDRGDDPSTAINIRGLQDFGRVAVVVDGARQNYQRSGHNAQGSFFLDPELIGSIDVVRGPTANIYGSGAIGGVASFRTKDINDVLRPGERWGVDLNGSVGSNNGRGLGSVFGGVRVDPTVDVFGGAVYRTQGNYKDGDGTEIGNTGNEVAAGLFKLTVRPADGHEVKFGGVFQDYQYSVGQLNRGPVLTAAQRALYQGSSVYESDAKNYTGTLSWKYSKPDDALFDFNISLYGNRTDNDQTKTYHYSTSGSAYCGAGNAGNNISGCVGDKRGYLIDTIGIDANNTSRFDLGDWRNAVTYGVDAFQDDVATWDSRGNSNITTPSGTRTVSGGFVQLKNNYSTWLEVVSAVRYDHYELSSNLGSTSSSGQRLSPKLTVGVTPVAGFTPYVSYAEGYRAPSITETLISGAHATGGGPAFFNCPDGTTGLFCFLPNAGLRPEVGKNKEAGVNLKYNDVFTAGDSFRGKLNVFRNDIDDYIDLVASTPQLVPPFGSFSKFYQYQNTPHARIEGFEAETMYDAGFWFAGVAATVQRGKNTETNVGLVTVQPRKVTTTGGLRFLERKLTLSAQWSAIADNTDIPVGYLPSTAYDLVNVYVAYQPTADITLSFAVDNVLNQYYRPYAIPGASADGSSQNDALWTSPGPGIVYKGGLKIHFGGA

SEQ ID NO: 20101 - protein, 803 aa, Fusobacterium nucleatum
MDSMSSLRVRHPATLALLLVPLTLPAYAQQVPDGATPDPAATVPASADEQVSTLDQVQVVGQAMTYSKTNVSKEMLDRQFVLGSVNDALNELPGVVVTEADAFGSSDWGTQISMRGFVSNRDTQQIGTTIDGVPNGGSAYGGGSKANRFIDMPDLETVEVSQGTADIASRSNEALGGTLNYLTSEPLETQRVRMIGGIGDNQARKYYARYDTGLIGGSTRAWVSGSSARNDDWIDGSGHTSRDHLAGKFVSVLNQWTLSGYASYDDADESEYASVTPEQFARAPEHDLLTGTLTGIPYLDQNYRSGSRALRKNTFGYLRGAFDGGNGFKTTLTGYAHRMQGRGDWIPPYLVDVSNDGAGMAESEARGGNTVYGGSDLGKLYYLTPGGAAATMLAGCAGSDAVPAESNPACYPAGSVPVQSYRHSHYDNHRAGAIADVEWRTDLGAIDNTARAGAWLERVERSVTRDWHRLLNVGTNISFDHQPYWVQFKDNYQTDEQMYYLEDVMRYGAFAWRVGVKQFFVDQTRDRRIGDAQHVQSDSHSDPLLSAGLTWTTPVQGLEAFAGYSQNFAAIPSGVLGETDPVALSRVKPETADNIELGLRVSRWPLTGSVTLYDIRFDNRIVYVPANFVTGIDYLGETDGVYENFGGVHARGVEAALGYGWDNGWRINGAYTYNKADYLGSGDAARDTALEITPGAQVIGQPRNTLVVSADWRGQAWRFGMSGRYLGKRYLDASNRAALDGVTTFDANLGVELSQLSSQLKGLQLALNVSNLTDKRYLEGVDGSDSAFIAAPRTVGLTLTLDL

SEQ ID NO: 20102 - protein, 875 aa, Fusobacterium nucleatum
  misc_feature (851)..(851): Xaa can be any naturally occurring amino acid
MNATYRLIFNRALGCLQVASELAKTGGGAAGGVVGAGVRGAPAVDKNQVPALGLLLRQILAVLQPAVPLLMVGAGVLAPGLTDAATAKYISSSISNLTITGSGTSQVRLIPGGTISGTLANQGTISGASAAVSQVSATGGIGTLSNTGTISGTKQGVLNGGSIGFLQNSGGLIQGGIVGVSNNSSTSQIGTLLNQGTISGKSFGVSNYGTISNLTNDGIISASNPSNSYSKAALLSNGGTIGLLSNSGTINGGSALAILTSSGLIGTFNNDGVITNTGSSAAVVEVGNTGTISNGGTIVGARTGLAINGQVSTVTNTGTISGVQVMFGGFASAINNSGLLGGPNSHTGIALITKSSLFNGSLAGVQSTLTNSGIIQGENYAISISSKPATVILDSGSEVIGTVNAGTTASTFLLSGAQSWGSGSPIIAPQSTLTITPSGDVTTADMWSVATVNNQGTLAVGVFATPTGGGISPASQTIAGNYAQSAGGVLQMAITPADSTAGTDYSQLVVTGTANLAGTLDVVPNGAASAYTVGANYDLIHAGSIVGSFGTVSGMQALANYVSPQMSYSATDATLKMAVAGTPTPAPAPAPAPAPAPAPAPAPAPAPAPAPAPAPAPAPAPAPAPAPAPAPAPAPAPAPAPAPAPAPAPAPAPAPAPAPAPAPAPAPGVTLSNAPAFHSGRAVAASTYAVNVGGDAIVSSLLDGAGQVQGSDGPRFTDSRIGSWVKGFGAFGRANGASVENYGGIAGYGLAINHHLVLGAAFAGSGTGTNTDAQQVSTNSFGGFAYAIDTLGQLRLSTTLGAGYLHQSSSRNIFNAQNQSIYETAVGATNGWYFGAGLQAQYLIPLGQNFXCPMAASTTCTPMSMDSRKMAPINW

SEQ ID NO: 20103 - protein, 1066 aa, Fusobacterium nucleatum
MVNMKHERPCLVASGSDWLQEVLRRLLVWVVVLSSGTLMAYAGNLDISQTKVITGTVTEKETGDPLIGVNVSVKGTSKGTITNLNGQYSVDVNSDKDILVFSFIGKATQEKAVKGLSQIDVVMADDATMLGEVVIQTGYMTQRKADLTGSVAMANTSDLAQNPSTNALKSLQGKLPGVFITTDGSPGGNASIQIRGLTSLNAQPNPLIVLDGLAGDYNLRDINPANIESIQVLKDAASASIYGSRAAGGVIIIETKKGKKGESKISYEGRVQFSKWVNKPDLLNTDEYGRAIWQAYANDDKLGEIKQSVRFFDYDWSYDSNGYPVLNSVKPVEWLNTAQTMRSADTNWIDEISRTGVSQNHQISVSSGTDKSRTFFNLGYENTEGIQIETFWKKYSARLNSEYDLLNGRLKVGENLELNYMNYREANHTQLAANEPPIIPVYTETGGWGGASLDVGMDDYRNPVKDLILGKDNVNKFLKVIGNTYADLMIIKGLNLRTSFGVDYRGSYYRAVDKKWSEADGSGRDEKFNYVRNDQTHFLEYQWTNQINYNGQFGKHSIGAVVGMEFTKAESEAFYARKDGLTLEDRDYAFLSSATGDKITEATGSGDAYALLSYFGKFNYSYASKYLASATLRYDGSSKFGADNRWAVFPAFSLGWRIKNEPFLENVDFLSDLKLRFSWGRNGNSAIHSGYLQSSYVADYNGTSYAMNGQESGSLQSGFRKYLTGNSTLKWETVTQTNYGIDFGFFNQSLVGTIDYFYKKTTDMLYLPPYIGAFGEGGDTYVNGPSMENRGVEILLTYRNSLPSGFNYSITGNIATFKNKITELPDNVRSVYGGNGMLDDIIGRPRNSIYGYVADGIFKTQEEVDNSPQQAGKGLGRIRYKDLDGDGRITQDYDRTWIGVSDPDFTYGLNLQASYKNVDLALFFQGVHGGDVWDSWIEYSDFWNIQDVNNTNHLKGVFNAWSPQNPDSNIPALSTRNTNDEKRTSTYFLKDGSYLKLRTIELGYTFPESMVKKAMISRLRAYVSANNVFTIKKWWDSNRFSGPDPEIRDFGYVIPFTATVGVNITF

SEQ ID NO: 20104 - protein, 445 aa, Fusobacterium nucleatum
MTTTPRFSVRAVSLAVAAVSASLSMPTSASMGNLGTSYGVMPVDVATAQSLSMFNEQVSATYYNPAALTKDPRGELTAGILHSEQELRSDNPNASGDIVSDSPSQHVLIGMKTNLGSLTRFGHPIYLGFIAGVEKYGKEMLAFSSETSESGQFLQYGKEPLFLNIGGATPIWRGISAGASVRVTLEATANLDAVSTLGGETSRERLAVNAEPSLKTILGTNIDLGSTFCPESDCFLNGWETALTYRTKSSASTTVDSNIIVTQTIPDPGLSLAVTTIDSFQPETIAIGTQYSGDGWRIGGSIEQQNWSELEDEFSGDSIKDQGSVASGNRIGFDDILIPRLGAEYQLNKNFAVRGGIAYEESPLKTTRNPELNYLDTDKLVVGLGISATYDRTRLLAYPVRLDLGYQYQQLQERDFTLVDYDGDETSVTADGDIHVFSGSITLKF

SEQ ID NO: 20105 - protein, 1127 aa, Fusobacterium nucleatum
MDFNSYKKVISNCNHIVKVGMVSAYALFLGVNTALASVTEYMDQKVSLKTQNYTIESVIQQVEKQTDYLFVYDKNDVDVKRTVYVNGSNTDVIELLKGIFDNTDIDCKVLGNNITLSKITNVATRIAQQDKKTAKGNVIDSTGEPVIGASVVEQGTTNGTVTDINGNFTLNLSTPNAKIEISFIGYKTQVLTAQFGKQMAVKLVDDTELLDEVVVVGYGSQKKVNMTGAVATIDSKSLASRPISNISQGLQGLAPGVTVTNAGGQPGQDTGKILIRGLGSFNASSPMVLIDGVEGDMNVVDPSDIESISVLKDASSAAIYGSKAANGVILITTKRGQSGKPKLTYSALFGWSKPADLMDRTNSAELAELTNEAEYWDAISQGASSEQAEKRKPYTQEDIRKYAEGSDPYGHPNTDWYDLFYTGSGFMNRHNIGMDGGSEWAKYRASLGYVKQEGIVENASNRQFNVRTNLDLKLTERLKSRINLDFANTLMKEPTDPISWSDGAAYQVFRQVNRISPMVPYKNEDGTYGAIADGNPIAFQDLGSTGDTDKDYLNAFAEFSYDIWDGLKITANGSYNIVNKSYKLYRKDLQYNANKYDGPIRLTKSHTKEIRRQGDILLNYDKTFAQKHTVNTLAGFHTELYSYEYDDAYRQNFPSSDVTDMNGGSVVGMRNSGYTRELAMNSVFGRLKYNYMDKYLFEANARGDGSSRFAEGNRWGWFPSFSGAWRVTNEDFIQGTAFNEVVTDMKVRGSWGMLGNQQIGNDYYPYINTYATNAKYPFDNKVSGGAVQTENKIQDISWEKTTTWGAAVDMTLFNELQVTLEYYNRKTTGILMQVNVPNTYGYPGYWDNVGAMRNQGLEVSLAWHKTLGGVQLNFGGNFTYNKNEILSLGNVDVQKDARTIRMVGKEFNAFYGYKSDGIFQSKEEIANAPKYTMISNDRLIPGDIKLVDINGDGEINPDDKVILSSENPKYTFAFNLGARWKMFDINLFFQGAAGVSRYFTDEFYGEFNGDSGHPSNHWLGRWTPENPTNKWPRASKFRTYNLPETTCSDFWLVNTNYLRLKDIQVGFNVPKEWLQAVRLGSARIYYSGTNLLTFSKTPQGIDPEAPAGWGAYYPHVKTHSIGINITL

SEQ ID NO: 20106 - protein, 703 aa, Fusobacterium nucleatum
MFIQESSVLSSTTFRYSILACSMMFGLSAQAASDVTELKALTVNASVIGESKESDVKEYAGSRTVISAEQMTKTAAKSIDDALQQVPGVKVQDETGTGVLPNVSVRGLSASRSGQAQFLMDGVPLTLAPYGHTGQSVFPATLLSLERIDVVRGGAAVQYGPNNVGGVINLVTRPIPKDWESQISNRITGFEHSNNTLNNLYLRTGGWVNDDFAIQIEANTQNGDSARDHSDTDIQNFQIKTDWLISDTQELQAFVQRYDADTQMPGALSPQAYKEDRTQSQRTNDTYEADATRWHLKFLQDLDWGNAAQFEVLTFGHRDTRNFVWGYNGTSGVAWSDPRFASTDIRNSPREFNVFGVEPKLSVAFGSPESVTQNLIVGMRYVNEDIDYQLRQTSISTGTVTVPRDWQMDTDAVAAYVSDEVGLMNNRLKVTPGVRFESVHMNYQDNGTTKEQRSNQINEALPGLTVAYSLTDDWVSYANAQKSLRAPQISSIRGDGNKDGELSWNYEVGARYTHGRNAFNVALYRIDYKDQLEWIAGEQTFENAGKTLHQGLELSGRYGPESLPDLSLGLAYTYLDATYEEGANKGNQLIDASKHQLSWDASYNFAGYQSTVSGYYYSDAFSDASNTTEEDVNGSTGKIPSYTVWNLNVSKDLYEVGKTKLSIDVAVNNVFDKEYYFRGVDTSPVGRYPALGRTYSVTGNLTF

SEQ ID NO: 20107 - protein, 777 aa, Fusobacterium nucleatum
MTKALWLAASAMLVCPYVAGTALAQEAPPVKAAEPESARLDEVVVTAQKRAENVQTVPISIAAFSATQLTQAGVDDVLEITKIVPSFTSTRQANVSSVRLNIRGIGASAQTAVEPSVASFLDDVYVSRPGAVVGRFYDVESVEVLRGPQGTLFGRNASAGALSIHTKKPTDRFGGDLSVQAASFGSYEASGAVNIPIGDRAAVRIAGVGASTDGPWHTDIGDHDYGALDTIGGRATLRLKPTDQIDWILRADYLHLTGDAGSHNTVKSDTVTPAARANYLARLGITPYFDDQFSRTSNNFMVGDLDDHQYGLTSDLTWDVADGYSIRLIDAMRDWSSDQVAGDLAFSPRPLLLRNEIQASYSSSHELQFISPGDQLLGGRLSFVSGLYYFDETLTIDEKVTFTADTCNYIIRLAAPALQAACLASPLSPGAIANFAQKTRSYAAYGQVTYKLTNRLDLTLGARYTNDEKSGSFVQTNPNAAARVLRSIEATALAFKDDQITWRANLSWTPADDILVFANYATGFKSGGFNSGGGTPALTAATRPFGSETVDDYELGVKSTLFDRVLQLNATLFRTDVHDYQDRSFNGLSFLVRNAADLRQQGVEADFILRPFDGLRINGAVGYLDSKYLSYPGASGLPGFGGVQDLSGKRNNFSPEWQGAVGVQYDRDIAGGVGLTVRGDMTFVSDNNVGSVTDANPQMIQDGFALFSGRVTFTSPDRRYGLQIFGENLFDKGYYTYIFPNTLDNVLGLRDSTTGGTLMRGTLGTPRTVGVKLTVSF

SEQ ID NO: 20108 - protein, 317 aa, Fusobacterium nucleatum
MNVFCKTLLASALATATLASAHAADPLTVYGKLNITAQSNDVNGDSETRIQSNASRFGVKGAFELSSSLEVFYTIEYEVDTGDDDKENFKARNQFVGLRGGFGSIAVGRNDTMLKQSQGKIDLFNDMSGDIKKLFKGENRLAQTATYVTPSFSGVKFGVTYVASADSAQLEQDGYSLAAMYGDKGLKKSPIYASIAYDSDVKGYQVARATVQGKIAGFKLGAMYQQEEKVYAYDNNVVNPFDGDSYTGYLLSASYTIDAIVLKTQYQDMENKGDSWSVGADYKLGKPTKLIAFYTNRSYENIENDDKFLGLGIEHKF

SEQ ID NO: 20109 - protein, 178 aa, Fusobacterium nucleatum
MDEIDIEKRRQEQQDFDNLIKSQNFSVPKSSEDNEQKNLILNVTSIDLEGNTIFEDFQIDALLRKYVGKDKDIYALINELENKYIEKGYVTTKVGLNTEKSDFENGNISLFVLEEKIDKVFYDGKENKFKTFITFPQRENNILNIRDLDQGIDNLGDNSKMDIKASDKDNYSNIYKER

SEQ ID NO: 20110 - protein, 1654 aa, Rickettsia sibirica 246
MAQKPNFLKKLISAGLVTASTATIVAGFAGSAMGAATQQNRTTVGAATTVDGAGFDQTAAPANLAVAPNAVITANANNGINFNTPAGSFNGLFLDTANNLAATVSEDTTLGFITNAANNGNFFNFTLGAGKTLTITGQGITAGQAAATKNAQNAVAQVNGGNAIANNDLSGVGTIDFGAAPSTLVFNLTNPTTQRAPLILGDNAVIANGANGTLNVTNGFIQVSDETFATIKTINIGDGQGFMFNTDATAGNALNLQVGGATINFNGTDGTGRLVLLSNAAGGGATDFNVTGSLGGNLKGIIEFNTTAVAGQLIANAGPANAVIGTNNGAGRAAGFVVSVANGNAATVAGQVYAKDMVIQSTNAGGQVNFGHIVDVGTDGTTAFKTAATTVAITQNSNFGAVDFGNTASQITVPDTKVLTGNFTGDASNNGNTAGVITFAANGTLASGNADANVAVTNKITAIEAAGVGVVQLSGTHTAELRLGNAGSQFKLADGTIINGNVNQTVLVGNAALANGAIQLDGSATITGDIGNGAGNAAPIQGITLANDASKTLTLGGANIIGANAGGTIDFQANGGTVKLTSTQNNILVDFDLAITTDKTGVVDASSLINAQTLTISGNIGTIAANNKTLGQFNIGSSKTALNSGDVAINELVIGNNGSVQLAHNTYLITKTTNAASQGKIIFNPVVNDNTTLAAGTNLGSEANPLAEINFGSKGVNGDTILNVGQGVNLYATNITTTDANVGSFSFTVGGTNIVSGTVGGQQGNKFNTVELDNGTTAKFLGNAIFNGETTIEANSILQIGGNYTADKVESADGTGIVEFVNTTPITVTLNKQAGPVDDLKQITVSGPGNVVVNEIGNAGNDHGAATDTISFENVSLGAALFLPNGIPLDGLTIKSTVGNETATGNFDVPRLIVSGVDSVIADGQAIGDQDNIVGLSLGSDNSITVNATKLYAGIGSVNNNQGTVTLSGGIPNTPGTIYGLGIENGSPKLKQVTFTTDYNNLGSIIATNATINDGVTVTTGGVAGTDFDGKITLGSVNGNANVRFVDGTFSDSTSMIVTTKANNGTVTYLGSALVGNIGSSDTPVASVKFIGSDDGAGLQGNIYSQVTDFGTYDLSVLNSNVILGGGTTAINGEIDLLTNTLTFASGTSTWGSNTSIETTLTVANGNIGHIVIAENAQVNATTTGTTTINVQDNANANFSDTQTYTLIQGGARFNGTLGGPNFAVTGSNRFVNYGLIRAANQDYVITRTTNAANVVTNDIANSPFASAPGVGQNVTTFVNSTNTAAYNNLLLAKNSADSANFVGAITTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFTFSLYGAQQLVENFFAQGSAIFSLNQVKNKSQRYFFDANGKMNKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGTLKVRVNF

SEQ ID NO: 20111 - protein, 2093 aa, Rickettsia sibirica 246
MANISPKLFQKAIQQGLKAALFTTSTAAIMLSSSGALGVAAGVIATNNNAAFSDNVGNNNWNEITAAGVANGNPAGSPQNNWAFTYGGDYTITADAADRIITAINVAGTTPVGLNIAQNTVVGSIITGGNLLPVTITAGKSLTLNGNNAVAANHGFDAPADNYTGLGNIALGGANAALIIQSAAPAKITLAGNINGGGIITVKTDAAINGTIGNTNSLATISVGAGKATLEGAVIKATTTKLTNAASVLTLTNANAVLTGVIDNTTGVDNVGVLNLNGALSQVTGNIGNTNSLATISVGAGKATLGGAVIKATTTKLTDAASAVTFTNPVVVTGAIDNTGNANNGIVTFTGNSTVTGNIGNTNALATVNVGAGLLQVQGGVVKSNTINLTDNASAVTFTNPVVVTGAIDNTGNANNGIATFTGNSTVTGNIGNTNALATVNVGAGLLQVQGGVVKSNAINLTDNASAVTFTNPVVVTGAIDNTGNANNGIATFTGNSTVTGNIGNTNALATVNVGAGLLQVQGGVVKSNAINLTDNASAVTFTNPVVVTGAIDNTGNANNGIVTFTGNSTVTGNIGNTNSLATISVGAGKATLEGAVIKATTTKLTNAASVLTLTNANAVLTGVIDNTTGVDNVGVLNLNGALSQVTGNIGNTNSLATISVGAGKATLGGAVIKATTTKLTDAASAVTFTNPVVVTGAIDNTGNANNGIVTFTGNSTVTGNIGNTNALATVNVGAGLLQVQGGVVKSNAINLTDNASAVTFTNPVVVTGAIDNTGNANNGIATFTGNSTVTGNIGNTNALATVNVGAGLLQVQGGVVKSNAINLTDNASAVTFTNPVVVTGAIDNTGNANNGIATFTGNSTVTGNIGNTNALATVNVGAGLLQVQGGVVKSNAINLTDNASAVTFTNPVVVTGAIDNTGNANNGIATFTGNSTVTGNIGNTNALATVNVEAGLLQVQGGVVKSNAINLTDNASAVTFTNPVVVTGAIDNTGNANNGIVTFTGNSTVTGNIGNTNALATVNVGAGITLHAGGSLDANNIDFGARSTLEFNGPLDGGGNVIHYYFKGAIANGNNAILNVNTKLLTAYHSTIGTVAEINIGAGNLFAIDSSAGDVTILNAQDIHFRALDSALVLSNSTGVGVNNILLAADLVAPGANEGTLVFDGGVSGLNIGSNVAGTARNIGDGGGNKFNTLLIYNAVTITDDVNLEGIQNVRINNKADFTSSTAFNAGAIQINDATYTIDANNGNLNIPAGNIQFAHADAQLILQNSSGNDRTITLGANIDPDNDDEGIVILNSVTAGKKLTIAGGKMFGGAHKLQTIVFKGAGDCDTAGTTFNTTNIMLDITGQLELGATTANVVLFKDAVQLTQTGNIGGVLDFNAKNGTVTLNNNVNVAGTVKNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTATLGGTTSFAHTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVNFTFDASTLTLFAEDIAADVIDKDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQGSVKVRVNF

SEQ ID NO: 20112 - protein, 480 aa, Fusobacterium nucleatum
MTGSKAFRAALAASVFVAAPQIARAAEDQSARIADLQRQVDELKAMVLALKAAQGATPATTAAAAPATAPAAPVAVQPVQLAAAPAPSAPPSVPAPEKKKAWYEKLQLRGYTQLRVNEIVSGPKSAPSGISRLRSVQDSGINDTGNFSIRRARLVVQGDISNRVSLYMQGDLSAAVNNQSGTEPRQHFFQMRDAYADVFLDKKKTLKLRLGQSKVPFGWENLQSSSNRIPLDRTDAINAPVPGERDLGAVLYYTPLRVQKIWDELSHDGQKLFGNYGAFALGVFNGQGTNRTERTGGLMTVAMATMPFRLDGLGLDGQVAEFGFTAMRNQVRPEVRSGGVSTLSYDDNHVSVHGMIYPRPFGIQSEWTWGKGPQWDAATSSIQAKRATGGYVMAMYRMPETPVGQVIPFARWQKYRGGWKGATNAPRLETDEYEVGVEWLPLKELEVTLGYANVHRNEADERRTGRAKGDLVRAQVQWNY

SEQ ID NO: 20113 - protein, 1084 aa, Fusobacterium nucleatum
MKKKFKGILTLLLAFIVHLTFAQEKTVSGTVSDESGTLPGVSVVIKGTSVGTQTDFNGKYTIKTKQGDILSFSYMGYKTIEQSVITSNTMNISMVQDANLLDEIVVTALGIKRSKKSLGYSTQKIGSEELTTVKEANVLNQLSGKVAGLAVQRTNNMGGSTNIVIRGQSSLTGSNQALFVIDGVPLSNRNTNTGAQSQGATGYDYGNPISDINPDDIESMNVLKGSAATALYGSRASNGVIIITTKKGKGAGANDYSVTVSSNVSAGSIDKSTFPEFQQQYGAGYGGNDYNFDPSDLNGDGTVNNYANLNDDASYGPKFDSNLNLLQWDAVYPQLSTYGVARPWIAPKNGPLTFFNTPTSTTNSISVAKGFKDGDGNLRLSYSNFNSKGMLPNSSQNRNTFSLAATAKLTDKLKATGYATYINTATVGRNSTGYNDNIVGFMRQWGQNNMDFKRQKDAYFQTGENITWNPKSPTDLTPIYWDNPYWTRYENFQSDGRNRFTGYTELQYKITENLSITGKASVDQYSEIQEERRALGSVATGFGINEGADGSYNRSTQGSGYLRRNINSRETNLDALINYSKNFSDDLSFSAFLGGNIRNNTLNMITAATNGGLKVPGVYSLQNTTDALPNPKERDETKEIQSFFAGATFGFRDYLFVEGTVRRDKSSTLPAENNSYYYPAVSGSYIFTKNLDAPFIKFGKLRANWAQIGNDTSFDRINDTYTALTSFQGNASAAVSNSKKNPTLKPELSSSVEVGLEMKFLERGNLGFDLALYKTNTVDQIVPVSVSETTGFASKIINAGEIENKGIELSAFSTIDITEDLKWRLNINWSKNVNEVVSLAEGLDELLIGSFGVDVVARIGEPYGAIKGDDYTYHENGQKIIAANGKPVRSDANQIIGNGNPDWLGGVRNTFSYKNVSFSFFIDVRHGGDMYSLDQRYGQATGVLATSVFINDLGNPVRNTIANGGGFIFDGVYADGTTNTTRLDASGFGNSGYRTLPKSEFVYDASFVKLREVSLTYNFKKEVTTKLHMNNLSLSVVGSNLWIISKNIPGADPETGFGSGNIQGISSGSLPTTRNYALNVKFQF

SEQ ID NO: 20114 - protein, 1135 aa, Fusobacterium nucleatum
MLLAGTGVSGKKLTVFYSTNKNESHGMNKKVSIATLSAFLVATSPAMAVNEANTLYVNLELSLNRTTVGMIIQSISEQTGYEFSYDESILSKEISKVSVRVKNEHIESVLKKVFKNTDISYRIVDNRIFLQDNAKTENVSFASVQQVKRTIRGTVVDNTGLPVIGANVIVKGSAGVGTVTNVDGDFTLEGIEDGATLMISYIGYVDQEVAVAKGKNDYKITIHEDTQNLDEVVVVGYGTQTKVNLTGAVSTIGKDELINRPVTNVSSALQGLTPGVTITSGTGQPGSDGATIRVRGVGTLNNANPYILVDGIETGTFDSIDPNDIESISVLKDAASAAIYGSKAANGVILVTTKRGKAGKATVSYNGNVSFSNVSTLIDRLSSYDYARLYNQLLTQDGASPRFTDEDLRLFQDGTDPYGHPNTVWTDYIYRTGFMHKHSLNVSGGSEDVKYMASAGFLGQEGTLRNSDRQQFNLRTNLDIKLSDKFTMRTNMAFIHNDYSEPNASYGGGSTQLIRQADRIAPWIPYKKEDGSYGSISDGNPAAWVDINSRKYHLLQNFSGILAFDYHIIDGLTFTLQGAYVTNIKETKDYRKECWYDDVNYHGPDQLGETISRWSRYTLDALLNYDKTFNQDHHFKAMVGYKIEKYDYRNLYAFRKSFPNSEVTDLNGGDSSTQTNSGYSRELALLSYFGRLNYDYKGKYLLEANFRADASSRFAKGYRWGYFPSFSAGWRISEEDFMENTHGWLQSLKLRGSWGLLGNQDAVSDEYYPYLPTLYIGKNFPFGGSVHQGITVVSHKVTTISWENSTNWGIGFDANFLNEFMLSAEYYNRKTSDIIMDIPVSDTFGISGTYQDNKGSLRNSGVEASFAWNHSFNKDWRMGINANFSYNKNELLDLAGVNEIIDGYMINRIGEPYQSFYVYEVDGLFKSDEEAAAYEKQYGNPWSLPFKGGDFRIKDADGDGKLTDKDRVVKGTQQPKTTFGLTLSAGWKNFDLSVFMQGVTGTNRYFSRDVVGSFIGDTSHPSTNWLDAWTPENTNAEWPRLFLEENSISSPQRVNSSFWCMNTNYLRIKNVNLGYTLPKSWTNKLGIANAKIYYTGENLFTFDSLPFNADPESPSGNLDVYPISRSHSFGINVTF

SEQ ID NO: 20115 - protein, 996 aa, Fusobacterium nucleatum
MANGAARTRQAPDREMLRAGGECDARSRFSRRNGKQAGFRWGRCLRAFVVGNFFMPSHRPSPARRGFLLASTAVCLAAPAQAQTANPWATPEYYASQALRQINAAAAYAQGYTGAGVTVGVMDAAVDGRHPEFSGRMVPGWDFLNNRPTGQFDNMPDDSHGTHVAGIIAAARNGEVMQGVAFNARIMSVAYNWRVTSEDEIFASSWNYLAASGVPIVNNSVGMNDCDRAPAGPCNVTSYTRAKVEAELPQTLAAMRATARAGVLMVFATGNETQPHPDVLAGMPYLVPELKDTWLAVNLVSSVDLAVSWGNRCGVAKDWCLVAPGYNILSTVPLGEGFGLYRGYDTMSGTSMAAPSVSGAAALVKEAFPWFTAHDIQQAILTTATDLGEPGVDNVYGWGMLNVGKAVLGYAMFTGTTTLDTQGMTSTFSQDISGAGTLIKTGAGELILTGANTYSGGSWVDGGTLSINGSVASNVYVGQEGLLRGTGQIFAQLAVAGRLAPGNSPGTLTVAGPVLMSPTATFQVDIDGTGTGTGAGNYSRLVTTGPTGTVEVAGTLAPQLRGITGSATNSYTPTLGTTLRVIEASAGVSGSFSGLAQPIGLAAGTRFDALYGANDLSLIVTPAAYGTLSVLGLATSRNGTAVGGALDSVRPAAGVALTGSLGAFYQSLYTLQAAALPATLAQLSGEAHASAEAMAFDDARHIRSAVLERLDGSGVAAAPLAPGLTASVWLSGYGGWAHASGGDAAALYWDASGFVAGIDAPVTEMVRFGLAAGFGQSSGTVGDLTSDIDNTHIDLAAYAVAEGAGWRAKAGVAYGWNDLSMTRAIGFGSVAEGLATKQDGRTVQAFGEISRDLVLGHAQVSPYANLAYVNQRLDAFAETGGVAALSGSAQTLSTTLATLGARLAIGLPMGNATVTPNVNLGWQHAFGDVATEAVMTLAGSSPFRVYGVPLARDALVLGGGLTYGFGNSVAASVAYDGLIGSDVTESSIKADLRFKF

SEQ ID NO: 20116 - protein, 439 aa, Fusobacterium nucleatum
MDICSRNKKLTIRRPAILVALALLLCSCKSTPPESMVTPPAGSKPPATTQQSSQPMRGIWLATVSRLDWPPVSSVNISNPTSRARVQQQAMIDKLDHLQRLGINTVFFQVKPDGTALWPSKILPWSDLMTGKIGENPGYDPLQFMLDEAHKRGMKVHAWFNPYRVSVNTKPGTIRELNSTLSQQPASVYVQHRDWIRTSGDRFVLDPGIPEVQDWITSIVAEVVSRYPVDGVQFDDYFYTESPGSRLNDNETYRKYGGAFASKADWRRNNTQQLIAKVSHTIKSIKPGVEFGVSPAGVWRNRSHDPLGSDTRGAAAYDESYADTRRWVEQGLLDYIAPQIYWPFSRSAARYDVLAKWWADVVKPTRTRLYIGIAFYKVGEPSKIEPDWMINGGVPELKKQLDLNDAVPEISGTILFREDYLNKPQTQQAVSYLQSRWGS

SEQ ID NO: 20117 - protein, 956 aa, Fusobacterium nucleatum
MTINIARVRAIKLRPRRTVAVPAGSLTTVSLLVLGTMCFPAGAQNYTGNDISSGPFSSGTQTFRDTSMLNAATPNAVNGGDQLFYDRSVLNASAGNAVNGGNQYFIDANVLNASAANAVSGGRQDFTGASVLNASAANAVSGGDQYFNNNSVLNATVAKAISGGVQDFADDSVLNLSAANAISGGLQRFITKSVLNATVANAIGGGFQDFYGESVLNASGSNVISSSGQQRFDDKSTLNALVANAVTGGYQEFQGESVLNASAANAISGGFQAFYAQSVLNASAANAISGGKQGLTRMSVLNALVTNAISGGFQDIDDMSVLNASAAGAVNGGTLYFTRAGVLNVLVDDALTKNTNTFFEKMHGGPGGTVKLNGHSTVIGGINSVSAGSGIIENGGGADGVLTVDSSSVGNSSFSGLLRDGGAGKFALVKTGAGTLQLSGISSYTGSTTVTGGTLQAGSTTAFNIISDFTVASGMLDANGFDQTVASLSNAGTTATNFKGGALGTTLTVTGDYTGNGGTVLLNTELNDDTSRTDRLRIRGNTAGLSKLAINNVGGPGAQTIEGIRVIEVDGNSVGEFVLNGDYIIAGQQAVVGGAYAYTLHKNGVSTPNDGAWYLRSRLKGLDPEQPLYQAGVPVYEAYPQALLALNSVSTMQQRIGNRLWRTGAEPDADISACTDPSTGSWARIEGSAERFDPTRSDSMSSYDVDRYKMQVGLDGLLHETGTGRLFGGLNLHYSNGRTKVSSIYGNGRINTDGYGVGGTLTWYGDNGFYIDNQAQFTFYDSKLASTTAGRTLVNGNNGKGYALSSEVGRRLTIARGWSFTPQAQLMYSKVSFDSFTDVFGAVVALDRGKSLRARLGLSLDYENAWRDATGQKKRLQTYGIVNLYNEFLNGTRVGVAGIDFASANERLWGGIGVGGSYSWADGKYKVYGEGSVNTSLNRFGDSYAIAGILGIKIAF

SEQ ID NO: 20118 - protein, 105 aa, Rickettsia sibirica 246
MGSIMRKTLFLLLPLIVTNAHAVYVGVRHEYLDDSKANYDRAYIAHRFANGFGFAIEAISKSGGDDTNKAFNDLETQGNEYTISYQFKTGDVVWQPDFFTWRAFL

SEQ ID NO: 20119 - protein, 249 aa, Rickettsia sibirica 246
MKKLLLIAAASTALLTSGLSFADCDMNSSVDSSTNSSMSSSVENQWYLKLNAGGVIFNKTKPKGADFKLNNIKSNIKSNTGFTGEIGAGYYIMDNLRTDLTIGTVASSHLKKSKTYPDGNSFSVKNKPTIVSVLLNGYVDFVDLSMFKVFAGAGVGAAFVKEKIHSKDIKGGVTDTFNGTTKNKTNFAYQLSLGTSFEVAQGVKAELVYSWRDYGKTKNTTKTINGDKVKFGGTHYKGHNLMAGLRFDM

SEQ ID NO: 20120 - protein, 224 aa, Rickettsia sibirica 246
MKKLLLIAATSATILSSSVSFAEGMDHEWYLRIDTGAAMFNEEKDKATGVKLKSNTTVPVALGIGYYISENFRADLTLGTIIGGKLKKSGAATNAPFTRTNVSASHKPTITRLLINGYVDLTNFDMFDVFAGAGVGPALVKEKITYNGITGLSSNTKNRTNISYKLTLGTSAQIVDGVKVELAYSWIDDGRTKSKNVIYQGTSVPTGGMHYQSHNLTAGIRFDI

SEQ ID NO: 20121 - protein, 1902 aa, Rickettsia sibirica 246
MNKLTEQHLLKKSRFLKYSLLASISVGAAIPFEGMAMSKEAFRIDLSNKLLNHVSQLNGYKDTTNNTPQQIGKVIVSEPKINTYTPSEIREMKISNKPKASNPLKDVPIEDHYKVVARSKSDVGTARKVRPITRCKTFAGIEKTEQSQNTYTPESTEQMPQKPEIIITASSPTVSPASNSFITAPNTPNTTLTSPEHYTTAPGTPSSTPATPYQSTSDSKPNDSLGANTPPNINTNSKAVRRLSFSSSGPQQQAVQSSSQVKSEVPPKPTFVPLPIKKSSTEIVAGMVSNISRVNEMIGIKLAEVTQAIDTTDKKDKERLQKLYTQLTSTQKTTEKLKSRAEEIETKIKIGENKDKIKKLEKELTSKNNKADRLFQKIEKIDIPANKVSIKSQETVPVTTASTEVSAFQAQQARINEARQGVFNKNKSSGGNARKSSAGTKREKKKQEAQKQLSEIKKQEKAIKTASDKAKEVAASAKKETSRTALRAMQDKMNGDSEQLNKIEENLKLLTPVVYNSSTGPTYKQSPKATPTIPLSHGVQRILGEQPEDEEGYLVPIKVQQQPYQEIEDPIPSHSKDIYEAKVSQYINYLNSIQPNQSNQAQIDSVIDGLATEMRKFSADQFSQKLGEIAHLASIKAYEGLFEKLYEIQQARILETQKVYEQAEISQSYAEYEENSRKSSIPVLSRSSSAKSVISSNFEEKSALLQTTTTDESLRSDNNWKNSAPYSSSPKLDKRGLEYLDLAGDAFVQNLKQPDTLTIETLGLITPTQNTTVAKSDSSRKNNVSGSISEIQQLQSEKMRTETLGVQDDLGLDLHYTPQETLTEKSTYLVSSKKKQGNIIKRAVSKVGSILQTNYAENRRRKRDGETSKQRTVDQEGEFGHAWGNENHKESSLSVVSGCIKKATQLISLLDAKRTAILQTTSPSQRRSVSLVLQEIENDYREAIKISQKLQQVLIRKPEDIKAYNAKAEKKLDAIKSRADKHFNNIETDVDVGFNPNGGNSHSMPTANMDILPKNLAVTPPTNVGSLYNSPQAQQFQEDHKNIIINDRSQGRLNLVDSTIVRELTDVDASIYNTAPPEVLKEAEALLDRSQGRLNLVDNTIKKGTQPLSNLSTIYESVSYENLASETIYKTEQPKPSISYTNTSKRKLPIPLFRSAELDKKLEYLDLEDKLLEVEEARIVKEKEAIAKLNQYQDPENLEFKRLAMEALDLSSKESQLKQKRKAIEAEFSLNEKSSSTDVSILRSYSIDDISGVLSDAESNLSRSPSVSGLEDLNNSNVMQLEELKSKHEKIANDYNKELELDTLNKEKIWLEGEIKHLDTEFKPKVTESKPVFSCSSSVGSINSFSNDDDLSSRDVVTPVDTLNIEINKDYVDTYIRVLSNKIQKIEEIQKIEELSGSSSRSEELNHIKEAMAYISNRIQDVEELDEKMLLAINAQLQEHDEKISSLLREEATDILAQLLLQEMLVSDGKSESTLPAGDEEQEDTEVSRQLSSLPALASSNESALALSDDREKECLALGDSSEDEESYDSGFEEEEETIGQLSDSDGDNLKITEVDTVIPLEQEAKKEMQTQISENAPTLNQAKVVNTIVNNMIRNRLDASMNMSNNMVAVGAGDEEESHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQSKLVITPNIGLRYGKSRDGVYNETGVNVQEIALTMKENNILSGIVGTKVTVPLKDALKFNNLGLIFQGAVEHNFKEKTQRINRVVKIFDNTFKHNYLIPKQPKTSYNLGTGIIGSIKNTTISLDYNYYLNKHYRSHQGSVKLKVNL

SEQ ID NO: 20122 - protein, 1050 aa, Rickettsia sibirica 246
MDILFNLNRLYQIITDNDRISNLFTTHKRWAARQTTIFITQTSKIMKPKIYTYLCVLLLLLSGVSPTFAQDSQVTGTVNDESGFPLPGVTILVKGTTRGTTTDLDGNYSINASSTETLVFSFIGYTPLEESVGSRSVIDVTLNPDLSELDEVVVVGYGTAKKSQLTGAISSVGSKEIQELPITDARQALQGRAAGVDVTQPGSKPGSAPQVRIRGRRSFNASNEPLYVIDGIPVVGGLNDINPQDITSMEVLKDASATAIYGSRGSNGVVLITTKRGTRGKTIVSVDSYYGVNQELGKIDVFNGPEFAEYKRESRRTSGEYPDGPATPAADESLFEPVELEGIAQGRSTDYVGGLLRKGAIQSHQVSVSGGSEKTTFFVSANYFNDKGVIKNQDYTRYTFRANIDHQINKKIKFGTSTLVSFSERNGENFNPLGGALAENPLGKPYDEDGNLIFLPTSDGLRTNPFAEIVEGAQEDLTKNYRIFNSIFANYEIIPGLTYRLVFGPDITISRNGRFTGSQTNARRGGDATGSVNDEFTFNYTLENILTFNKSFNEKHNLNITALQSIQKDRYEQTTVSVLGIPAESQFYHRLGDASQITGANTNLREWALMSFMGRVNYDYKNKFLLTATLRADGSSRFGENNRFGYFPSVALGWNIHSEGFMQNSTNVDQLKFRVSYGSIGNQAINPYQTQALLGRTSYAFDNSPAYGYRPSTIGNPDLRWETSTTFNVGLDFALWQNRVFGSLEYYITNTSDLLAPQPLPNSIGFGGFTTNIGETQNRGIELTLSTLNIEKGDFTWTSDLIFTKNKEEIISLPNGDDISAGRFIGQPLTIFYDLKKIGIWQLDELDEATSYGSVPGEIKIEDLNNDGVINSDDRQFLGSAVPDFALGFTNRFSYKGFDLSFFLFGRFGSMIRSQFHTGNNTLAGRYNNLDVNYWTPNNPTNDYPRPNVNQERAKYASSMEYFDGTFIKVRNINFGYNFAPEVINKIGFTSLRLYTSIQQPFIFANYRSEHKGIDPEVFIDGEQGVGGGAVNANVSPAVTSFTFGINAKF

SEQ ID NO: 20123 - protein, 244 aa, Rickettsia sibirica 246
MLRIVKKLGIILFVSTISINSFAKSMYDDVDSASDYDSTPYYENEGSLVFKMRLGGVVSSAKQKGLPTPTSPQPVSVGEVAKNGYGGDASTTIFFNNYLATELSLGFNVLRTKYTSLAAVAHNYGVDNVKLGKHKPIYMIPATITGQFHIAPYGGIRPYIGIGYHGSYMLTQATGLKIRNGHGAVGQIGVDFYAKDDTLINIDVRQFFLNPKLEYKPNLVGNKTMTSKVKLNPLIVSIGIGFTF

SEQ ID NO: 20124 - protein, 782 aa, Rickettsia sibirica 246
MVPTSRGPTRNRALVLHIPVTLLASASSFFSTPATAQEPVELQDIVVTADHPSLASAAVPPIKQKYQLPQTSQSATAATIAEKINIIDTEDSVKYFPSLFVRKRNYGDTQPTLATRTWGVNSSARSLVYADDLLLSALIANNNTLGAPRWGLVSPEAIDRVDFLYGPFAAAYPGNSMGGVLQITTRMPDKPIAVLSQNEAFQTFNRYGTKDTYRTDQTNVVIGNRSGDFSWFITGNYQNSYSQPLSFITSATFPKNTTGGFAALNKLGAPANVLGAGGLLHSEMANISGKFAYDITSWLQMTYQIGFWSNHTNSSVQTYLRDDTGAATFAGQSSFANNNYTLTEQHLSNALSFKTHTGGVFDWDLSVSNYYFLYDSQKSPYGVTATGAGFTTNGKIARLDGTNWINGDFNGIWRPMGPGSEHEISFGLHADRYFLTNPTYASSVWNSDAESSNSLYTNSRGTTVTKAIWAQDAWRLAQNVKFTLGGRLEQWQAFGGLNLATNATSAGVITSTTIQNQPSLDAVRFSPKVSLNWAPSAEWDITGSFGQAYRFPTVTELYQIVATGATFSVPNPDLRPENVLSEELAIVRKFDSGHVRLSLFNENVSDAIIAQTSFLGVSQTPTTFTMNVDAIRNSGVELAAQKDHFIFDEVDAFGSVTYVDSRILQDAGWASSTGTTVVGKHVPYVPDWRVTAGVTYHPTPNWALTAAMRYSGKQYSTLDNTDVVPQVFGAFDSFIVADVRAQYKLSDQTWINLGIDNINNDKYTLYHPFPGRTFTFGARVQF

SEQ ID NO: 20125 - protein, 641 aa, Prochlorococcus marinus
MKIYILLLSLSILNAIELPSIAIESSKLGDTLKDSSNSINTLDKNKLEMSNIKEIKELSSLISNTNISGVGNRTDKTITMRGISNYVTYESNVAMYIDGTPVPFSYGFGMVDMNNVENIEVLKGAQGTLFGKGAESGVINIYTKAPTKTFQSRASIDYGSYDTQKFYGFVSAPMSNEDITYSLSLTKESSDGFSTNELTHSNFDDKDFKSLSAKLRYNPSTPLDVSLNYTKSQSDDGGSAFKINTKSNPFSIDNEPTNDYVKMDTDMLSLILKYKESDYTFTSATTYAKNSSTKYNYVAIRGGLDMDFDIEIEEITQEFRLKQNFENSDFLIGLFYSDKLKFDYKENQTFLTLYPVPVLSKNSLENPDENIALFSQYRYYIDEKYSVMAGLRYQTTKRSFSRTMNNFAAASTSVEGETTWTHVLPTLSFSYYAEDDSHTYLTYAKGYRPGGYNYRTSDALTPFKPETTNSLELGHKRVLNSSTTFSSALFYNLIDNLRINTFDNNLATITLSAEKAYSYGAEIEVNYKADNLNIFMTCGVIKTEISESKDSPQYERNNIIDVPNITTSIGAKYMFTQNYHIQSDVKYMGERYYNASNSAKESGYATANIGIGYKKDGWSALVYVDNIFDKRYVDFMIFHTI

SEQ ID NO: 20126 - protein, 514 aa, Synechococcus sp.
MKLFQQLLVAPAALGLLATGANAAELNINGVSDYAASADQVTSVTQFSDVYPTDWAYQALANLVETYGCVAGYPNGTFRGNRAMTRYEAAALLNACLDRITEVTDELRRLLKEFETELAILKGRVDGLEARVGELEATQFSTTTKLRGQADFFMGAVKYDDRDECNEEVAGACESDGFNFSYRYTLNLDTSFTGKDLLYTRLRSGNMKNVWTESDSYLSDAKSGDNTLKVDKLWYSFPIGDEFKVTVGPLIENYYMIETPTRYKPILKAFKLGGYGAVLGASTGQGFGVQWRQDVDPGDAAFNIAVNYVADGGDGAKSTSKKQMFGEDTDAYLLSQVGYGNRKWYLSALYALKNARQPDGSSTAKAAMGYSTPTAKNLAHPLHAVGLRGYWSPEDSGFIPTISAGLDFGWADSEYYGNAEAVTGWMVGLNWNDAFMEGNKLGLGFGSYSSYATEIRDRPDGGDQNFAIEAYYDFAVTDNITITPAVFWVDDAKGKDQIDGANKLGGLVKTTFKF

SEQ ID NO: 20127 - protein, 478 aa, Synechococcus sp.
MKLFQQLLVAPAALGLLAPVAATASELNMDGVNQYASQEQVTSISQFSDVQPTDWAYQALSNLIERYGCVAGYPDGTYKGQRAMTRFEAAALLNACLDRVTEVTDELKRLMAEFEKELAILKGRVDGLEAKVGELEANQFSTTTKLKGIATMVLGGAGETGFGDNVTANYDVRLMFDTSFTGKDLLRTTLRAGNFGDSVFGNGNTAMEVAFQEESGADSVGINRLFYQFPISDSFTATFGAKVRQDDMLAMWPSAYPADTILDLFTYAGARATYSLNLGAGVGLWWQNEGFSISANFVSNENAAEDSSRGVGEDYTGTVQIGYAGDNWGAAFAYTYSDFVGFDSTNNVGLSAYWSPAESGWVPSISVGGGWSDGFVDSADDAWSWMVGIQWADMFVKGNALGMAVGSAGQTDPGKCADRGVLCTGGIWTDGGEETIAYELWYKFQVTDNISVTPAFFWIENDGASDTYGGLVKTTFKF

SEQ ID NO: 20128 - protein, 875 aa, Synechococcus sp.
MKLLQALPSLCAVAVSAVYAPNIMAADEEVERIEVTGSHIKRTDMEGPSPVTSISEEDISNSGATDLIGLFSKLPISGQGTFSTQANSSDDTANGGSSVSLRGLGADSTLILVNGRRVSVSPFAKGIDTAFVDINNIPVSAIKRVDILKDGASATYGSDAIAGVINIILRDDIDGAEITARIGDTSAGGGKEESASLVWGSHTEKSSHTFILDYFNREELLYGDRDYSKSANQSALRPNDPFAKSFRSSSGIPGTIELAVRPEDPEKVFRLPDTFGNDVCAPEDIDSVDNICRYDYAPVMTMVPENKRFSVNYMGKYDITDNVSGFLEFNGQSSKTTVKGAGSPSFNELFMSADNPNHPFADMPTHEFYNQDLTMRRRMVDIGNRLKEVESDYYRTVIGLNGQFGEWDWETAFSYINSKSVERGIDGFPNSRRAQEAIDNGSWNPFEPSTNTQEALDFIETTTNRVGESTNRSLDAKLSGPLLEMPAGELMVAFGIEYREETISDNPDDQFLRGEVFGTEATQANGERDNTAFYAELGVPVFESLELQLALRHEDYSDFGTTTDPKVSFLWSPLEDLSFRGSWGTAFRAPSLAQLGLGRTDESPSLVDTVRCDAVGNINKACEVQEYTAVFEGNPDLGPEESTSYNLGVIYNITDNLNFSLDYYSYDIENIIDSDTQFVFSNFGDDPNVVERLPSAIPNDPGEVVTIYDSFQNIGDLVTTGLDLDANFLLETGAGEFKFSYALNYMLKYEDKRPDSDGGQRINIVEGDFEQPEARWTAGVDWTITDFRSYLGLNYIGEFKQKEAVQKDGMPDIDAMMTVDASVNYYGLPDTVLTLGATNLLDEEPPFSYHDFMGYVTSVHSGQGRFVYLQASYSF

SEQ ID NO: 20129 - protein, 649 aa, Synechococcus sp.
MPAYAQEKPKSDEQSGVILNRIVITSAPQSTPFKVVTDPKAPRQPVPASGGADYLKTIPGFSTIRNGGTNGDLVFRGMFGSRVNIRTDGGVILGACGGRMDNPTSYISPESYDRMSVIKGPQTVQWGPAGSAATVLFERDPQHFDKLTLKGDSSILFGSNGRFDARVDATVGDKPGYIRMMANKSRANDYKDGDGNRVPSKWDKWNTDLYLGLTPDADTVLEISGGLGDGEARYAGRAMDGSQFERQSFGLKFSKSNVSDYLEKIEAQLYYNYADHIMDNFRLRPPQKMPMESEVDRRSMGGRVSTTWNFDEHRLVAGLDFQTDTHRGKEKVNMQLTDNWLKDAQFANYGVFGEWTWNFADNQRLVAGGRIDRASVEDDRASSLTYGDKRNQAAFSGFIRHEQDWSSLPVNSYIGLGYVNRFPDYWELFSPKGVTGSALNAFEGIESEKTVQVDFGAQYSEGDTDIWASGYFGVINDFILFDYSNPGGSVATNVNARIMGAELGVSRQFANYWKAEASIAYAWGQNTTYDEPLPQIPPLEGRLGLTYERDNWSVGALWRLVAAQTRIAENMGNVVGKDFDKSAGFGVFSVNGTYRFNESVRLSLGVDNLFNKEYTEHLNRDGDAGFGFSSNYQLREPGRTFWAKTDFKF

SEQ ID NO: 20130 - protein, 366 aa, Shigella flexneri
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGLATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 20131 - protein, 1035 aa, Shigella flexneri
MEGIKRSLLFALFLIICTMVQAQRLTVQGKVVSKTDGEPIIGATVIETNQTGNGTITNIDGDFTLSVPQGAELTISYIGFKTVNVEAQATLDITLEEESELLQEIVVTGYTTQRKADLTGAISVVSMDEIAKQNENNPIKALQGRVPGMNITADGNPSGNATVRIRGIGTLNNNDPLYIIDGVPTKSGMHELNGNDIESIQVLKDAASASIYGSRAANGVIIITTKKGKEGQIKINFDASIAASMYTNKMEVLNAEEYGRAMWQAYVNEGQDPNTNALGYKYSWGYDANGYPQLNNISMSKYLDSANTVPAADTDWFDETTRTGIIQQYNVSVSNGSEKGSSFFSLGYYKNIGIIKDSDFERFSARMNSDYNLIGKFLTIGEHFTLNRTSEVQAPGGFLQNVLQFNPSLPVYDINGEYAGPVGGYPDRENPVARLDRNSDNRYTYWRMFGDAYINLNPFKGFNVRSTFGLDYAQKSQRIFTYPITEGNVTNDKNAVEAKQEHWTKWMWNAIATYNLEIGKHRGDAMVGMELNREDDINFSGYKEDYSILTPDYMWPNAGSGTAQAYGSGEGYSLVSFFGKLNYTYNDKYLLSMTVRRDGSSRFGKNNRYATFPSFSLGWRLNREKFMQSLSWIDDLKVRGSWGQTGNQEISNIARYTIYVPNYGVTESGGQSYGTSYDIAGTNGGSILQSGFKRNQIGNDNIKWETTTQINLGLDFSILKQSLYGSFDWFYKKTTDILVQMAGIAAMGEGSSQWINAGEMKNVGVELNLGYRNQTAFGLKYDLNANIATYRNEITKLPTTVAANGTFGGNGVQSVIGHANGSQVGYVADGIFKSQEEIDNHATQEGAGIGRIRWRDLDHNGIINEKDQQWIYDPTPDFSYGLNIYLEYKNFDLTMFWQGVQGVDVISDLKKETDLWSGLNIGFLNKGKRVLNAWSPTNPNSTIPALSRSDTNNEKRVSTYFVENGSFLKLRNIQLGYNVPKTFAQKMKMERLRFYLSAQNVFTIKSKEFTGVDPENANYGYPIPMNITFGINVGF

SEQ ID NO: 20132 - protein, 773 aa, Shigella flexneri
MQGKNTIVTTGDYSIGLLSQTSGNLNTDTIIRVNSDGSVTPSFSDGDDTFIVTAGNHAVGVLACASPGSACACVSSLDEESTADTGSNENNAIAKLDMAKGEITTHGTESYAAYANGTVVKAGDTLDYTNASVTLTDVDITTHGDNAHAIAARQGTVSFNQGEIYTTGPDAAIAKIYNGGTVTLKNTSAVAHQGSGIVLESSINGQEATVDILSGSSLRSANEILYHKDETSNVTITDSEVSSAADVFINNIKGHLTVDATNSKITGSANISTDDNTHTYLSLSDNSTWDIKADSTVSNLTVDNSTVYISRADGRDVEPTRLTITENYVGNNGVLHLRTELDDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRPEAGSYVANLAAANTLFVMRLNDRAGEMRYIDPVTEQERSSRLWLRQIGGHNAWRDSNGQLRTTSHRYVSQLGGDLLTGGFTDSDSWRLGVMAGYARDYNLTHSSVSDYRSKGSVRGYSAGLYATWFADDISKKGAYIDSWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGVSNLGEIKLGVNGNLNPAASVWGNVGVQLGDNGYNDTAVMVGLKYKF

SEQ ID NO: 20133 - protein, 556 aa, Rhodopirellula baltica
MPEASDGIFCGGAAVRANSEKIVQIRQHRIKSSTYTKAKQGISDCLFYSGLNLNQYGVALPYYLYCLRLRRLVLIFVNPLYLSTVRLFTETEMTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIMEKAKALKETPPNPTKAAQIKADGHADVKGSDWGFGYQLAWMWDINDRARVGVNYRSKVSHTLKGDAEWAADDAAAKAMWSTMLAANGYTANEKARVKIVTPESLSVHGMYKVSDKADLFGDVTWTRHSRFDKAELVFEKEKTIGMGKKSDRTTITPNWRNTYKVGLGGSYQISEPLQLRAGIAFDKSPVRNADYRMNSLPDGNRIWFSAGMKYHIGKNHVVDAAYTHIHINDTTYRTAKASGNDVDSKGASSARFKNHADIIGLQYTYKFK

SEQ ID NO: 20134 - protein, 697 aa, Rhodopirellula baltica
MFFSILRFKSIQILFPIFFCISIQAQDESTKIGNKVVEKESPNKIITKNNNTTTESLRKENGQNIPEESQIVVTGSRGERRLKDSTVATEVISRKKIEASGARNAAEVLETQLGIDVVPFFGGSRVRMLGLDSQYVLILIDGERIAGRLNNAVDLSRFKVQNLERIEIVKGASSALYGADAIGGVINLITREADKKLSYEMRTTYGNGSRKNFNTEGEFNTNANMGFRNEFVSGSVSSGYNKNPGYRLVPNSQATTGNAYQDLNTGINLTFNPDGNFKGKTRILYQHRNQNGVDVTQSKAIFDRNNKTHDFLATGSLEYGFGKRNLISFRGNISKWENKYYNNQRGSDELDVKQLNAELTSQGTVQLDMEASERHFITIGAESFANELESDRLQSRYVYRTRKAVFFQDEWTISSSPRIRMIPGVRYDDDSQFGNQTTPKLAVRYDIFQNLVWRASYGRGFRPPSFQELYLRFENPAVGYVVEGNPNLKPERSITINSDLEYSPFSFLTLSLSLYRNDIINLIQYKFDSNKGKEFAEFQLQNIAKAYTRGGEFGVQYRFLKYFTLELGYNHTDTRDLNTDRPLEGRALHQASANFIYNSPGGFQFNLRGKHLDKRPFYSATNNLAGQDSIPTEVKLNENPPVIYGKPFSILNVRIEQKFFNKHFSLFLGVDNVLNQYELTYNPTRPRFYYGGFSAQF

SEQ ID NO: 20135 - protein, 458 aa, Rhodopirellula baltica
MKKRSLILAALLITGVSVSADTIEEAFAKGKVQGELKSFYINRSYDGVATQTRDGLSVGGHLNYNTAKYYGFDVGATFYTTNKVDEKSSTANENDNTLFGADGGGYTVLGEAYIGYTAAKTTVQFGRLSINTPFAAPNNFRMLPNTFEGLVVKNSDVTDTKFELGHITKIQTNGFANSVPVTNGVLDPNSSMTRLSLLYGFGPGYKVGEFANIADVYLGSTNTKSTAGMTYINAKYTGLKGFTFSIWDQYIHDIMNIVVAKASYKGKLSDVNTFASVFYTKQDSVGDNLLGKAFDTGSGAKDVDSTQYGAMLKASLDNGLGIDLRYVNTPASAGSVLDGGIVNALGGANPFIISQGALHANFGDTASYMAGVDYQFKPLTGIDLLAMVKYFEYDIGEYNGYQSGYSWKTKEVDLDFIYKVTKNFKLRARANFPRDWFDLGGTTQLSFDEYRLIAYYKF

SEQ ID NO: 20136 - protein, 208 aa, Rhodopirellula baltica
MTKPYVRLDKNDAAVLLVDHQAGLLSLVRDIEPDKFKNNVLALGDLAKYFNLPTILTTSFETGPNGPLVPELKAQFPDTPYIARPGNINAWDNEDFVKAVKATGKKQLIIAGVVTEVCVAFPALSAIEEGFDVFVVTDASGTFNEITRHSAWDRLSQAGAQLMTWFGVACELHRDWRNDIEGLATLFSNHIPDYRNLMTSYDTLTKQK

SEQ ID NO: 20137 - protein, 358 aa, Rhodopirellula baltica
MDKRLAGVAVAGFFPLAASAASVTLYGVADSFIGYFSNSEKSVTSLNSGGLAGSRWGMRGTEDLSADLQAVFVLEGGYNMDTGTNAQGGRLFGRRATVGMRSNTYGEIALGRQPTPGYDFAAIFDPVLMAPGSVAASLTGESSNPWMFNPLNDPARSDNAVRYNSPSFGGVTVSAAHVFSENAGAPVNRNYDIVTFLYSANKLNAGYGFARATGTTNLTPDTSRQLEHAFAASYETPWATLYVNYQLRYRLGAAHDSAWQVGTTIPVGAAGNLKLAYGMRDSGVTNGLPDNTPTADVAAWAIGYTYDLSKRTTLYAFFKRLENRGSSKQTIYPPGGLAAPTQLHENVNALGAGIYHRF

SEQ ID NO: 20138 - protein, 789 aa, Rhodopirellula baltica
MESRWKLTTAVVLAATAATFANDAAAQDAKQERASADSPVVFGDIVVTATKRSENVGRVPIAISAFSGDQLKALGITETTQITQHVPGLQLNAWSPNVTIFNLRGVSQNNFTDYLESPVAVYIDDAYMGSINGVSGQLFDVQRVEVLRGPQGTLFGRNATGGLIHYLSTDASNATFNGYATAGYERFNRRMLEGAAGGSIAEGLRFRVAGRIARADGYVKPQAALPGVFESNGQALGGENGWALRGTIQADLGERGTLDLWYKHSEDNGVATGGYVFDNCDLTASGYCATDAAGLSNGTGGVINAITGEKASPYANFSNLRGSLDRDIDVAQAKLLYDLGGAKLTAITNYTWLDKVYAEDGDATPLDLIGFGTTAKYRQFSQELRLSGDAPRFRWQVGAYYLDMKIRGSSLTSGVPALSAAVATGLDGTNPAIDDDYNLRSKNWSLFGQVEYDLADKVTLVAGGRYSKDTKRVDYRSAVTSGGATVELGSDESFAALRPGVDRISDGDWAARVSLNFKPNADTLLFASWNRGIKGGNFTLSPVVDVANFQHGGETLNSFELGAKWANADKTVRLAATAYHYIYDNYQAFAIINFVPQVRNSDARATGVEIEAFLRPAPHFNVNLGATWETSKVDFVSTAGTAVLGVLVPGAPAPQYCTDQGDGTYGCAYPSAGVTDAELPNSPRFSVNYVLRYDVDTSFGNVAAQFDGAWYDDQFLEVTNGASSRQSAYNVSNASLTWTSPDDRFSVEVYGRNVFDTVYRQYTLNLGPLGTTSMYAKPATYGVSATVKW

SEQ ID NO: 20139 - protein, 440 aa, Prochlorococcus marinus
MKLFQKLIAAPALISLASGFAVNATEINSTDLSDYSNSNNLVSLGDFKSDTLFPGDWAYDSLKDLTNSPKFNGNSVSRLEAAAELNNLIAGGEGLMNGAAIDRLSDELGSELAIMKGRVDGLESRVNTIEAGSFSSTTSMKGKVEAMLAAQSTDAGANDAVMFNYHYEVDLNTSFTGDDKLNVEIAAGNQVANSVAAAHDALGETSDNLAIEDVNYTFPVGEWALSVGESMDASKNWPNSCKYGNVVDNIGDCGASNSVDLGGDISISAGRDFGDGWSFGLGASADDGETNAGMFTEEGDDRYGLALGYENDTYGVTLAYSSIEDGAANNTYVGATAYYNFEPFTLSGGIEWMEADLATDVNSEQWTVGITTEMGPGEISAGIGTNGAIDDNAEDLHVYEVKYSYPVNDSVTLDTFAYIAETVAATDDTTAVGFLTTFKF

SEQ ID NO: 20140 - protein, 543 aa, Prochlorococcus marinus
MKLFQQLLVAPAALGLMAPMAANAADLDIKGVSDYSASSEQVTSISQFQDVYPTDWAYQALSNLIERYGCVAGYPSGSYLGNRAMTRFEAAALLNACLDRITEVTDELRRLLNEFEQELAILKGRVDGLEARVGELEATQFSTTTKLVGQTSFIVGANSFAGDAEDVFGDDRDDEAAASDGATVFNYDMRLELNTSFTGKDLLKTRLRAGNFAKSPYSGNGYVGLSALEVAFPGDEDHNDVVKVDRLWYQFPLGEEFTVTAGAMVRQDNMLAVWPSNYPSETILDVFTYAGAPGAYSLTKGGGAGIWWDDNDSGWSISASYVSGNADDGNPNTGGVGTDGAASNATAQIAYAQDQWGIAAAYSYTSGDNGAGIYPGNATPLAVSLAGSGTTNSYAVSAWWAPEDTGWFPSISAGWGLNDVNENDDSDLIDNATSQSWYVGVQWEDAFIEGNVLGAAVGQPTFVTAVDYDSDVDASDFVADGNYAFELWYKFQVTDNISVTPAVYYLSRPLGDLTDGGGPVFGGGRSDDTFSNFGGLVRTTFKF

SEQ ID NO: 20141 - protein, 536 aa, Prochlorococcus marinus
MKLFQQLLVAPAALGLMAPMAANAADLDIKGVSDYSASSEQVTSISQFQDVYPTDWAYQALSNLIERYGCVAGYPSGSYLGNRAMTRFEAAALLNACLDRITEVTDELRRLMQEFEQELAILKGRVDGLEARVGELEATQFSTTTKLNGKAHMVLGGTSYTGDETDDLTDDGDYLGTDALTFNYTLQLDLNTSFTGKDLLYTRLKTGNFADSAFGGKGYVKPAYLNVANNNQDVVKVDKLWYTFPIGDDFTAWIGAKIENYYMLGSAPSLYQPILKAFKLGGNYGVYGASTGQGLGLAWKSPVDDPMDARFGISANYVAKEGDNGDPSDGGVGNGNSKGKFLAKVDYGNPQWQVSAAYAYTQQGMTQGFGTSDGGASVYSKCRGTSSCGADSNGVAFRAFWQPDEPGLIPSFSVGYDFTDYNLPDEAADGTREQSMAWFAGMMWKDAFIEGNTLGAAVSELQWVTQQKGDDTPDDGNMAFELWYKFQVTDNISVTPAVFYLSRPFGEKTGTATKYGGKGADTFGTFGGLVQTTFKF

SEQ ID NO: 20142 - protein, 481 aa, Prochlorococcus marinus
MKLFQQLLVAPAALGLLATGANAAQLNINGVAEYSSSSKDQVTSVTQFSDVYPTDWAYQALSNLVEQYGCVAGYPNGTFRGNRAMTRYEAAALLNACLDRVTEVTDQLKSLITEFEKELAMIAGKVDGLEARVGELSASQFSTTTKLKGYSAWVLGAAEGFDGDAGEAVTFNYDLRLALKTSFTGEDMLTTVLRAGNFGPSVWDEGLTFVETAMSSGGSVKIGRLYYTFPVGENLTVTAGPVVRTDDAGMYAGYATFYPSDLLLDFFTYGGAWASNNLAGAGAGVGGVYSFGDSGFSLSGNYVAWSGSESIGQDETASTSSWQLFYSGEVAEGSFLAQAGYAYAQNVGLTIGTNKAFAVEGDSRNGYSLAAAWAPADAGIIPSVSGGWSMSDPEGTDENIHGWYVGLEWSDVFVAGNSFGTAIGQAPKVEDDYNKMWEIFYKFAVSDNITVTPTYFIIDEYSGSLTGEYVHGAYLKTTFTF

SEQ ID NO: 20143 - protein, 531 aa, Prochlorococcus marinus
MKLFQQLLVAPAALGLMAPMAANAADLDIKGVSDYSASSEQVTSISQFQDVYPTDWAYQALSNLIERYGCVAGYPSGSYLGNRAMTRFEAAALLNACLDRITEVTDELRRLLQEFEQELAILKGRVDGLEARVGELEATQFSTTTKLVGQTSFVIGANSFGGSLDDARDIYNKEWGSTSFNYDLQLVLNTSFTGKDTLSTTLRAGNFGKTVFGGDGPTNLSTLEVASEAEGGADVVYIDKIFYQLPIGESFTATLGAIVGQEDMLAIWPTAYASDGSSTVLDVVTLPGASVGAFNKNLGQGAGIWWENNGWAISANYVAANGHNGDPNSNDDPCGGIANDCSAGTGTAQIGYTDEQWGVAATYSYLQNNDLVLYSSIYVADSYGFTSGTDSYTNAFALSAYWMPQENGWIPSVSLGWGINSTSFDVDDDVYDGEVSQSQSWMVGLEWNDLFVEGNAGGFAIGQAPFATRLKDGDTPHDGNYVSELWYKFQATDNIVVTPGLFYLSRSASGLMDTDKTLNQFGGVFRTTFSF

SEQ ID NO: 20144 - protein, 342 aa, Prochlorococcus marinus
MKKTLISATVASVLTMASFGALAEGPNFYGRLDLSVTNSDNGLTSREGKEGTVLENNFSHVGVKGSENIANNIDVIYQMEFQVENTSSNSDVFKARNTFLGLKTTAGTVLVGRNDSVFKQAEGGIDLFGNSNADIDRLVGAQSRVADGIWYYSPKIADLVTLNATYLMTDNNQAGVEDADDQYALSATIGDKKLKAQNFYVAGAYNKGIAGMDAYRGVAQVKVAGFKLGGLFQNSEHVSKTNLEGNTYFVNVAYNLNGVNLKAEYGKDEAGLGLYAKRSGIQTAETTDVNITTITVGADYKIAKSTMVYGHYAMYEGDYKLSGIKMDLEDDNVFTVGVRYNF

SEQ ID NO: 20145 - protein, 426 aa, Prochlorococcus marinus
MKLFQKMLVATASVGLIAPMAAQASDVLNLEGMNDYNSSNKSSATSLFDSETFVNEVNEELATLKGRVDGIEAIQNDYEAGSFSETTTLDGKVIFTVGALNVEETGETEGTLATYMWQGNLNTSFTGDDNLYVRLKTGNATGWQTSYTYGTYLSSSKGNADAIKVDKIWYTFPVGEKHTVWIGPKIENYYMHATTPSIYQPITKQFTLGGNGAAYGASTNPGFGWAYKADNGFAISSNVVSKEGDSTSGWGTNESATSWATQIGYTQPTYSASVILNMKYNGWTDSYYTTPFGKLRPNGGNSSNIGLRGWWRPEDAGKATPSISLGYDTSETDATTNSNTTAYFVGLTWEDTFTPDDKIGVAFGQPQTREDETTVDPIAWEAYYSYQVNDSVNVTPAIFGGSDRAGSAGRQGRDHLGAVVETTFKF

SEQ ID NO: 20146 - protein, 716 aa, Helicobacter hepaticus
MILSMNCMSRGALLSSVAIFAMTAGAEAQDRDQSRDSVYQLGEIYVSGGGRSGSGSGGGVGGSTVTREQTWTFEKQTLDQAVNLVPGVNGTQSANGQRNETDIFVRGFGRWQVPLMIDGVRVYLPADNRLDFSRFLTGDIAEIQIQKGYASVLDGPGGMGGAINLVSIKPVKAFESELNAGTMFDNRGAFQGWNSYARVGSRQEKFYVQGSVNQLDQDFWSLSRGYSPYPAQGPYAGSLEDGGRRNGSDTRDWRINLKAGYTPNETDEYSINYIKQSGAKGAPLNVYNNPPSSQNSFWLWPKWDVENLSFLSNTQLGDASYVRTKLYYNTFYNLLSAYDDITYSSQSNNGRFNSYYDDSARGGSVEAGTELIPMNTLKTAFHYRQDFHAEWNHNRPTHPTMAMLEPRQNQAQTTWSIAGEDTFHVTPDFDLVAGISYDKYSINRAEEWDSGGGFIYEYPKGGSDALNWQTAAIWRYNETGQVHFSVSDRTRFPTIFELYSQRFGTAIPNPNLGPERATNYELGWKGQIASNVKGTAAIFYSDVRDLIQAVRVSPTQSQTQNINQGHFYGFEASFEAQLSAQFMIGGNYTFIERNVSDVSVPGFQPVGVPTQKAFLYATWRPIEPLAITPNLEVTSDRWSDVLVGTQGPNAPIRAAFPDLYIRTGAYTLANINVNYKFTENVEVAGGVRNLLDQNYELAWGLPQPGRTFYLKARARF

SEQ ID NO: 20147 - protein, 537 aa, Helicobacter hepaticus
MFGGNAMHGVINVKSTNIDGNNNLNFQVDKNESVRSKFLYKSLENTAVGFELVSDNGFRNNSGFDQQKIILKNFNNIRDLSLQTLISFTNLNQETAGYINSYFYPTRIENINPEAYRDAKSLRIKTEISRGLKKYKIYFTPYLRLSSMEFIQHYLPGKPIEKNGQKSTGLTIKLSEMEINDNFFEIGSQVEIAFINLDQFQPDVLNSSNAFNNAVRPQGYHYDFEVVTNFFAGFISHEIELKNNYNFFSNLRLEYLNYDYDNLMSDGRLKDDATACARGGCFYSRPADSELSFKDYSYRLGLSKITNIGNIFLQFSKGHRPPQINELFRLQKSQVLADLDSEKIDSIELALENKGNDFFNKLVFYYSKKKNYIFKNSDSSMVLGGKSRHKGIEIKGAKVLNNSFSVKYALNLAGHYYDFTNQDMGVASGNEIDTSPNLFGSIFINFQVSNKLNIEIEQEFMDEYFTEPSNAYIYKGHNLTNLRTSFEMSDAINLNLSILNLFDKEYAERADYSLFTGERFFPGIPLKWRLGINYKFN

SEQ ID NO: 20148 - protein, 798 aa, Helicobacter hepaticus
MSFELRRVQRLAGASLLLLGAAATSALAQEPVQQPVQQPAQDKSSAELPAITVTAPSPIVRRVVPTRSPVHVARTGRSRSQQHAAEATPPAAASAAAPQQGVLPIVTNQFATVTVVPNEEIRREGGGQLGDLLFSKPGITGSSFAPGASSRPIIRGLDVNRVGIVENGTNSGGASDLGEDHFVPIDPLATNQVEVVRGPAALRYGSTSIGGVVSATNNRIPDALPSCAPSFQTYGLPTKAPLATAETSPCVTAETRSAFSSVDRGVESGVLLDTGGGNFAFHADVYGRTTTDYGIPSYPYLNDQTRSVANGRQPNSATRSDGASIGGSYFFQGGYIGAAITQNDSLYHIPGIDGADHNTRIDGHQTKINVKGEYRPDAAAIDTIRFWAGATDYRHNEIGLADPADPNSDGVRQTFTNKEQEIRTEVQLMPFNARFAEVTTALGFQVGHQELTAPSPDNPGTLFNGLWDPNNNTRVAGYAFNEFKFTDATRAQIAGRIEHVELHGTTPNFPADFLPDGTPQVAIARNPSYTPKSGSIGLLQDLPGGMVGSITAQYVERAPKAAELFSRGAHDATATFDIGNPNLTIETAKSVELGVRKATGPFRFEATVYYTHFDNFIFRRLTGVMCGDDFASCGTPGAELNQAVYSQRNANFRGGEFQSQLDVGAFQGGIWGIENQLDVVRATFTDGTNVPRIPPLRMGGGVFWRDDNWLMRVNLLHAFAQNNVAVIAETPTAGYNLLKAEVSYKTKLDRNWFGAREMIAGVVGNNLLNESIRNSVSYTKDEVLMPGIGVRAFANFKF

SEQ ID NO: 20149 - protein, 165 aa, Helicobacter hepaticus
MKKIVVAVLVGLALGSIGVRNAAGYKNTVSIGYAYTDLSGWLSGNANGANIKYNWEDLDSGFGAMGSVTYTSADVNNYGYKVGDADYTSLLVGPSYRFNDYLNAYVMIGAANGHIKDNWGNSDNKTAFAYGAGIQLNPVENIAVNASYEHTSFSTDADSDVKAGT

SEQ ID NO: 20150 - protein, 820 aa, Helicobacter hepaticus
MKTKKIMIALMLLTTGTAWAEDFPKDSLKIVDIEEVVVIATPKENRKLRDLPVAATVLSQDNMRANQVNSVKNLTGIVPNLFIPDYGSKLTTSIYIRGIGSRINTPSVGLYVDNIPYIDKSAFDFNYADIERIDILRGPQGTLYGRNTMGGLIKVHTKSPFTYQGTDIRMGAATYNNYNVSLTHYHRTSDRFAFSTGGFYEHTGGFFENSARNNEKVDKSNAGGGRFRGIYLPTSNLKIDMALSYEYSDQGGYPYYYIGITPSAIAKAQKDGKEMTEDRADYIGKISYNDRSSYRRGLLNSGVNIEYQACNFILSAVTGYQHLNDRMFLDQDFTERDIFNIEQKQRANTISEEIVLKAKPGKRWQWATGAFGFYQWLHTTGPVLFKEEGVKSVIENNANSAFEEVSAKPGAPTMGMTVYNPTLSVGGTFDTPTLSGALYHQSTFNNLFIEGLSVTAGLRLDYEKISMKYNSLSTPIDFGFDFHMAMGPTQINLSDQNMKAPASFVGKLSTDYVQLLPKFAIQYEWKNQNNVYATVTRGYRSGGYNIQMFSDLSQTELKNSMMNAIKESPTIGQDAIWGETIIKMMDQMVPAKEINVKASTTYKPEYSWNYEVGSHLTLWEGRLWADVAAFYMDTRDQQLSQFAESGLGRITINAGKSRSYGAEAALRASVTKELSLNASYGYTYATFTDYVITEEKKDGTPITTDYNGKYVPFVPKHTLNIGGEYAITCSPHSIFDRVVFQANYNAAGRIYWTEQNDVSQSFYGTLNWRTNLEIGDAMISFWARNFLNKDYAAFYFETMNKGFMQKGRPMQFGVDLRCRF

SEQ ID NO: 20151 - protein, 842 aa, Helicobacter hepaticus
MQQALSIEGGDRLKPRVLGPGRPAILASAISQLFLVAGVVTILALPEIAQAADAAPGTPASFAARKTYNIPAGSLEAALNRFGREAGILLSFPTELTNGLKTKGLQGSYNVQEALPLLLYGTDLVASIDGASAVIRRQSAAVSEATLPAVHVTAAATATTEGSQSYSSSVVTLNRGEQKLKDIPQSVSVLTRQRMDDQALTTLADAVGNTTGLVATQGVGPGTVIMSRGFQIDSYQYDGVPLPRNTYSIGNWSSESLAFYDRVEVLRGAAGLTQGTNSPGGAINFVRKRGQAKPTVTVTGKAGSWDHYGLQLDAGGPLNAEGTLRGRVVVDEDRSDSFINYVWANTRTLYAALDYDISPNTTVGIGISNKETRSRPSFIGLPRYADKSDIGLPRSTYTGSNWNRAYNDQTSVYADLEHRFNDNWSFKASAVAMREKNTSAHQRISAAGTGITPGGNTVRYGDFAMNLEGEQYGLDAYVRGRFEAMAMKHEVIFGANYSRYHTDDAVARRWTTGGNIFAINNNRPWQDFASIAATPGSTGTVSSYDVEQTGVYGTWRAQLTDRLTAILGGRVGWFEQMYSQPARGTDPRYESVQEASGRFTPYGGLVYALSDQWSAYTSYSDVFEVQSAPTLSGAPIKPVTGTNYEFGIKGELADGRVNTSFAVFRYDHKNRAVVDPDGLGMCSGNDCSRAAGKVRSQGFEAEVSGEVLRGLQLFGGYTFNTTKYLIDPVNEGKVFSTWTPKHMLRLWADYKLPGNLSKFSVGGGVNTQSKALSFDSSFDVPGFTIWSARAAYQVTPELSLALNVNNLFDKTYYLPSYNSTTGNNYYGTPRSALLTLKYTPRF

SEQ ID NO: 20152 - protein, 772 aa, Helicobacter hepaticus
MLFSKNFSTDNGGAITAKTLSLTGTTMSALFSENTSSKKGGAIQTSDALTITGNQGEVSFSDNTSSDSGAAIFTEASVTISNNAKVSFIDNKVTGASSSTTGDMSGGAICAYKTSTDTKVTLTGNQMLLFSNNTSTTAGGAIYVKKLELASGGLTLFSRNSVNGGTAPKGGAIAIEDSGELSLSADSGDIVFLGNTVTSTTPGTNRSSIDLGTSAKMTALRSAAGRAIYFYDPITTGSSTTVTDVLKVNETPADSALQYTGNIIFTGEKLSETEAADSKNLTSKLLQPVTLSGGTLSLKHGVTLQTQAFTQQADSRLEMDVGTTLEPADTSTINNLVINISSIDGAKKAKIETKATSKNLTLSGTITLLDPTGTFYENHSLRNPQSYDILELKASGTVTSTAVTPDPIMGEKFHYGYQGTWGPIVWGTGASTTATFNWTKTGYIPNPERIGSLVPNSLWNAFIDISSLHYLMETANEGLQGDRAFWCAGLSNFFHKDSTKTRRGFRHLSGGYVIGGNLHTCSDKILSAAFCQLFGRDRDYFVAKNQGTVYGGTLYYQHNETYISLPCKLRPCSLSYVPTEIPVLFSGNLSYTHTDNDLKTKYTTYPTVKGSWGNDSFALEFGGRAPICLDESALFEQYMPFMKLQFVYAHQEGFKEQGTEAREFGSSRLVNLALPIGIRFDKESDCQDATYNLTLGYTVDLVRSNPDCTTTLRISGDSWKTFGTNLARQALVLRAGNHFCFNSNFEAFSQFSFELRGSSRNYNVDLGAKYQF

SEQ ID NO: 20153 - protein, 744 aa, Helicobacter hepaticus
MKTIKIIFTTLLLLLSVASVYAQGRKISGKILSPLNKPIEGAIISAVGSKDAKTGVDGTFKMELKENTTQISVWAAGYYPETRLVDDNSQVVILMMPESTYKYNESAILPMRIESSRPELTSAVNINKKDFTQGSMKIDRALAGQVAGLKTTRAGGMPGEGSYMNLRGIRSFVGSNAPLVVINGVPYLPDSRESQLINGFSRDIFQAYNIQDIQNITVLKGAEASMYGSMGSNGVILIETDGATSDNLDTRVSFYGQYGVNWNNKRMPLLTGNDYKSYLSDIGMTYFGNMEGFFSEFPFLSDPNSKYNYLYNNTTDWQDEIYKNGFVTDNLFRVEGGDAIAKYDLSLGYAMENGLMDYTKSQRYHTQLNTNVLISKWVEMTATVGLAYLTGNYQQQGMDNVSNPILAAYSRAPLLSPYKKDIDGNILDTYSTYYYGNSTNMDFAVSNPLAIVNTLDGRNRQYDVNFRLGLVYKPFNGLSFNGTFGMFYNYNKEHLFIPGLSDKSILPIVDQYGNAENTVKEGVGETLNIFANGNVRYQRLFQGIHHLNILAGAQMLITQNKYEGGAGRNTPNDFYQTLGDTKTIGRYFYGYQEKWNWANFYAHADYTYRDMVAASLNVAADGASSAGTYGNHFYIYPSGGVTLLGKGWLPLTNSTLVNRLNLRAEYGLSGNSRFSSNLGKYYYTSLPYMTTSGIVRANISNTTLKPEKNIQFNLGLDMSLLRNRLEVTLDYYNNLSKDVIFAVP

SEQ ID NO: 20154 - protein, 575 aa, Helicobacter hepaticus
MKIKFLIIIITISSSLTFAFAQERTKDTIDDQVVNVVKPYKPTISDAFKIKDTPQLNDSSTVKKKEVKYNIFSIPVASTFTPAKGKAAKVDKAKYVKLYDNYASLGVGTYTSILGEIYLNHELSTGENVGGYFSHHSSAGGIEDIVLDDNFSKTHLNIHYSQKLRDFSWKIDTGFDLQTYNWYGLPQGIYTENQINMIDPNHSFNSFYLGGKLKFDDALIKDGSVRFRRFGDNQDSGENRFIAKASFDVPVRGETINTEFSIDYIGGSFDRNYGIDEELKYGNVTFGLAPSYQMIEDDLTIDLGVKFVFLNDTEFSNNKFFIYPNIEASYRLVDEILIAYGGIKGDLIQNSYYDFASENPFVSPTLIVSPTDRQFRSFLGLKGKLSNNVSYNIKGNYYSEKGKALYRANNTLEAPEEEYQYGNSFGIVYDDVNTFSVAGELNIDVNRNFTLGIKGEYFNYNVDQQSEAWNLPDVTGSVFLDYQISEKWYTGGSIYYVGERKDRTLLEGPLIDTAPITVTLDSYFDANAHLGYKINDQLSVFGKVNNIANQDYNKWTSFPVQGIQFLLGATYQFDF

SEQ ID NO: 20155 - protein, 221 aa, Helicobacter hepaticus
MLRIASCTAIAFGLMAGTSLAADLPQPVQPSQPEISYETPATFSAYDWSGAYIGANAGWGFLSADGKSGASGALDDDQNGVTAGVHAGYNFMVAPSVVLGAEADIQYNDLEEKSAGVELQSDWNATVRARAGYALDRTLVYGTGGAAFKDLTAKSSAGKDEKTAIGYVVGAGVEHAVTDTLTARLEYLYQDFGDQKFDFGGTTEKTKIDENLVRAGVSMKF

SEQ ID NO: 20156 - protein, 346 aa, Helicobacter hepaticus
MITIRDVARQAGVSVATVSRVLNNSTLVSADTREAVMKAVSELDYRPNANAQALATQVSDTIGVVVMDVSDAFFGALVKAVDLVAQQHQKYVLIGNSYHEAEKERHAIEVLIRQRCNALIVHSKALSDDELAQFMDNIPGMVLINRVVPGYAHRCVCLDNLSGARMATRMLLNNGHQRIGYLSSSHGIEDDAMRKAGWMSALKEQDIIPPESWIGAGTPDMPGGEAAMVELLGRNLQLTAVFAYNDNMAAGALTALKDNGIAIPLHLSIIGFDDIPIARYTDPQLTTVRYPIASMAKLATELALQGAAGNIDPRASHCFMPTLVRRHSVATRQNAAAITNSTNQAM

SEQ ID NO: 20157 - protein, 170 aa, Helicobacter hepaticus
MRIIKQTKGINEMKTPLVTREGYEKLKQELNYLWREERPEVTKKVTWAASLGDRSENADYQYNKKRLREIDRRVRYLTKCLENLKIVDYSPQQEGKVFFGAWVEIENDDGVTHRFRIVGYDEIFGRKDYISIDSPMARALLKKEVGDLAVVNTPAGEASWYVNAIEYVKP

SEQ ID NO: 20158 - protein, 372 aa, Helicobacter hepaticus
MKKILIATAVAASFASVAHAQSSVTLYGTLDAGITYTSNVGGNAQWALGSGTIDENRFGLRGVEDLGGGLKTIFTLEQGFDLNNGSQASAGKMFSRQAFVGLSSDAGTVTLGRQYDAVHDFLAPVTAVGSWGGSNFAHLGNLDMLDDNSAIPTNNAIKFTSANYAGFSFGGTYGFSNSSSFAANREYSFGAGYQNAGLRVGAGYQQRNSPNVNSKGASDLVDLSGLVDVPSDVSFRQRSFGAGASYAFGPAVMGLAWTQARFDNFTGSTASLHTNNYEVNAKYNLTPALGLGIAYTYTNGAAGDFHFHANQVGLQGDYALSKRTDIYAQGAYMLTSSPHGDLIPAVIDNGSATGVSSSRRQTVASVGLRHRF

SEQ ID NO: 20159 - protein, 342 aa, Helicobacter hepaticus
MMFGFDYMQQSASEVGYYGSAPDLNVFHPNSQMAIPTPSPWVNYNTDSHQAGIYGQDEIHWRHLILTGSIRNDWYRSHQTDNMYNTTTNQSPSQITWRASGLYHFDFGLAPYISYSTSFQPQSGSVSMDGGKTVRQANPSLGKQLEGGLKYQLPGTSLLLTAAGFHIEQTNVLVAVGNTGYSAESGLVHSDGFEFEAHAEPFHNLVLTAAVSIQKVHDDSTGKPLIQSGKGNASLFAFYTMPSGPAKGLGFGGGMRYSNKSYGGEASYGSVWVPQYAVFDASVRYDLSNLSRSLHGWNVGASVRNLFDKNFIANCLSYASYGQEFCYYGERRNAQANIGFSW

SEQ ID NO: 20160 - protein, 690 aa, Helicobacter hepaticus
MKTTIPLLALPFSLLALGIANAAEEEDAALDPMVIKGDVLGKASDPEVLTYSGSRSVVDAQDLSKGSVRGLDDALQRVPGVKIFDETGTGALPQISVRGLYESRSGRIQALSDGVPLALAPYGQTGMSLFPMTLATIDRIDIVRGGAAVQYGPNNVGGVINFISRPIPREWETTLQERTTFAPGGRQLWDSYLGTGGYLTDNFGLQLDLNTVNGEYGREHSDTDIQNYRLRGQWLIDDDRELTFGVQRYVADMDLAGALSVRDYKDDPRQSTRPLDRFEGDTDRVWGTYTQYFGAVGPFDSVEFSWTNFAHNSYRNFVVGLPFTPDAQPVTKQDGPRDFKVWGSEPRLSMSIDGDSIGQTWLLGARYVKEDIDYRVDRQNLNSGVTSVFRDWSFDNDAKAFYLSNAISLLDHRLTITPGVRYENATMDYSDSVTGFQRTNKAKEWLPGLTVGFQATEEWFVYANAQRSLRPPQVTQIVKEGAVDAEIAWNYETGVRYTPWSGLRVDFGLYRIDFDDQIEYNASTDRFVNLGSTRHQGIETEIFWSPEAIRGLELHAGYAYLDAEQRSGQYADNEVPYASRHQVILDGRYRFAEFWTYSLDGLYVSKSFTDAANSHAENATASVGELPSYWLWNTAIEREFKFANKSLLTASAGISNLFDRQYYYRGIDTSPWGRQPAPGRTFTVGLNYRF

SEQ ID NO: 20161 - protein, 635 aa, Helicobacter hepaticus
MQNTIKFSIILVAFLSSLHATDAKTVVLEPLSITSTAIKTDELKSTDAVEIYTQKDIEKAHVRNVYEFLNSQTSVITMPGYGNPFAQKIDMRGFGITDGYQNIVINVNGRRLNNVDMVSQLLSSISPASISRIEIIKSSGIVVGGDGANAGVINITTKKSNDKEFTIYGGSYGTFDGSFYLGHKGDKLAISASGEAQKNDGIRNIDSAGNKDESKLTTGTFNLLYNPIEALELRAGATSARTKMIYASGLTEAQYNDDPTQKGAYSVKQSYDTDAFNAGLGYDISDKLNFNADATRENKKSKYGTSNPAYYVYDSIKAKINYESDFLKLSVGYDNYNNDRTSATNEITKRNNAGYIMSNFELGNSVIKAGYRYEKVSFESRGGDNQDDTLHGAELGYNYSYDKEKSLFINYAHSYQSADLDRLFNWTTGAFTGYVNPAQANNYSIGFNHIVSNNKFKISAFYIDLKDEIYYHKTGPWTGDNTNIDKSHKYGLDIYDKWLITEKWNIALNYNYIQAIIDEEKEGSDNYAGNHLPGVSDHNIKATLGFLPNKFSTISVTQVYRSETYAADDFNNNFSQKQDAYMSTDISATYTMKSWEVFAKINNLFNQKNGLWIENDNIYPINFTRTAIVGFKLKY

SEQ ID NO: 20162 - protein, 1048 aa, Haemophilus ducreyi
MKKTFTFFTLLMLLSPGFLLAQVQVKGKVSDETGEGLPGVTVLVKGTTKGTIADFEGNYTISADENAVLVFSFIGFETKEEAINGRSIINLTLNEDSRSLDEVVVTAIGIKQQKKKLGYATQEVPMDVVGEASTLNLGNALTGQIAGLTVNNPTGMFQSPSFSLRGKSPLIVLDGIPVETDLFDISPEDIESINVLKGGSASALYGSRGKNGAILITRKNASKEGLTITATTNNMVTAGFTVFPETQTEYGNGSNGQYEFWDGADGGISDGDMIWGPKFEPGVMVPQWNSPIRDKVTGEEIEWYGNVAGTVYDDKSRYERVPTPWVRHDNLKDFIRTGVVTKNDLSIAYQGEKAQFRFSANYAFQRGQVPNTSVNTGGFNFNSSFKLSEKLQLDATLSYNKVYSPNYPRYGYGPKNHMYTILVWMGDDVNGQDLKDHMYVPGLEGYRQANYNYAWYNNVYFAAYELNQVYNRNVVDGKLKLKYQFSPNFYVQGRVSARQKGLFEDMQSPKSYMNYGDSRNGDYKFWNNEQLNLDTDFLAAYSKDFNETIGISVNAGASTFYRSYKQDYSSSDGLIVPYVYSLNNTQGPVQATNYVEDKEIRSVYGSAGIDLWKSIFLNFTARNDWSSTLPKLNNSYFYPSASVSAIVSEFITMPKAIDFIKVYGSWSEVSSDLNPYSIYSTYNKGVTYGSIPSVNYPSSLVNSEIMPQKSTTFEAGLSTSFAQRRLSLEGTYYRILDENQIIDLNISEASGFNSRKVNGNEYTTHGFEVMLNYAAIKREKFSWNIGANWTKFTRSITDIYGGAEKYGNLKEGDRADSYYATVWQKSADGQLILDANTGMPTRDPFPTKIGHLDPSWRFGIQNQFNINKFRIAMDVDGAWGGLIRSLTIEKMWWGGKHPNSTLYRDEEYAAGQPIYVPDGVVVTGGELVRDVDGNIISDSREYTDNTTAVSWQTWSQNYPYRAQVTEDESEIFANVYDRSFLKLRRLSVTYDLMNVIPSKRFKNLDLTVYGYNLFVIKNLPYLDPDFGNDNNLQDPSSRYVGMTLKAVF

SEQ ID NO: 20163 - protein, 358 aa, Haemophilus ducreyi
MKKTLVALAVTAFAASASAVTVYDAEGTKVQVDGSLRLVLEQASSKTKYANGKTVKNKNAHSQLRNAGSRFGVRVNHDLGNDFYALGRLEIRFDKNNSDDQFGDLYAKRAYVGLGSKQYGEVTFGRQLTIADDYGQTDDYEYGIVPSYIATSGNQVIRYDYKGIEGLQIGANYNFAEKRNARGEVLVNELKNAYGLGAVYETQLGGNTFNVEGGIGRSNYATGTNHKHYQDGYELALGYAIGDFKLVSDFGYKYEKNGAARTKAFFVAPGFQYQVIPASRIYGNYLYERAETTVDEKDAAKAKKHGFLLGVDYQLHKQVVAFVEGKYVQSKDYIAGNGYKYTGKEIDKAIGVGMRVFW

SEQ ID NO: 20164 - protein, 719 aa, Haemophilus ducreyi
MTNALKHSAACSTLILLFTAPAWAQPQTSASARAEGEQQIHDKVIVTGEQIPYLRLSETATKTNLDLMDTPLSVTLLNKAFLEDLHSERLADAYPYTLGLSQSGTNANSFTLRGLSASLQNVQINGLPGLASRFGSPTSANIERVEVVKGPASVLYGLMEPGGLVNIVTKRPEEEASNTLTFTTRSYASETSGFGDDTGAGLTFDSTGSLTDDGKWLYRLIARVETQDTFRDGVSYDNVYLFPSLTYRVSPEAEATFGLEYVKEDGDADDGLAAVNNDIDQTAPINVRYQEDGDFDNDEGLVAFAHVNWDISAKTRLRLNLRSVFHEDERKLYENNRVNDAPDLEDATLRRRDRHQLNKREYHFVDLNISHAFDTGPAQHNLLAGLNGGFERADYERIRFGSAISPNISILDPAYGVGEPVAITAGTDRITDYLNYGAYIQDVAAITDWLTVMVGGRYDRQDVDFTEQTTDFTDDQMSDVFLPQGGIVIRPNDALSLYASYTESFNPNSVQRRDANGESFNPERGEQTEAGLKASLFDEQLNLTFAVFDIEKTNIVETNLNGDLQLLGGLESQGAEFELQALPLENWQVRFGYAYTDSVISQSPDEALIGRRNAFAPEHDAFFWTRYNLPRDVWNGTVGASVGVNYESDRVTNASPSTQVELPGYTRLDLGFYYEADQYRMALSMENIADETYYTGGTRDTRIFPGDPRLLILSLRAKL

SEQ ID NO: 20165 - protein, 430 aa, Haemophilus ducreyi
MPSTHPQAVQPARFSRLTPTALASAATLAGFAPLSQAAFIEDSSATFETRNMYFNRDFRDGTSAQQSKRDEWAQGFMLNLQSGYTEGTVGFGLDALGMLGVKLDSSPDRTGTGLLPTHDDGRAANEYSKLGLTGKVKISATELKIGSLIPELPILKPNDGRILPQTFEGGLLTSREIKNLTFTGGRLDKAKDRDDSNYEDIRLNNKNSRFAGTVAGKHFNFGGLDYKFTDKITGSYHFAQLDDVYNQHFLGLVASQPMGPGTFGSDLRLAISDDQGQARGGKIDNKSLNGLVSYALNGHKLSAGYQHMSGDSAFPYVDGSDPYLVNFVQINDFAGAEERSWQARYDFDFAKLGVPGLSFMTRYLSGDNIALKNGDTGKEWERNTEVKYVVQSGTFKDVAVRLRNATYRSNYSARDADEVRLLVSYSLALW

SEQ ID NO: 20166 - protein, 741 aa, Haemophilus ducreyi
MLACAPALADPAKPDTKATAKPAPRKALPAPELIEASGIRRAFTHASAQHLPDSDTRVSAERLTERGVVDLRGLEYVAPNLTVQSINGTASTNFYLRGLGFNDFTQNNMGPVVTYVDDVAYPYSTMASGLMFDMADVTVTPGPVGTEHGQSTTGGEVKLRTNDPTDSFHFGASQDMASYARSRSEAYVSGPIARGFSFRVAAQVNQGGGWQTDPLNGAHLGDADSWALRAKLKWTPDSRTTVLLSGHVVRDESEVVGGVPIARLIGSTPIPAVGWTQTEWSAKNAFTNLIGRNAGLKPSEDNWFWGADLHVAHDFGPVTLTSVSAFETEREGEYTDQDATAAAQADAYRTIAANSFTQELRLSNTNAQDRLQWVLGAYYQRSRMNQSFYFDYTDYLPARGYMQDSSFGLNQEATSEFGHVSYRLPGNVTLFTGLLHEIDDRAITGLTSRIYGGRTLDFHGESTAAAQFAGQVGVSWQATKSVLLYYKMSKGFKPGGFTANNTQVQAQLAPFKPESVLTYELGLKSDPIPNVLRINAAAFYNDFHNQQILGTILIPDYGPLSQLTNVPKSESWGFEGTIDLHPLRHVFVTQNFGWQRGTFQDFPTVNRAKTNAYYAQHGVWKAINDNFSGVDNGQPKLTLNGQLDWRQAVNPRYAVEFGPNWVYRGAQAMTPGGTGFYRLPPYFLLGAHVTLRPASDRWQVTLYASNILNRQYYTSGGQATTTYLYIPGAPRFIGGRVSCNL

SEQ ID NO: 20167 - protein, 814 aa, Chlamydia pneumoniae
MVITFNLFSVKHSMRARPSAATRALHSSSRPRRLIPALLGALACLGTGVQAAPIDVDIPPQNLAQALHQLGRQANLQVLYSQDLVDGQRSPAVQGRMEPAEALERLLKGRNIRYSIQHNTVTLTPMPLTATLPAISVVGALPDSDTYVATGTTAGTKTDTPLIEIPQSISVVTAAQIREQNPQTLGDAVRYTPGIVVQEGFNRTDDPFIIRGFDVRTNPGVMFRDGLKIPLPHYSAMSEPYALERIEVVKGPASVLYGQASPGGIVNVVSKRPTDSPLRELQLSGGSHSNRQLAGDFGGRIDDEGRLTYRLTGLARNADTMIDHVPDDRYYLAPALTWRISPDTSLTLLASYMKNKTINNAGYPLEGTVKYNPNGRIPRHRFTGEPDWSKWDQEVANVGYQFAHRFNDTWQFKQNLGYAQSRNRVNHAYWWTWVPGSDFSTAERGAYRRDDDAHGVSIDNQFEATWQSGRFRHNTLSGLDYTETSFTRKQYAGYNNLAPIDFFDPAYGSDVLLPAKPDTYTNEKRSQLGLYLQDQIKFDDKLVVVLSGRYDNADGSTLNKLSGVNTRTGDNAFTWRTGLLYLADNGLAPYISYSTSFQPQAGTTSPARGTTPFDPTKGKQWEAGVKYQPNGSNLFITASVFELTRTNVPTTDPANPVYSVQEGEVRSRGLELSATANLASGWNLIAAYTYTDAEITKSNSNTLGNTPEAVPRNMASLWSDYTVPSGALAGLNIGAGVRYMGSTYNNTNAAKVGDYTVFDAAVRYDFGARSPSLKGWTADLTVRNLFDKDYVASCTYACFYGEGRTVLGRVTYKW

SEQ ID NO: 20168 - protein, 761 aa, Chlamydia pneumoniae
MGIHYKSALLSGSSISLLLLTGIAAAQEASSSNQDLDEVVVYGSTVAEDALAPTLGYVPTETASAGRIGLPIEETPRSVSVVSSQQMEDQGAESIVDAISYSAGVVPAIYGFDLRYDNYAIRGFESAVGGLNYRDGLPLRIFAWGGWNIEPFGVERVEVLRGPSSDLFGANQPGGLVNTVTKRPQEEFSAVLQATYGNNNRKQLAADVTGSLSEDSPISYRIVGVGRLSDTQVDDVHDDRLYIAPSVTAKLGDKTKLTLLAQYQKDFQGESWQILPQHGTLLSNSQGSFDYDTFAGDPDRNGLERDQHYVGYELDHQFDNGLELYQRARIAYNKITYDGAYNGGAVDFDTLLAGGAPQVSGVDTAILVKNEVEETGYQGSIDTALKYDATFGSVETQFIAGLDYYKGYSEADLGSGYAGEKNLFTGEITNLLPTLPGVNPALLKDYTGFSDQSVTQTGLYAAANSKIFDKFRLDLNIRHDWLDRDVKGERPEPGSSPAREQTFDRALTGRIGVSYVSDYGITPFASFGTSFDAPPAGMTKEGKAFKPTHAEQFEVGVKYAPTNFDGFFSVAGFQITKDNVLTNDPNNTGPLPASLQAGEVRVRGIEFEGAIELYSGLSALGNYTYLDTEVTKDTTASLVGNQLERIPEHAGSLWLKYNFAEDTWLKGLSVAAGARYLGERFGDNENAIKLDAVTLFDAALSYEYRNLKLSFTGRNLADKSFISHCGKASLASLVPAALNVDSHNCTYGKGRELRLQLTSTF

SEQ ID NO: 20169 - protein, 868 aa, Blochmannia floridanus
MIHFEGQKHRRRTWLFAVASVGPCLWAAQVLAIPVVPIAAGQTVAAPGRVQQLLGLWKGSASDLTGDSLPWDIAPPAPQTHLGQAPPQPSADTQTSQAPATAAEDASGDILDEVSVTATRRPTRERDTTATTYTVTKEDFRRLGALTVTDALVQVPGFQSLPALGGVRNSGNSYLRGFDDQRFQLLRDGISLQRSSNNRVDISRISLEDIERVEVVTGGATLRYGAGAAGGVINLISETPKGPPKLTLKYEAGSYGFSRYVGKYGGGDDTFSYNLVYTGLVAFNNFPYSLTIPNTAQFYERDAVAPNGQSLFGYLKPELGPAVTLSGINDTGYNASDSYSGKLVFRPDPANRLTLRLNQQNSKNEAFGPGRSAFGLCRGGTSVQPNGTTSGRRFLPLDANGNELPCDTQAFIFNTPTAAFSGRYNFDANAAGTVAIPTGQSYLIEPLTGTTNFFQRFLQAQTEATVFWDYDITPTTSLNSYLSLVRLLTITEQPSPFFYDTNARGTGTPGALTVPPPAQPFIDNQRYEAQIALNSQISPGQNLSFGINFLEDRSYQQQQSKGAQTFFDRAISRLSLFLIDDISFSNELKANLGLRLTNSSQFGSVLTPAAGVRYSPNNVLSLRANYSYIFNAPALSNLFATGSNILANPGLRPESGVTYDVGFDLTPARNLGLRFTYFNSYLDGAIGGVSLANPNPATAAAIPLVLQAQNLDTRQASGIEAVADWRPTEQLRLQAIWTNSDVRAAGNADNPSQSTYPFYYQFQDPGIPFNSVLLSASYVHQGWLVALVGRYDGGKRRATTASGVVSRGSNEYVPAWATLDLNVEIPLVPLFTLTGSVFNLTDTQYESLSGIPAPGTTFRIGGRLELGG

SEQ ID NO: 20170 - protein, 376 aa, Blochmannia floridanus
MKLRVLSLMVPALLVAGTAGAAEIYNKDGNKLDLYGKVDGLHYFSSNNGVDGDQSYMRFGLRGETQISDQLTGYGQWEYQANLNHAENQDNKNFTRYGFAGLKFGDYGSFDYGRNTGVLYDVAAYTDLQPEFDGMTYGADQFMFQRSSGLATYRNNDFFGLVDGLNFALQYQGKNGNGEETNNGRDVLGQNGEGYGMSMSYDMGYGISAAGAFFNSRRTSEQNGANGHQNIMGRGDKAEGYSGGLKYDANDVYLAVMFTQSYNAARFGSSDSSVYGYANKAQSFEAYAHYQFDFGLRPFVGYNQTKGKDLGRAGNGKDYGDQDLVKFVDLGATYFFNKNMSTYVDYKINLVDNNDFTDAAGINTDNVVAVGLVYQF

SEQ ID NO: 20171 - protein, 808 aa, Bordetella pertussis
MGSFRHPFFNPKPLVLAIHMATFSIATLPLVAHAAATQVNIPAGHLAQVLNRYALEQGVNFIFDSTLFLDIKSQGIQGAYEIDDGFAELLKNTNYQIKQTSNGYRLEEKPVNSKKEQIVKLTPLQSKANQSGYSGLGTSSGSILPTITLEAENHDTPLKRINTVGVLGNKSVIDTPYSITTKTAEEIETRQTNSLGKIFVGDPSIVTEVNSYSSGWSTPVSIRGLKLDETNGYKVNGYSVSAWGGEFPVELAQNVMALKGLSGLMYGFATPGGVINYQTKQPTEENLLSTKIGYRSAGILSAQLDTGGRIGEDKQFGYRFNIVKEKGETYNGSDADNLATALALDYRILPNLVWKGEIIYQDRHLDNEASMFSWWGFQGNKLPKPIDGSDKHIVKGAFYTIHTALAQTGLYWEVNDNWKAEITQARIRNRNTVNKAFAYILNQQGDYSINMYQLGGESIRDISQFMVTGLFDTGFVNHELILGSSFEKKQAHDANSNWDANTDVGNIYQSQTTYYNNSMSFTSAFSSNIYQKQVFLSDTLSFNDHWQAIIAGRYINYNNQANIYQKEVVTPTYALIYKPIEDWSLYASYSEALEEGQKVTSSTGKEYANAEQYLDPTISKQYEIGTKYQQDRWHVSAALYRLERMAIIDEMINGQLNLTQNGETIYQGFELMGGYKFTPDLTINAGINLNDPSIEKVSEVNASIKGNRPAGASKIQAVVQADWNIPYIDGLSVHGDVRHYGDTWYDDENTIKFDDYTLVNIGGGYQTRISKKPVTFRADINNLLNKKYWMNSGAGEPVTFVLSAKVDW

SEQ ID NO: 20172 - protein, 249 aa, Bordetella pertussis
MSSPQKTFSSLLFSSLLFSSAAQAASEDGSRSPYYVQADLAYAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKT

SEQ ID NO: 20173 - protein, 238 aa, Bordetella pertussis
MRFYRPLGRISALTFDLDDTLYDNRPVILRTEREALTFVQNYHPALRSFQNEDLQRLRQAVREAEPEIYHDVTRWRFRSIEQAMLDAGLSAEEASAGAHAAMINFAKWRSRIDVPQQTHDTLKQLAKKWPLVAITNGNAQPELFGLGDYFEFVLRAGPHGRSKPFSDMYFLAAEKLNVPIGEILHVGDDLTTDVGGAIRSGMQACWIRPENGDLMQTWDSRLLPHLEISRLASLTSLI

SEQ ID NO: 20174 - protein, 411 aa, Bordetella pertussis
MYTLNNVDIDTFRAISSEDFYSKVVGLDKNHVYFGNIAIPDLDPNKFYIIGNGYYSDGTNTYYCSPVSEKNKDLSIISELFQITINVFSKNKKPLIYIYPYKKVETDKKLRAVKNMFSFATDGKKVYYNGEILENADLNTLKSVDGYTEYFVDKENVYYKTRLLPIKNSGELKIVSTKQGNKVLYDEANGYVFIEDYSFDREKAPYKVLGNGGNHLYDLFFIAKDGIYFYNTQKKKQERIGDNIFSGNIEELTPNIFTDDKNIYYFDTYDVWFKGKNTGHILTSKNTIIYYLDKKDNWEKVSDISDETIVGTIWKKGNDYYYFDEFYMKNTIYQIADKETLDYLLNANNINHDNMVNLVENKKLIVVNGEEKIRATTELNGVYRFVIKYSKIFLFILIAIGGIFRLYKKNK

SEQ ID NO: 20175 - protein, 724 aa, Bordetella pertussis
MPRPTSRRTRPARRQAQPAFVPALFMLALGAVAAGARAQPAAAGVPDTQGVAQMPAVTVNAAPVDDTLEHLEAPVDTGALGRRTQLETPFSTTVVTARDMEERQVNKLGDVFALDASVTDNSASYGAWASYLTVRGLPLDWQNSYRIDGRPFLSYVTTLPFEHFEQIDLLKGASGFMYGFGSPGGLVNYVTKKPTDEAVRSVELGYVSKGLLREHVDLGGRVGESGAFGYRLNATHEEGNTYNGGSLYRDSVSLALDARLSDRLTWDFQSIYQDRKAIGQEPTIYAGTMAGSELPSPVRNDNDRLVGQGPYADNAFRYYSTGLKYQLADEWTLSTNYSYSSTRTRRNESVLFLRDQAGDYDDYRSDYGEAYGYNQWQAMLEGKFATGPLKHHVVAGASWQKQKNDYSANGVYQLQGTGNLRARNTNTYYSEGQLHLYRAAEITQKALFASDTVDLTGVWSVLGGLRYTNYAQQGFDATGARTSRYDKNGVLMPTFALMYKLTPRTMAYASYIESLEPGSSVGATYANFGALLDPLKSKQYELGIKTEQDGWAATAALFRIEKKAEYANAANELVQDGKTLYQGLELGASTRIARDWNVGGSLMLLDSEYKKGSDFTGNRVAGAPKFVAAAQLAYSVPQVPGLKLRADVKYTGNTMLGASNRVQVDDYAIVNIGATYDTQIHGYEATFTAGINNVANKRYWLYQSSDYVKAGDPRTYGLTASLKF

SEQ ID NO: 20176 - protein, 629 aa, Bordetella pertussis
MKSRSLRRCAGVLACAAPLAGHAQAGAAAGQPIPELDPVVVTAARSPQLLRNVLADASVIERDTLARAGQSSLAEVLAQQHGIEFADSGGPQSVTSLFMRGANSNQTLVLLNGQRINNANGGGIALNALPPQAIERIEIVRGAASSLYGADAIGGVINIITREPGDKALSAYANAGYGTYGTSRYDAGVSGAADGFSYSLSTGYGQSHGFNATNRRSFSYNPDKDSYYQNYATGTLGYEWRPEQKVVAQVYRSRINGGYDASASYDYNDRYIQDLQAYSLASENRLTRYWKSTLRAGYVEDKNDSRAEGMFEDNNTRFRTRQMQYLWQNDFTLAAGQTLTLAYEHLDQRADGQMSTPTGIGNYTETRRHVNSYTGVYLGDFGRHHVQASLRNDDNSQFGSHTTGGLAYGFDLTPNLRATVAANTGFRAPSFNDLYTPTSAFGYRGNPDLKPEESRNAEIGLKYQDEDSELGVVYYQTRIKNLIQVTEDFSTVENVGRARLQGFTISGAHRFGNTRLRASLDLSNPRNEDTGKQLLRRARTVLRAGIDHRFDRLLVGAEWYASDERYDYGFPEEKRLGGYGLVNLTAAYDLSRNMQVQVRWNNVLGQRYTLADGYNTAGSNAFVNLSWRM

SEQ ID NO: 20177 - protein, 201 aa, Bordetella pertussis
MICWRAIEGIEGAMMKQQGKHSYSVAAGLVALACVISGPVSANDDPLLPGYVGVQYNLLDQQISAGDDAQPRSVQAVWGWQYNTLLALEARLGYGVSDDEGGLDTARVSVDPQWLVGGYLKMGLSYRLPLSPYVLLGHSSVKRDITVAGGDTEEDVASDPSYGMGASIKLNERNALTVEWLQLEDDDNDLTTVNVGYLFRY

SEQ ID NO: 20178 - protein, 182 aa, Bordetella pertussis
MTQYFRALAFFLLLVPATAMACDGWPSWARGACQRVDQIWNEGGNDLYLTGYSWHNRAMYSSDKIRSFNELAWGGGLGKSIYDEDGDWQGLYAMAFLDSHSDIEPIAGYGFQKIGRIGADTRLGIGYTVFLTSRSDIMSRVPFPGILPLVSAGYRDATLYATYIPGGKGNGNVLFMFGRWEF

SEQ ID NO: 20179 - protein, 732 aa, Bordetella pertussis
MKQTSLYYAALGLAGLALAAPARAQEQQVPAQLETVVVHGAPEANGPLDLDAVDSTGSRLGLTLRETPASVTVINREQIEARGALDTQEIARGIVGVDNASPPGSAGSVSYRGFSGSQVSQLFNGISVQYDVIAARPIDSWIYDRVEAIGGPSSFLFGAGAVGGAINYVTKVAQRDTFYDGQLRLGSYGARQASVGLNRQLAGEPGGRGQYLRIDANANASDGWVDGNRSHAEQVAASLLSDLGERVTHTLALEYQHETVHRPYWGTPLTTDGDGVVRGEGHIRGGTRFKNYNVDDGQYEQSVWWLRSLTEWQASDRLSFRNTLYYYRADRDFQNLETYRYNLGNSQVLRSGALLQRHEQRLLGNRIEALYHGSLGGLRSDWSFGADYSVNRQTRYPTSVAGQVDSVDPYEFDPGEFYDIPGMRRGHVPDRDNKVRTLAFMLENRTEVGGGVALVTALRHDIIDLDLTNRRAASAASPGHASRRYNPTTGRVAVNWEVSPGATLYAQYATAADPPSGVLSTATFADVLNNDKLTTGTQVEAGGKFAFWDGRGTATVAVYEIKRKNLATPDPLNPGSSLPVGSQSARGLELAGGLQLTRALSLQANLALVDPRYDDFSQNVGGVAVSRNGKVPVNTPRRLANVWLDYAFAPDWRASLAARHVGKTYADAANTVWAPAYTVFDAALSHRIDRHFSVTARVRNLTDKVYAASVTGAPMYYLGAPRSVELALQARF

SEQ ID NO: 20180 - protein, 735 aa, Bordetella pertussis
MSTPRFALHYASASVLLAASGLAMAQTATQIHDPSQVQQMATVQVLGTAEEEIKESLGVSVITAEEIARRPPTNDLSDLIRREPGVNLTGNSASGARGNSRQVDIRGMGPENTLILIDGKPVTSRNAVRYGWNGDRDTRGDTNWVPAEEVERIEVIRGPAAARYGSGAMGGVVNIITKRPADRATGSITYYTNQPEDSREGNTNRVNARISAPISDTLSMRLYGNYNKTNPDARDINAGHANTSDNGNPSTAGREGVINQDLSALFSWKADSHNTVDLDMGFSRQGNLFAGDTMNNANSDFSDSLYGKETNAMYRENYALTHRGVYDWGTSRASVGYDYTRNARQREGLAGGPEGAPTAGGYDTARLKNWRAAAEASVPFHLGFEQVATVGVEWLRESLEDPAGTRQTYTGGAIGGTAPADRDPKSRQTSYALFAEDNIEIDERTMLTPGVRLDHNSEFGSNWSPSLNASYAVTDALKGGIARAYKAPNLYQSNPNYLLYSRGNGCLASQTNTNGCYLVGNEDLSPETSVNKEIGFEYDPGTWRTSMAYFRNDYRNKIVAGTDVQYRLANGARVLQWTNSGKAVVEGLEGNLFIPLASNLDWNTNFTYMIQSKEKATGEPLSVIPEYTINSTLDWFYTPQLSFQANLTYYGKQEGPSTNVRTGVELNGDGRQTISPYALAGLSMGYEVNRNLKFRVGVSNLFDKQLYREGNASSAGAATYNEPGRAYYATATVSF

SEQ ID NO: 20181 - protein, 606 aa, Bordetella pertussis
MKKTLLAVALAPLCLPSQVFAADESSNDVMVVTANRFEQPIKNVIAPISVVTKEEIDAIQAKSIAEVLRRLPGVQVVSGGYGQATEVYVRGTTSRHLLVMINGVRIGSATLGSADFSQIPLTGIERIELIRGSRAALYGSDAIGGVLNIITAYQPGESVAEVTAGGGSDGFYQLGGSVAGGLGESGWGKIALKTEGADGFSARKEPFEQDDDGFKNSNVVAEVGTHVGDHWKLSLQGYYHDGESDYDDSYGAPHAQSESSLFNIAAKAGYSNDKLDSQFTVAQNQDENRNFNDVSSGSKIKTERTVANWQNHYQLTDGLELGGGLEWYRDSVSNTGTQYAEDERDNTAVYLTSIYRISDWQFEGSVRTDDNDSYGTNNTWQLATAYNITSELKVSANAGTGFKAPTFNDLYWPDSGNPNLKPEESKNYEISLSGTHQLLDWSITGYQSEIDQLIAWAPKDASNPSGDWIPMNVDEAEIQGIELTAGFATGMLYHDVSYDYLDAKDKGLDKQLIRRSKDSAKWNVSYLAEQWQLDVSAIYKGTSYDDAANTKKLDAYTLVDIAASYFVTDNLSVRGRIANLFDKDYVAKETYNVQERSYYATATYKF

SEQ ID NO: 20182 - protein, 472 aa, Bordetella pertussis
MNDPQDLSTPPVEHDLHIFRSNCICAESGIRLGSNCEFAAPIDDLPTEGTLFSLPVNVHGQTTYINQRYNNFTSSYSGMNGLSAQKSMAYTWSGTLFFGARLAPNTDVYFNPEVISGVPFSGLTGLGGFSNGEANKSAGLNAKFYSARAFLRQTINQDGDKVLLENEANQIMQTVSSNRVVITAGQFSTLDIFDDSRYAKDPRIQFMNWGNMTYLAYDYAADARGYSTGLAGEWYLDNWVMRASRMLAPKNPNGRDLNWQMFNAYGDQFEVERQHHIADLPGKVSVLAYRNKMILARFSDATSFVIANNAQGTQAINNVRTNYQYKTGIGINGEQALTKDLGIYGRAFASDGHTETMSFTEADNSVSVGMGLSGTSWSRPKDTVGISMMQNGLSSYRKNYLQSGGVSYFIGDYAGPGRTISYRPERIGELYYNATVIKNVLAGLNYQHINNPAYNAARGPVNILSFRIHAEF

SEQ ID NO: 20183 - protein, 438 aa, Bordetella pertussis
MKPLHYTASALALGLALMGNAQAVTTIPFWHSMEGELGKEVDSLAQRFNAENPDYKIVPTYKGNYEQNLSAGIAAFRTGNAPAILQVYEVGTATMMASKAIKPVYDVFKEAGIQFDESQFVPTVSGYYSDSKTGHLLSQPFNSSTPVLYYNKDAFKKAGLDPEQPPKTWQDLADYAAKLKASGMKCGYASGWQGWIQLENFSAWNGLPFASKNNGFDGTDAVLEFNKPEQVKHIAMLEEMNKKGDFSYVGRKDESTEKFYNGDCAMTTASSGSLANIREYAKFNYGVGMMPYDADAKDAPQNAIIGGASLWVMQGKDKETYTGVAKFLDFLAKPENAAEWHQKTGYLPITKAAYDLTREQGFYEKNPGADTATRQMLNKPPLPFTKGLRLGNMPQIRVIVDEELESVWTGKKTPQQALDTAVERGNQLLRRFEKSTKS

SEQ ID NO: 20184 - protein, 698 aa, Bordetella pertussis
MHTRIKNLFLISLFFSIFIYSQDIEEIIVKGEYREKSISEEDSSILIIQSEKINSQAIKHFQQLSYLVPNLNYAASDSRARYFQIRGIGERSGYQGTPNSSVGFLIDDIDYSGQGGIATLFDVDQVEVFRGPQGSRTGANSLAGLIYIKTKDPTDQFEGLSEITIGDYGTQNLGIAFGGPTKNKKVKYRLVVRNDYADGFRKNIFLNQSDTSQKDELTIRYKLNWDINETTDVNFLLSRVDMDDPADIWTIDGSLNTLSDRPGMDSQETDSFGIKLLKHFDHFDLQSFTSITKTDVIFSYDADWGNPESHFPYIYDYFSETFRKRDTFSQEIRFLSKNTNFSKENPFEWIFGFHLSELEETNLTRDDGIYGDPSDPFGPYVSESIIFRNYEAENFSLFGNIDYFLADNLKLAFGLRWENWNSKYNDSNKEFFNPSDNMNGGKISLIKYIDKSNIYFSIARGYKQGGFNLGLDATDNSIRDSLIFDPEFLTNYEIGFTSNNNNSNINYSAVLFYSKREDQQVLISKQVDPTDPNTFSYLTQNAAEGENFGLELSSNYFVSDNLNLYANVGLLRTKIKNWESRPDLENRSQAHAPERTYAVGINLNLKNNFYLKMDITGKSSFYYSDSHNNKSKSYQLANLLIGYSNKKLSADIWARNLFDEYYSTRGFFFGNEAPNFEDTLYRRQGDPRNIGLSLRYNF

SEQ ID NO: 20185 - protein, 1013 aa, Bordetella pertussis
MSKNTTGRVRGLQYGVSGGALALAMAFAGAASAQTAPAPASDEIEAVVVTGFRASLANALDVKRRENDLVDVIKAQDIADFPDLNLAESLQRVPGVSIDRDGGEGRTITVRGLGPDFTVVRLNGLEALATTGGKDGSGGANRGRQFDFSIFASELFNSVTVRKSTSAMNEEGSLGAIVDLQAGRPFDFSKFTMSASAKVGYNDLSRKNDPRYTFLVSNRWDTGIGEIGALLSVAYATRAQREEGSSTGRWENPSVRFNSATAFPCFGAAYNPVTAGAATGGATAATSAACSTIGTVTGGTAPTVTAAAGTANNLWHPRIPRYGRLDYDQERLGVTGSLQWRPTDRSTLTLDMMLAKFQNNRDETYLEIISFARSGAGLPQTDVVNFTADSKGTLIKGTFDDVDVRTEYRHDTLKTEFNQFALTYDTRFGEGGNLKVGYGQSRSIQDNPDQTTFSFERYDSDNYSYDYSANDKLPSFNYGFDATNPANYVYSSSNTLGDASLLRMRPSKAVNTFKTIFADVDYQILDGFKLRYGAKYKEYGFTSWEKRLNSRVLAGNPATTFTSEAAFGLPPGVTVADVSRVISGFGRGLDIPAGVPTSWLAPDLDKLRQKLGYDCNCVNANGDFRLSVQNQLGAMRAITEKDTAFYIQGDFDYDIFNIPVRGNFGVRYVKTEQEATGNYSTGFTTQTVTTLGGTFSQRVPIAMSQTVKRQYTNTLPSLNISAQPFDSFFVRFAAAKVMTRPQLPNLSPGFSAMSQQAQTLTRGNPELNPMLANNMDLSFEWYPDKETLFSVGFFQKDIKSYIQTSSVAVPWADTELPDNLLANGNTADTLFTVTTQINTPGGKLKGFEVSLQRPFTFLPAPFDGFGGIVNYTHVQSDIQYVIANPVYAGTPRALVTPAVMLTQPLVNLSPDAYNATLYYEKNDFKARISASYRDPYLIQVAPSATNNNDVRIKEKTLNIDSQVSYNFKNFTVTLEMINLTDEKDSKLNDSTRMISEEYVHYGRQYYLGVKWKF

SEQ ID NO: 20186 - protein, 1039 aa, Bordetella pertussis
MPAQRTPRTAVCEATVRSSPRWIHCTGFVLCALLAACGGGGGGGGGGGGGGSPGGRAPSAPQPAPSPRPEPAPEPAPNPAPRPAPQPPAPAPGAPRPPAPPPEAPPPVMPPPAVPPQLPEVPAADLPRVRAPLSTYRRPQRTDFVTPTGGPFFAKQDKALNTIDLKMAHDLKLRGYRVKVAVVDEGVRSDHPLLNVEKKYGGDYMADGTRTYPDPKRQGRHGTSVALVLAGQDTDTYRGGVAPNADLYSANIGTRAGHVSDEAAFHAWNDLLGHGIKIFNNSFATEGPEGEQRVKEDRNEYHSAANKQNTYIGRLDRLVRDGALLIFAAGNGRPSGRAYSEVGSVGRTPRVEPHLQRGLIVVTAVDENGRLETWANRCGQAQQWCLAAPSTAYLPGLDKDNPDSIHVEQGTSLSAPLVTGAAVLVQDRFRWMDNDNLRTTLLTTAQDKGPYGVDPQYGWGVLDVGRAVQGPAQFAFGDFVARVTDTSTFGNDISGAGGLVVDGPGALVLAGSNTYAGRTTIKRGTLDVFGSVTSAVTVEPGGTLTGIGTVGTVTNQGTVVNKEAGLHVKGDYSQTAQGLLVTDIGSLLDVSGRASLAGRLHVDDIRPGYVGGDGKSVPVIKAGAVSGVFATLTRSPGLLLNARLDYRPQAVYLTMRRAERVHAAAQRGADDGRRASVLAVAERLDAAMRELDALPESQRDAAAPAAAIGRIQRVQSRKVLQDNLYSLAGATYANAAAVNTLEQNRWMDRLENHLAQAGGERVAAIAEYRHGQLRWRPDGLQGRQRGNGIMLGLAREVSAGLSLAAALTHSRTHWDESSGAPARDNAAMTTPGVLLGARRAWEDGWFVQGALGYSRYRNQATRHISLGDAGHTVGATARGHVWQADAGLGRQWTLAPGHTLAPRAGLQLTHLRQQGFSESGAQGLGLRAHALTRTVPTLWAQLQSRHAFMLGATPMTAQLQLGVWHDLRARRYAASGGFAGLAQDQGASGYWPVPRTRVQGALGLRAEFAPGLVLGLGYTGQLATHWVDHQLSASLTYRY

SEQ ID NO: 20187 - protein, 628 aa, Bordetella pertussis
MRSARDGGGRHSERDTSPARDYSRGGGASRGERDLVLGRTTLALAAVTWLSASAAWADEPMAQIQGVEDRALRDAIQRALSDSKQPPRSRSEARRRARQAGEDAIAVLRAEGYYAYTVEPDVTEGDPPRAIVRITPGPAFLLADPHIDWSGSPPDEGVRQRAVAAMRLTEGEPGRSADVVGAEGRIVAQVAKLGYADVAAEPREVVVDHADRTVRPTFRIMAGELVRLNGVDVVTKGRTNPEWVGRLAPWVAGDVYDPEDVAELERRLRDTAVYDSISVSLAGTDKASAEGYRPVVVTLSDRRARTIELGAGYSTSEGAGVDARWIRYNRQKRADTTTYALRFAKLEQRLGAEISLPHWRRPQQTLKLNSSVFRNDTDAYNETGATVGVDLTRRRQTTAYRTFGVSFDLSQTKEQVNRNGLIAGRKLNLATLAGLAAYAWDFSDDILDPKRGWRLETRAEPTYVAGDTSVPYLKLAGQGSAYLPFGKQDSTVLAARVKLGAILGAGLLDVPASRRFFSGGGGSVRGYAYQAIGPRLSDNTPQGGISLVETSFEVRQKITDRWSGVAFVDAGAIGTHETPQREDFRAGAGLGVRYDLGFGPIRADIAAPLGRRKGDPKFQIYLSIGQSF

SEQ ID NO: 20188 - protein, 834 aa, Bordetella pertussis
MFSRSQKHPSWRLSPCVLAAALCAVAVGSADTARAQAPAASAQHYEIAAGPLADALTRFARRAGVVLSFDPALVQGRSTAGLQGVYGVRDGFAALLAGSGLQARAGGGNNWSLAALPRGGDAQTLAPVTVLGLEGALAPTVGYVASASLSGTKTDTPLIETPQSISVVTRDQITEQGAQTLNQVLRYTAGVATETRGATATRLDQFSVRGFSAATYLDGMRVFGGRDALPQVDAYRLERVDVLKGPASVLYGQGGPGGVVNQVSKRPLDEPLREIEVQAGNFDFRRVNMDFSGPVDEDRRFLYRVTGAAYMSDGQVDHTRERRYFVSPSFTWRPSADTTLTVLTNFQRDPDMGSYGSISAMRTLLSAPDGRRLGPNHYDGDADFEKSDRRSYSLGYQLEHRFNDTFKASQNLRFQHAEGVYRSIYGASNNNYGYLDKDYRYSQRGLAISDVDVDAFTIDNNLQARFDTGALAHTVLVGFDYQRVQTDTLSGYGSAPPLDVFDPDYHMGIERPPFTSDQTQYNYQTGLYLQDQIRLDRLSLLLGGRYDWSRTHTGTDNLANGSHSSSALAAEAFTGRVGAIYNFDNGVAPYASYSESFEPQTGTGWNNTPFKPTEGKQYEVGVKYQPPGSATLLTLAAFDIRRKNLPTTDPDPTHMCGVSRCSIQAGEVRTRGIELEAKTEPLRGLSLIAAYSYLDNEYEKAYPNTTGLDLKGKKPVAVPAHQASAWARYQLQEGPLAGLGMGAGVRYIGSSYANETNTLKVPSVTLVDMMLDYDLGRASPALKGMQVALNVSNLFDKEYIGSCLSDSWCWYGYQRSIKASLLKRSEITTGERLR

SEQ ID NO: 20189 - protein, 1076 aa, Bordetella pertussis
MAQASARGMGLRITSLAAALLGVYGAAGAAENRLECIGACPPGQPVAGAHYSGTNLSANREWVVYGEGSNAVFTLQGGSVTASGGLMGAVNAADGARVDLNQVSVRTDAGNGWEAPGVRAEYGALVNVRGGSIATVGGGSYGVQSLDSGTMIELNGTDIRTTDAYSDGLRAEFGGSIRAVGLTINTTGEHAVGAMGADDGTIALRDSRITTSGVDAYGLGTESQVLSPGGVLQVSNTAIQTSGKNAHGVYLQGGSSLNMSGGSIRTTGSGAAGLRVSNGSSVALNGVEVVASGPSLLSTLSATRQQSIVVGAGSNLTRNDGRLLLVRRVAGGELGQVTLTLKSGSYAAGNIENLAADGSRESSALTIVDVQSGAQWAGLVIDDTTAIVNGSQSGQHSGFSTAGDMVLEGGSAPVTFTGVSNIGGSSSLGAGSQTTFGGATTIGQSLAVLPGGSVAFNGPLTIGESVTGGQGTALSFNAPAIIGANVQGAGGAAFTFSGPAQVGGSVQGLDGASFRFSTSAPTVIAGGLSLAGGSSLGGGSPTTPIVVTGGADAVSGAILGGNLDIGGALRMTGASLAPGNSIGTVTVGSVGALSGSTYLAEVNAKGQSDLLVVRSGNVDLAGVSLVVGQENGTGGYVLNHDYTIIKTEAGKIVGEFAAASLDESLASTLVKLDPVKYGAQATQVSLSPDADKLAAARAGLTRNQSAVLDGALSVAGRNASADAVMLMSDTGQRADALDQLSGEVHGSAVSALYSNTQLLNRTVARRMSANLGAGLLAGAPTAQAAGPAAASAMPGTAAYPLWADVVGNWSSFDAKDNAAKAKSNTAGLFIGGDAAVGAGWRVGGALGFTDGRIKADAVDSRSDVTSYTAALYGGNSWAAGKGKLNFLAGVGYTHHDIDSRRSVDVGGAQTLKADYKANTTQLFAELGYQVPVGASSSVEPYAGLAWFNNHSDSFDEDGGPAALHGSGQTDQITTFTLGLRGNTALQLGATEARLSAGLGWRHANGDVDATRKLAFIQGGGTAFTVAGSPVARDAAVLDLAAEVDVGRNAALGLAYGGQFGNGNKENTGSLYLKVRF

SEQ ID NO: 20190 - protein, 681 aa, Bordetella pertussis
MKSLAPRLSLAALAAMATSAASAVDQDAPFTLGEIRIAAPQDDKLATGSSVVEAADMRLRDRETVDKALALAPGVNVAYMGGRAEQVVFVRGFDRLQVPVFIDGVPTYVPYDGNIDLGRFTTYDLSRIEVAKGFSSLLYGPNTLGGAINLVTRRPTQAFEGEVGGGLELTDHGNVNAYRSYVNAGSNQGNWWMQGGVSYVDYDYTLLPDDFRPTNNQQGEGRRENSEKRDGKFSFKLGLTPNDTDEYVLGYVQQQGRKGQPPYAGDLPATGQRKRWWEWPTWDKTSLFLATSTRFGEHGLKTRVYHDTFKNSLESFVYNNGIVGPLQAGFPSKYDDESSGFSIEGDLAVTASNRLGIAYHFKEDVHRSRDGGDPWTHFRDQTQSLALEDTWKLDDVFSVVGGVSYNYRKSLDAENFGTSSASPRVKTLYDEPTGSDDAVNAQLGLFMNTGPLLHVDHDGQVRLTVARKSRFATIKDRYSTRFGTVIPSPDLKSERATHYELGYAGSLGSLWSVDAALFVSEIEDSIQQVTVAPQPGCAAPCGQYQNIAKARNQGVELGLKGDIGDWQLNASYTYLDRKNRSNPDIHPVDTPRHNLFASATWNQGAWRHTGSVESASRRYSASDGTQVADGFAVYNLKTGYTFANDLRVEAGVRNLFDRLYEYSEGYPEMGRNYFVQFNVPL

SEQ ID NO: 20191 - protein, 736 aa, Bordetella pertussis
MSLHPNRRAKLRFARSAPVTPYRLSLTTLVLSLQAGGVFAQSGDSPAPAAPAAAAAAELPAVTVRASSDDETATGPVHGFVAKRSATATKTDTPVMETPQSITVITRDRMEAQGAQTVQQAIGYSAGVYAGPFGNDARGDWGRFRGTEFTQYRDGLLNQVGFYNNVRPDVYALERIDVLRGPSSMLFGQGAVGGILNLVSKRPQAEAAREIGVQFGNYNRKQVQADLTGPLDADGKWLYRLVALARDSDTQVDYVQDNRYLLAPSLTWRPTQDTSLTLLANFQRDVSGTSVGFFPWRGTLYPNPGGQIPDHLFISEPGFDRYTAEQQSVGYEFQHKFNDTVTVRQNLRYSHSSVDYRSIYARFNDANRGWVPGSNTLMNRTVYVNQPTLNSFAVDTQAQTNFRTGPVQHTLLTGVDYQHAEITGTTGVGGSAAPLDVFNPVYGNFTPPGTRSLNPATQAQTGLYVQDQLAWNKWLLMLGLRYDWSRAAQDNTPSASRDDSELTKRAGLMYRSDIGLNPYVSYSESFQGLAGFNKANQAFKPLRGSQWEAGIKYQPPGKNATLTIAAFDMREKNRKTAGVVNGIPDSVQVGEARTRGIEVEALASLTNRLDLIATYTYLDARVIDGTPAEVGKKLASTPSNMASLWANYRFKLFGIPGFVAGGGLRYVGPSYDGNDQNRVGGVTLYDAMIAYDHGPLRVALNANNLFDKQFLTTCLARGDCYFGARRTVVGTVTYRF

SEQ ID NO: 20192 - protein, 814 aa, Bordetella pertussis
MVITFNLFSVKHSMRARPSAATRALHSSSRPRRLIPALLGALACLGTGVQAAPIDVDIPPQNLAQALHQLGRQANLQVLYSQDLVDGQRSPAVQGRMEPAEALERLLKGRNIRYSIQHNTVTLTPMPLTATLPAISVVGALPDSDTYVATGTTAGTKTDTPLIEIPQSISVVTAAQIREQNPQTLGDAVRYTPGIVVQEGFNRTDDPFIIRGFDVRTNPGVMFRDGLKIPLPHYSAMSEPYALERIEVVKGPASVLYGQASPGGIVNVVSKRPTDSPLRELQLSGGSHSNRQLAGDFGGRIDDEGRLTYRLTGLARNADTMIDHVPDDRYYLAPALTWRISPDTSLTLLASYMKNKTINNAGYPLEGTVKYNPNGRIPRHRFTGEPDWSKWDQEVANVGYQFAHRFNDTWQFKQNLGYAQSRNRVNHAYWWTWVPGSDFSTAERGAYRRDDDAHGVSIDNQFEATWQSGRFRHNTLFGLDYTETSFTRKQYAGYNNLAPIDFFDPAYGSDVLLPAKPDTYTNEKRSQLGLYLQDQIKFDDKLVVVLSGRYDNADGSTLNKLSGVNTRTGDNAFTWRTGLLYLADNGLAPYISYSTSFQPQAGTTSPARGTTPFDPTKGKQWEAGVKYQPNGSNSFITASVFELTRTNVPTTDPANPVYSVQEGEVRSRGLELSATANLASGWNLIAAYTYTDAEITKSNSNTLGNTPEAVPRNMASLWSDYTVPSGALAGLNIGAGVRYMGSTYNNTNAAKVGDYTVFDAAVRYDFGARSPSLKGWTADLTVRNLFDKDYVASCTYACFYGEGRTVLGRVTYKW

SEQ ID NO: 20193 - protein, 786 aa, Bordetella pertussis
MMPLRAQPLRALHKATPLVMAIRLSLLPVACLTSGITYAAVEPASTHYDINAGELDKVLNQYSTHAGITLSVDASLTRGKQSRGLHGNYSITDGLNTLLIGTDLQVKTLGDNTFTLKPAPVAQKDVLTVVGDWLGSAREADVFEHAGARDVIRREDFAKTGATTMREVLNRIPGVNAPENNGTGSHDLAMNFGIRGLNPRLASRSTVLMDGVPVPFAPYGQPQLSLAPVSLGNMDAVDVVRGGGAVRYGPQSVGGVVNFVTRAIPQDFGIDASVEGQLSPTSSQNNPKETHNFMIGGTADNGFGTALLYSGTRGSDWREHSATHIDDVMLKSRYAPNEVHTFNSLLQYYDGSADMPGGLSRADYDANRWQSTRPYDRFWGRRQLASLSYQYQPDQQHKFNIQGLYTHTLRSGYLEQGKRITLSPREYWVRSIEPRYSQLFNLGPSAHEVGIGYRYVNESSHEMRYYTATSSGELPSTSSPYDRNTRSGTEAHAWYIDDRIDIGNWTITPGIRFEHIKSFQNNNVKGTRQEVSYDAPLPALNVLYHLTDSWNLYANTEGSFGTVQYSQIGKAVKSGNVEPEKARTWEVGTRYDDGALAAEMGLFLINFNNQYDSNQTNDTVTARGKTRHTGLETQARYDLSELTPKLNNVSVYASYIYVNAEIREEGNTYGNQVPFSPKHKGAFGIDYKPGNWTFNLNSASQSSQFADNANTVQESANGSTGRIPGFMLWDTRVAYDFGPQMANLSVAFGVKNIFDHEYYTRSYDDNNKGIYAGQPRTFYMQSSLKF

SEQ ID NO: 20194 - protein, 391 aa, Bordetella parapertussis
MEISMKLDRVNKLVILSNILAGCLLPGIATAQSSVTLYGVIDEGIDYVNNSGGQHLWRMRDGTYDGMYGSRWGLKGSEDLGGGLSALFKLEAGFSLENGQMRQGGREFGRQAYVGLSKTDLGTVTFGRQYDSVVDFVQPVTAVGQFGGPFVRGGDIDNTDNSFRVDNSVKYASPSFGGFTFGGMYSFTNSNAPGLGTTGMWSLGAAYSHGGFNAGAAYFYAKNPAARFTDGNFIGNTTGAAIGASGSFSYVGAPRNERIMGIGADYAFGSATAGIDYTNTKFDDANGTTSSVTFSNYEVWGQYKVTPAATLGAAYVYTDGKVNYNGARPKYHQVSLMGSYSVSKRTSFYAMAGFQQAAGDAKQADIFDFSIADASTTNRQLMFRLGMLHQF

SEQ ID NO: 20195 - protein, 987 aa, Bordetella parapertussis
MLRHLGWLAACCAASAYAADYPGLTLNPGDDFTLQGNDTVNGATAVRMSSATLNFGAGPITVNATGTGIFATNGAGALINFLPSSVVTLNVTSPTAGVGILTSSSSNTAIDLQADSSLTINAYQGINLAHTPRAAPNRLSIGDGATLRVNASGTGMAPKGLLINNNNSVVVASGGTLGLGTSGGRYARALELSISLTYPDAAADKFTAAPGSNLNLSTTGQDSDAFYMLGVGEALMQGNTDIHTTGANSTGFYLYRYGAPTSHLLVAPHAGGHATILTEGQGSHGLWAINGSQAEFANASLQTRGDEAAGLYALTTIGETATQVRAADTAIATAGAQSYGVLAQGYGTDVALTRGTVATSGAQAHAVVVAGESRFSADGTAIQAQGDGAMALLMSSDRDAQTATVSGGSLRSLRGSAIGIEGGTARVELDGTAVDGATNWLHVADSGALAVLRDVTVPGRDPSQTDAPAFPAILHGTRAAGIAATATVVARNADLTGAAITEPGNTSHVTLIDTTWHMTGSSTITNLVNDPSLIDFAAPQGGAYKTLTVGNYSGDGTIALNTYLGADDSPSDKLVIDGGTASGSSKLRIKNTGGPGAATQAQGILVVDTRNGGTTTATAFSLSEPVVVGAYDYQLYRGAQTPEQEQNWYLRSAILPPVDPTNPDQPGEPIPTYRPETPGAVMAPEVARQVGARMLDTFHDRMGDQYALLNSAQRKAGWGRVIGQRLTQRWDGDVEPRFKGNIWIAQAGADMLERDRDDGLSDRLGLFGAYGQADGRVDGFVQGEHGKQAGKLRVEAYGLGLYWTRLKHTNWYWDNVLMGNYYTGRSRSDRGVAASLEGWGFTASSEAGYSFFPRHDIMLQPQAQLVYQYTSLDDTHDAYSTIRYHGGGALTGRIGLLLQGNADQPERIRPYARINLWHRFSHGESVSFGPSDSIRTEYGSTSMDLRIGLAAPLNRQTELYASAGYGFDLDGNQRQAYYGNIGVRYSW

SEQ ID NO: 20196 - protein, 723 aa, Bordetella parapertussis
MVCVRTVVCGTEMYQRFSNSSAHSLRRSPKSALARAIEALQPAGRGLALGTGLGLLACSPLVFAQSEAAKQESSLAEVTVSATGMAAGDMATPVQVLGEEELRLRRAATLGETLAAEPGINASHFGAGASRPVIRGMDGARVSVLSDGSELLDASTVSPDHAVTTEPLLARQIEVLRGPSALLYSPGAMGGVVNVLDGKIPTQAPEKGLEGSAEVQAGTAAGMSAGAFSLTTATPLKNDNGQLVLHAEGVARNAGDYRVGSGWGQSKVPGSFSRGNTGSVGLSWVGNQGYLGLAYTRQQAKYGLPGHQHSFEGCHAHGDHLHCGSHDGHDHDHGHEESGSVPVVDLTSERWDLRGEWRKPTAGIAALRLRGGLTNYRHDEIEDGSVATQFRNKAHDLRLEMEHEPISGWRGTLGLQTLKRRFSATGEEAYVQPTDTQRHSLYLLEEYRWQDWSFQGALRHDRQRVEAELSNERRSHSATSASLGTVWKFQPGYSASASFTSGSRMPTAEELFANGLHMATATYEIGNPNLSRERSQALDLGLAKTTGDTTWKLNAYHYRINGYIYGATLDAHEGLQLLQYTQGNARFTGWEAQLSQRLSRELSLSVFGDGVRARLEDGSALPRIPALRAGLRVNARLAGWDTMAEWTQVLRQNRTAQYETQTPGYGMLNLGASYLWKSGGNQWQFYVKGQNLTNRLAYAATSFIKSAAPLTGRNLVVGLRMDF

SEQ ID NO: 20197 - protein, 704 aa, Bordetella parapertussis
MPALFMLALGAVAAGARAQPAAAGVPDTQGVAQMPAVTVNAAPVDDTLEHLEAPVDTGALGRRTQLETPFSTTVVTARDMEERQVNKLGDVFALDASVTDNSASYGAWASYLTVRGLPLDWQNSYRIDGRPFLSYVTTLPFEHFEQIDLLKGASGFMYGFGSPGGLVNYVTKKPTDEAVRSVELGYMSKGLLREHVDLGGRVGESGALGYRLNATHEEGNTYNGGSLYRDSVSLALDARLSDRLTWDFQSIYQDRKAIGQEPTIYAGTMAGSELPSPVRNDNDRLVGQGPYADNAFRYYSTGLKYQLADEWTLSTNYSYSSTRTRRNESVLFLRDQAGDYDDYRSDYGEAYGYNQWQAMLEGKFATGPLKHHVVAGASWQKQKNDYSANGVYQLQGTGNLRARNTNTYYSEGQLHLYRAAEITQKALFASDTVDLTGGWSVLGGLRYTNYAQQGFDATGARTSRYDKNGVLTPTFALMYKLTPRTMAYASYIESLEPGSSVGATYANFGALLDPLKSKQYELGIKTEQDGWAATAALFRIEKKAEYANAANELVQDGKTLYQGLELGASTRIARDWNVGGSLMLLDSEYKKGSDFTGNRVAGAPKFVAAAQLAYSVPQVPGLKLRADVKYTGNTMLGASNRVQVDDYAIVNIGATYDTQIHGYEATFTAGINNVANKRYWLYQSSDYVKAGDPRTYGLTASLKF

SEQ ID NO: 20198 - protein, 870 aa, Bordetella parapertussis
MVYACDQGARRARPAPPRRPQTALAMRGALAACALAGTLAAAPAAAQPAAAPASAGARAWHIDAGPLGEALARFADQAGITLLYDPAAVRGRASAGLQGVYSVPDGLARLLDGSGLDARQRGAGTYVLQALPAGPVAQLAPVTIEADGVRADPAWARTATRRELDARQVLDWNDIGKRVDPGVNYNRRTKSINIRGLDENRVVTRIDGIRLPWLDDGARGIQGGLNAVDFNTLSRLDVVRGADSSAAGSGALGGLADLRTLEPADLLRDGRRFGALAKSDYDSADASWGLNAALAGQVHDDTSWLLQAGTRNGHDLDNRADTGGYGSKRSQPSPEDYAQNNFLLKLQQRIDGGHRLGLTGEYFKRRADLDQMYQQGAGTSYQYGANRTHEETTRKRVSLDYQYNAPQAGAAIDSARAMVYWQRLRLDSSQDARRTRDGRAYARPGDPYFYGYPSGPYGRSNSIQESILGVNGELSSRFEGMVSQRVTIGGEWYGNRTEQYSDGYDNCPAIPPGTPAPMGPRLCDMLHTNQADMPRVKGSQWAIWAQDEIAFADGRYILTPSLRYDHYEQKPQQGGGYQNNPNAGTLPPPSSGGRFSPKLLGTWKAREALTLYAQYGFGYRAPSATELYTNYGGPGTYLRVGNPSLKPETSKGWELGARLGDDQLGGAVSLFDNRYQNFIDKNVPLGKGSPQWQPAWDGQYPLGVTGLANRARVRIYGAEASAHWRFAPNWRTWGSLAWAVGKDENTGQHLNSVPPLKAILGLGYQRDEWGIDAMLTAATRRDDVQYPEACANARYADFQAPGYGVVDLSAYWRPAAVKGLQLQAGVFNLFDKKYWEAINVPTAGAIAIPRPLDWYTEPGRSVRVSLTYQY

SEQ ID NO: 20199 - protein, 381 aa, Bordetella parapertussis
MSDLLQKFGSITMKKTLLAVALASGFAGTAQAAATSVTLYGLIDSGIGYEQVKGPNGFKQSHVGATSGVSSGSRWGLKGAEDLGDGLQAVFTLEAGFNNQTGNSEQSGRLFGRQATVGLSSSAWGKLEFGRQTNMASKYLADISPFGTDYGMAGIGSTFGSAKSLRLDNMVMYQSPDFSGFRFGLGYSFNADTTKGDNFSTSDNPRVVTAGAKYASGPLTLVATYDRLSPNHAATNGESQSVQEYALGGMYDFEVVKLHAAWGQTFDGWFSGYSMGTNPSFAGYSKLPSLAYKDGAKVDSLMLGATVPLGKTKVFGSWQRADPKNDKLTGGDKTYNIFALGATYDLSKRTNLYAYAAYGDNYAFHDEVRNTAVAVGLRHRF

SEQ ID NO: 20200 - protein, 354 aa, Bordetella parapertussis
MKRLIPAVALAGMFVGTAHAETSVTLYGIADVSVRYLSTGNDNGNSRVSMENGAISNSRWGLRGVEDLGDGMKAFFRLESGFNVQNGERSDPDSFFNRHAYVGLDGGEIGAISLGRQDTPLFTILADSYDPLTVGNYAQNSWLPVAMSRARSSNSVRYRNDKLAGFDVILSYAFSDSFEDHKLGEQYGGTLSYTTGPFSIGGGYMLTHSASNSDYQQRVWNLNASYKFETAKVFIGYFNGRDETGFVNAVMGNTSLPDNGLERKDNGYFAGVTWQATPRWALTGAAYYDTSKNLVEEGDKGKRYALVGVAEYALSKRTQVYGTIDYNKVKDAATGEIQGDDKQIGAAVGIRHIF

SEQ ID NO: 20201 - protein, 369 aa, Bordetella parapertussis
MKKTLLAVALASGFAGTAQAAATSVTLYGLIDSGIGYEQVKGPDGFKQSHVGATSGVSSGSRWGLKGAEDLGDGLQAVFTLEAGFNNQTGNSEQSGRLFGRQATVGLSSSAWGKLEFGHQTNMASKYMADISPFGTDYGMAGIGSTFGATKSLRLDNMVMYQSPDFSGFRFGLGYSFNADTTKGDNFSTSDNPRVVTAGAKYASGPLTLVATYDRLSPNHAATNGESQSVQEYALGGMYDFEVVKLHAAWGQTFDGWFSGYSMGTNPSFAGYSKLPSLAYKDGAKVDSLMLGATVPLGKTKVFGSWQRADPKNDKLTGGDKTYNIFALGATYDLSKRTNLYAYAAYGDNYAFHDEVRNTAVAVGLRHRF

SEQ ID NO: 20202 - protein, 360 aa, Bordetella parapertussis
MKSRSLRAAVLTGSAAVAGLAAGAAHAQSSVTLYGIMDAGIEYTNHAAPEGGSSVKLKSGNKNTSRWGLRGVEDLGGGLKAVFRLESGIDLANGAFDDGPDSIFARRATVGLKGKWGELTLGRNYTVTYDYLLPFDPMGYAQNYSWATSSTATGGRKDGMFTRSSNAVRYDGEFGGFKFGAMYGFGNVPGSVKTSSKYDVALGYETGPFAAVVTFDRQNGAADSVTPADTVNYIQGIHAGLSYDFGNLKTMAGYRNYRRTFHTSAANQLSDTYWVGGSYQFTPTFSLIAAVYHQDIKGGTDADPTLVSMRANYALSKRTVLYLSGAFAIAKHDQKVGVSRDFAGYGTTQVGVTAGIQQRF

SEQ ID NO: 20203 - protein, 1068 aa, Bordetella parapertussis
MTQVFGARRFLPVLLFLLCFTHPAKAADELLVYVFDQGAAVAGAAVAIDGEAVGVTRRDGSLFVDLPGSGQRVLTVTSADGAKQRDRFSSASGQLVDVIVNLGSGDNQSIVEVYSRTESTADRREVPTGELQITVRKGSDAAASQLVVISNGQGGVSTNAQGVATKTVPRGIYRVTTNGVSRSVRVVGGVTRGVQINLPEADAGFSIAAPQIEEVFVLGTFDASGFELSERDTNLIVDTLGVEELARFGDSDVAASVIRVPGVAVQDDKYVFIRGLGGRYVTSTLNNATMPSTNPTKRTVPLDLFPSNFVNQLDIKKTFLPFMPGESTGGNLVINTKTFPDERAGSITASLGYVTDLTGNTVAVDPADGTFDFIGWDDGSRKENILVSTIGDIVSDGGTFTDDEGNTFTLQQSVLRELQRSAGVLLSQDWDLDFSETTPNGGLGVNYGDLFYLGEGELGFYAAVNYSNEWSQRGNGIRRTYSASGIVADDQSYESYSQNIDISGLVSIGYNIGNNTFEWNNVMSRSTESFVERSVGREGDEFRSVYQATSQWEERQFFSTQIVGSHFLNEDGSIFGEWQFTGSQARRYVPGRTDVRFNAEANLTEPADLRAGYDFSSPNDEQGDLLNGFFFSSGSSSKRWDDLTDNNFDGSFDITWDLYDDGASFGQLRFGAQAIYRERDADSATYGYFNNGADATLSASPNVLVTDNIFVCGEGPGTVTCEDNTQGGVQDSPTTGFLFQVRTQVSDEYEAKLDYNSIYAMYDHTFDGVWEVIAGARYEQYEQVTDTFDLTTGNPVQGIVDEGSFLPALGINWFYSDTQQLRLAISQTVARPDFKEASNAVFFDNEFNVRVRGNPNLTVSDVFNADLRWEWYFGDNDTDNVSAAVFYKDMTDPIERVYQAASGTASNSRTFQNSEAAELYGFEVEGRKEFLLTDDYNNTLFVSFNAAYIESEVTLLSGDARALQGQPEYTANFVIGYDNVPGGHQLTLLYNHNGESIADVGILGLPNVLLEERGEMNLVYRYDISETASLKARIENIFDAEVEYTQGGEVFQFYEKGTTFQIGLDWEF

SEQ ID NO: 20204 - protein, 814 aa, Bordetella parapertussis
MVITFNLFSVKHSMRARPSAATRALHSSSRPRRLIPALLGALACLGTGVQAAPIDVDIPPQNLAQALHQLGRQANLQVLYSQDLVDGQRSPAVQGRMEPAEALERLLKGRNIRYSIQHNTVTLTPMPLTATLPAISVVGALPDSDTYVATGTTAGTKTDTPLIEIPQSISVVTAAQIREQNPQTLGDAVRYTPGIVVQEGFNRTDDPFIIRGFDVRTNPGVMFRDGLKIPLPHYSAMSEPYALERIEVVKGPASVLYGQASPGGIVNVVSKRPTDSPLRELQLSGGSHSNRQLAGDFGGRIDDEGRLTYRLTGLARNADTMIDHVPDDRYYLAPALTWRISPDTSLTLLASYMKNKTINNAGYPLEGTVKYNPNGRIPRHRFTGEPDWSKWDQEVANVGYQFAHRFNDTWQFKQNLGYAQSRNRVNHAYWWTWVPGSDFSTAERGAYRRDDDAHGVSIDNQFEATWQSGRFRHNTLFGLDYTETSFTRKQYAGYNNLAPIDFFDPAYGSDVLLPAKPDTYTNEKRSQLGLYLQDQIKFDDKLVVVLSGRYDNADGSTLNKLSGVNTRTGDNAFTWRTGLLYLADNGLAPYTSYSTSFQPQAGTTSPARGTTPFDPTKGKQWEAGVKYQPNGSNSFITASVFELTRTNVPTTDPANPVYSVQEGEVRSRGLELSATANLASGWNLIAAYTYTDAEITKSNSNTLGNTPEAVPRNMASLWSDYTVPSGALAGLNIGAGVRYMGSTYNNTNAAKVGDYTVFDAALRYDFGARSPSLKGWTADLTVRNLFDKDYVASCTYACFYGEGRTVLGRVTYKW

SEQ ID NO: 20205 - protein, 364 aa, Bordetella parapertussis
MRRLLVVAAMAAGSSSVFWSVAPARAANQLELYGVVDVGLATTRVSGLGTRQQVLGGGQTDNLWGLRGTEELDGGWRASFGLESGFDAANGTRNDDARLFDYGTWVGLGHAGVGELSLGRQQSIGLQYGGQLEIASWRDMGMGALFKASDNYRVNNLVNYLSPEFSGWQWGVGYAFDVESGDTGRFDRSPAFSTGLKYEDGPLLAAFTWDKLNLHDTSATGGRSPQALQAGFTYDFEALKMALAWSRQRNGFVGLNGGGQIGLGPEPFAHGGAINAWLLGLEVPVHGNGAWLVQGSMARPDWHWANGQQASKAYVVTLGYRQDLSARTSLYAYGGYMKGYDLEDPFASDVGRATRFGVGMTQRF

SEQ ID NO: 20206 - protein, 734 aa, Bordetella parapertussis
MPDPAHFSPAHSRRLRFFAHVLHLLGALFTQHALAQEARTGNDIAQLPAISVTGREISDLTEGTNAYTTEAMSTATGLTLSPRETPQSVSVVTRQQIEDQGLTDTGAILATAPGISVTRSDSNRYSFSARGFTIDNFQFDGLVSPILSQWNYGSTDMDAAIYDHVEIVRGATGLMTGSGNPSAAVNFVRKRPLREFAATFNASVGSWDYVRGDADISVPITEDGRIRSRLVAAYSQGDSYVHFLDTRRRTFYGVVSADLTPDTVLTTSVEYQHNHSNGFGSGFPLFYSDGSRTDFNRSVANNAPWARQDTEATTYFVDLTHRFTNDWKLRAAYSHTDGRYLMKHVYRGGYPDRHTGIIAAPPAFSNYDGNLDRDDIHLSLSAPFEAFGLRHEVALGWMSIDNHSDIQRYAMVGPAPAIGSFFDWRRAHIQEPSWADTLSPADDVRTKQTGAYLVGRFALAEPLHLIVGGRWSDWKTKQMYFGSRREYRIKNQFTPYAGLTYDINDTYTAYASYTEIFQPQNARDTSGGILPPIKGKSYELGLKAAYLEGRLNTSAALFQTRQDNLAQVIPGSSIPGFPNMQASRAASGAKVEGIDLEASGQILPDWNIGASYTHFTTKDASGNPINTNHPRSLFKLYTTYRLPGALHRLTVGGGVDWQSRMYQAAASPRGNVEVEQDSYALVSLMARFDFNKKLSATLNVNNLFDKKYYDQIGFYSQGWWGAPRNVMLNLRAQY

SEQ ID NO: 20207 - protein, 388 aa, Bordetella parapertussis
MKKTLLAAALLAGFAGAAQAETSVTLYGIIDTGIGYNDVDFKVKGANADGSDFKYNHSRFGMINGVQNGSRWGLRGTEDLGDGLQAVFQLESGFNSGNGNSAQDGRLFGRQATIGLQSESWGRLDFGRQTNIASKYFGSIDPFGAGFGQANIGMGMSAMNTVRYDNMVMYQTPSYSGFQFGIGYSFSANDKDADAVNRVGFATADNVRAITTGLRYVNGPLNVALSYDQLNASNNQAQGEVDATPRSYGLGGSYDFEVVKLALAYARTTDGWFGGQGYPVAVTLPSGDKFGGFGVNTFADGFKANSYMVGLSAPIGGASNVFGSWQMVDPSNDKLTGGDEKMNVFSLGYTYDLSKRTNLYAYGSYAKNFAFLEDAKSTAVGVGIRHRF

SEQ ID NO: 20208 - protein, 798 aa, Bordetella parapertussis
MKFYLWLSIALLSITATAQECSYTLSGYIIDLHDNEVLEEATIIIVGSERSVTTDAQGKYVITDLCEDQYTLQVSHPACETQLVKVTVSGNTTRTINMEHHLESLGDVEIVAHAHKSKSRTATESVVDHNLLENNSAASLGDALKNLSGVTSLNTGNSVVKPVIQGLHSSRVVLITEGTRLQDQEWGVEHAPNIDVNAAGEVTVIKGAAGLQYGGDAIGGTIIIEPEQVPVKDTLFGRTIITGATNGRGGSLTTSLIKSYNNGWYGGINGTLKRFGDFEAPDYVLSNTALYERDLSVRIGVNKYRYGVEASYSIFDKESGILRSSHVGNAADLSVAINSQEPFVVEPFTYDINAPRQEVQHQIAKLKSFYRFDNFGKLSAQVDYQRNNRLEFDIRRDSDDLRPSIDLQLETIGGKIDFDYTADNTITAKVGISGRYQDHFPDPVTGVRRLIPDYQGYDFGIYALGSKDFGKWTIEAGARYDYNRINAEKFYITSLWEAREYDVNFAQFVVEEFENQIFVKPEFEYHNFSATAGASYEVNDATTVSLNYALASRSPNVSELFSDGLHQSAARLELGDLSFNQEVANKISLNFTRSTDTWSFTIAPFANFIEDFILIEPTGVQQTLRGSFPVWEYRQTQARLLGFDIDNNVQVTDRFEFSNQFSLVKGKDVTFDNALINVPSASTRNSVTYTMPSVNNLKLSLESNYVFRQNEFPDTNFDVFLPETNTTEIVDISTPPDAYHLLNFRSSIDFAINDKSNLNVGLMVNNLFDTSYREYLNRQRYFADDLGRNVLLQLKINY

SEQ ID NO: 20209 - protein, 378 aa, Bordetella parapertussis
IFASGFALNEQDVPGMGTGFAGRSSSAENASTVYGNPAGMARLEGQQVTGGVAAIDASSNIKDVSGRSSGTNKGDMVPFTAVPFGFYTNKLNDQWAVGFGVYAPFGLVTDYESGFQGKAFGSKSEVTVITFQPTVSYAFNDRVSIGFGPTINRIAGTLESDINLPVAGTGSNNIKIKGDDTAVGFNAGLLVQATDTTRVGLTYHSKVKYKLEGHTEVTKGTNVPASLLNNGRYDASLKIDTPESWDLSVTQDMSDAWKLYAGATWTRWSRLKDITVNNEGVSAAAGSGVLAPQIVGTIKEDQNWHDTWAYAVGTSYRVTKQVVLRTGLTFDQSPTNNTDRSPRIPTGDRTIFSLGLGYDVMPNMTVDLAYSYLKEEPV

SEQ ID NO: 20210 - protein, 433 aa, Bordetella parapertussis
MFSRMFAPFPHAPGRRVAGLFLLCAGVNAQAAGFLEDSSAKVEARNVYFNRDFRDGHSSSSQGASKREEWAQGFILNVQSGYTQGPVGFGVDALGMFGFKLDSSPADSNSGLLPSSGHDPRGSADQYAKMGLAAKVKVSNTVLKYGSMMPDVPLLKYNDGRLLPTMFHGAMLTSEELRNLKFTVARLDKYTARDSTDRQDIRVHCKNKRYACDTEADHFDLAGVDYRFNERISAQYQVAKLENIYRQHFLGLVASQPLAVGSLSADLRLIKSDDIGNARAGAIDHRAFSGMLGYSLGGHKVSAGWQRMYGDSAMPYLDGSNPYLVNYAQVNDFAAAQERSWQVRYDYDFKALGVPGLTFFTRYINGDSIKVPGSSAEGKEWERDTEFKYQVQSGTFKDVSVRLRNSTYRSNYEKWARDMDETRVIVSYNFSIF

SEQ ID NO: 20211 - protein, 727 aa, Bordetella parapertussis
MLRSVRNDAATVRMRDTSAMPRLTLLAAACGLFVASASSLALAADAAPPIAALPAVQVDAARVHGVDDFDLPASFTVVVADDDNRRGAQVSELLDGIPGLVARDRQNYAQDTQLSIRGFGARSTFGVRGVRLLVDGIPASMPDGQGQLSHFNVLGAQRVEVLRGPFSALYGNSSGGVLQLWSADGKPGDPWRLRATYGSNATVNTGAQLLGQQGAVHYNLAANHFETDGFRDHSRAKRESVNAKLGFDLAPGSRLDLVLNYLDAPDAQDPLGLTRAQVTADPRQATAVATQFNTRKSVRQSQAGAIFTQQFDTQTLRLMAYGGQRSVEQFLAIPVAVQRNPLHSGGVIDLDSNYEGADVRWAWQGQALGRPLQLTVGANVDRQRQHRTGYENFVGTTLGVKGALRRNQRDQVENVDQFAQAWWQWSNRWSALLGVRHSAVRFRSDDNYIVGRNPDDSGQRDYSATTPVAGIVFRASDDLRVYASVGRGFETPTFNELGYRSDGGAGLALDLGAAKSRNVEVGTKWRSQSGAALELALFRADTDDELAVASNTNGRSTFRNIGATRRQGAELSWQQPIGQTQQVQLAYTFVDATVRDGYLTCASSGCATPTAPVASGARLPGVPRQQLFARWQWQPLQWQFAAESVVSDATVVNDLATERAAGYALVNLEASRRWTTAHGALRTFARIDNALDRAYVGSVIVNDGNGRYYEPGPDRTYTVGLQWDFGS

SEQ ID NO: 20212 - protein, 993 aa, Bordetella parapertussis
MNDRKSNSVSPVARYLRFGVAAVAGVAAGALPSPDVDAQAAPAAAAAAKIEALSDTDIYSDYEHGIVMAPDNKDYISYKPAEGGPEAPPPPPPPPPPPFKPAPYVSLGNDVVAERIRVDVRGDETLGVYVDSEHRSLTVRDSRIDAYGKPPSIESPNYYGAAAVYAGTLNIENSTVRHNYAAQPFEDAVGVGVTALGEKAILNVTDSEVSGTRGAVIGWGGEATFTNSVLRGSAFGLYAEMCDTCRDDDGTSPSIRVRGGVVQGGVGANNVAVVATGPGKVAIENAELLGASGMYATFGAQVDMKGGRILAHNTNVIGSQDYADGPYGGVVLTEDGQVNLEDVKVSATGLGAAGLWLLGDKDTSPRANLRNTDVHGEVAAIALGFNGEANISGGSLSVEDGAVLTTLTPDAVEYYYDYALSMEHPAADAPLTPVRVTLSDGARASGETLIAHGGLLPMTLRLSSGADARGDIVTLPPSAPPDSAEQPDAEPRPDAAAQSDAKAKARVMAQVDGGEPVAVPIPASSHPDAPIDVFIDSGAQWRGITNTVNALRIEDGTWTVTGSSAVNSLHLQAGKVAYATPAESDGKFKHLRVKTLSGSGLFEMNASADLSDGDLLVVSDEASGQHKVLVRGAGTEPTGVESLTLVELPKGSQAGFTLANRGGVVDAGAFRYRLTPDNGVWGLERTSQLSAVANAALNTGGVGAASSIWYAEGNALSKRLGELRLDPGAGGFWGRTFAQKQQLDNKAGRRFDQKVYGFELGADHAIAGQQGRWHVGGLLGYTRARRSFVDDGAGHTDSAHIGAYAAYVADNGFYFDSTLRASRFENDFTVTATDAVSIRGKYRANGVGATLEAGKRFTLHDGWFVEPQSEVSLFHASGGTYRAANNLSVKDEGGTSAVLRLGLAAGRRIELGKDRVIQPYATLSWLQEFKGVTTVRTNGYGLRTDLGGGRAELALGLAAALGRGHKFYTSYEYAKGNKLTLPWTFHLGYRYAW

SEQ ID NO: 20213 - protein, 737 aa, Bordetella parapertussis
MSTPRFALHYASASVLLAASGLAMAQTATQIHDPSQVQQMATVQVLGTAEEEIKESLGVSVITAEEIARRPPTNDLSDLIRREPGVNLTGNSASGARGNSRQVDIRGMGPENTLILIDGKPVTSRNAVRYGWNGDRDTRGDTNWVPAEEVERIEVIRGPAAARYGSGAMGGVVNIITKRPADRATGSITYYTNQPEDSREGNTNRVNARISAPISDTLSMRLYGNYNKTNPDARDINAGHANTSDNGNPSTAGREGVINQDLSALFSWKADSHNTVDLDMGFSRQGNLFAGDTMNNANSDFSDSLYGKETNAMYRENYALTHRGVYDWGTSRASVGYDYTRNARQREGLAGGPEGAPTAGGYDTARLKNWRAAAEASVPFHLGFEQVATVGVEWLRESLEDPAGTRQTYTGGAIGGTAPADRDPKSRQTSYALFAEDNIEIDERTMLTPGVRLDHNSEFGSNWSPSLNASYAVTDALKLKGGIARAYKAPNLYQSNPNYLLYSRGNGCLASQTNTNGCYLVGNEDLSPETSVNKEIGFEYDPGTWRTSMAYFRNDYRNKIVAGTDVQYRLANGARVLQWTNSGKAVVEGLEGNLFIPLASNLDWNTNFTYMIQSKEKATGEPLSVIPEYTINSTLDWFYTPQLSFQANLTYYGKQEGPSTNVRTGVELNGDGRQTISPYALAGLSMGYEVNRNLKFRVGVSNLFDKQLYREGNASSAGAATYNEPGRAYYATATVSF

SEQ ID NO: 20214 - protein, 980 aa, Bordetella parapertussis
MAPNHFRLASLVVPSSRTTLAALCLLAGVAVGAQAATSRADVALAASRARTAGADSVHDFDIAAGPLDQALAAFASQSGLRLAIDATLTRGLSAPALRGRHTARTGLRRLLASSHLQAVVHDDGSLVLRRDPTLPTFELSPVRVLSDPVRDVYLAPRSSVYVSAVDIARFGVVSPADLLKGLPGVQTGDSRNGGGLDVNIRGIQGQSRVAVKVDGAEQALDVYRGYAGTQQRSYIDPDLVSDIVIDKGPSLAPAAAGAIGGTVRMRTIGVQDILRDGQSVGLRVTGSLWNNGVSPASRDPHPRHPPEDAELAAPPRIQRGNLFGSDAQAGSVAFAYSDATFDVVAAYARRSQGNYFTGRHGHDRYRVFEGNAERASVATAYRPGEEVLNASARTESVLLKGALRPADGHSVELGYRRLDGRYGEIMPSDIFRYGTAGIWQYPLGTVLVDTTTARYRYTPSGTDLVDATVNLWTTHAKTRQLNTVIAPASEFYRDDRNWVRVANRRIGGDFGNTARLSSAYGEFRLELGGAFQYEDIGPQRGVRITQHDRNGNRYLRDAARRELGLNAKLTYQPTERFTAWAGVRYARMRHRDHNSHATPRQAQRLMRRIVITNPDDDGIMSYGYMDWFPDANGQFTDATDPRLHNGIVYRDAELPSEGIAFDDFLVNARTNVRVTDASVRDTVIGYDFSPPRINRDQGLAPALGVDYEIAPDMHVYASYTQGLRMPSLFETSLGVLQTTPGAGLRPERAHSWEAGIGAMRDGLLQAGDSAAYKLAYFRNDIRNYITRYYRPGANGLMTFSNAERYRVHGLELQTRYDVGRYFADLSATYYLKTETCDPAFAAQLRASAGRGRSTQDTPDCTPGSFMGSYANTQNPPRLAVNVTAGLRLLSQALTLGARMTHTSGPTARADRPWQQGATTAQLLYHPVTVYDLFLAYRVHKRAALNISLQNLTDRYYLDPLAQSYMPAPGRTLRVGLQAWF

SEQ ID NO: 20215 - protein, 915 aa, Bordetella parapertussis
MAGQARGWYGAGGRHPIHFQISAGAALMLGLLDVAGAAAVTAAQRIDGGAAFLGDVAIATTKASEHGINVTGRTAEVRVTGGTIRTSGNQAQGLRVGTENAPDNTALGASVFLQNLIIETSGTGALGVSVHEPQGGGGTRLSMSGTTVRTRGDDSFALQLSGPASATLNDVALETAGQQAPAVVLWQGAQLNAQGLVVQVNGAGVSAIHAQDAGSFTLSGSDITARGLEVVGIYVQEGMQGTLTGTRVTTQGDTAPALQVEDAGTHVSMNGGALSTSGANSPAAWLLAGGSAQFRDTVLRTVGEASHGVDVAAHSEVELAHAQVRADGQGAHGLVVTRSSAMVRAGSLVESTGDGAAALLESGHLTVDGSVVHGHGAAGLEVDGESNVSLLNGARLSSDQPTAIRLIDPRSVLNLDIKDRAQLLGDIAPEAQQPDGSPEQARVRVALADGGTWAGRTDGAVHTVRLLDRGVWTVTGDSRVAEVKLEGGTLAFAPPAQPKGAFKTLVATQGISGTGTIVMNAHLPSGTADVLVAPQGFGDRQVLVVNNTDDGTESGATKVPLIEDEQGHTAFTLGNMGGRVDAGARQYELTASEAQADKARTWQLTPTNELSTTATAAVNAMAIAASQRIWQAEMDVLLRHMSGLHSIGSPGGFWARGLSQRQRLDTGYGPWQKQTVSGIELGLDRRVAGGATTAWSVGMLAGYSETRRDGGAYRAGHVHSAHVGAYVSYLNDSGSYVDGVVKYNRFRHGFDIRTTDLKRVDAKHRSHGLGALLRGGRRIDIDGGWYVEPQASVAWFHAGGSRYEASNGLRVRADGAHSWVLRAGAEAGRQMRLANGNIVEPYARLGWAQELGADNAVYTNGIRHVTRSRGGFAEARVGVGALLGKRHALYADYEYAKGARFEAPWTLQLGYRYSW

SEQ ID NO: 20216 - protein, 734 aa, Bordetella parapertussis
MKPLPLAYLAALLPWYAGVIQAQSAPAAGDDASITLEAVRVEASADASAGGLAPAFAGGQVATGAKVGILGTRDNLETPFSITAYTNELIQDRQAKGVGDVLQNDPGVRVARGFGNFQESYFIRGFILSSDDIAYNGLYGLLPRQYISTQLFERVEVLRGASAFLTGAPPSGGGIGGVINLVPKRAPNEPLTRFSAGYGSDSVLEASADIGRRFGPDDSVGIRINAAQRGGETAIDGERTRTTVFALGLDWRGERARLSADIGYQDNRLKRARPNVTLAGDAAKVPGAPDAGSNYAQPWSYSNERDVFGTLRGEYDFNGRITGWVAYGMRQSKEENSLANLNNVNGAGQGKFYRFDNAREDTVNTGEIGLRAKARTGPVGHELVASASYFDLEKKNAYVMDFFNQFDTSIYDPVSYAKPAISSTAFRGNDMDDPAKQGVIRLASYALGDTMSFFDDKVLLTAGIRHQRLYQRDYSYDTGIGGTPYEQSHNSPAAGLVVRVTPQVSLYANYIEALSAGDTAPQTANGLPVVNHGESLAPYVSKQKEVGVKFEHDGLGGGLALFSTDKPRGFVGDDQVFRASGKDRHRGVELTTYGELTRSVRVLGGLTWLDAKQLSTGNAATDGKRVIGVPRFQANLGVEWDIPGVQGLTVDGRVVYTGSSYADAANTLEVPGWTRLDAGLRYMTDIGGHLVTWRARVENIANRDYWSSVGGYPGNGYLVLGGPRTFTLSASMEF

SEQ ID NO: 20217 - protein, 702 aa, Bordetella parapertussis
MDNRTPQRRRPAAPRLLHLSLAASLAAGAAQAQTATEATTLPAVQVTGRGETATGPVDGYAATRSATATKTDTPLSETPQAVTVIPREQIIDQGAQNVQDTMNYAAGVRPNAYGVDNRGDYVRVRGVEPVQYLDGLKQFFNYNNPRTEVYGLERVEVLRGPASMLYGQGSTGGVVNLVSKRPQPEAMREIGVTVGNHNRKEIQADLTGPLTEDGTWLYRVVALGRDSDTQVQYTKDDRMMVAPSLTWQPSAATSLTLQAYWQKDKSGTTQAFLPWSGTVSGNPNGRIPTRRFTSEPGFDRYDTEQFSVGWQFEHKFNDNWKVRQNLRYTSSKVDYSTLYPAVYGNPDNPFIDADQRVVNRYLYIKNPRMRSLLADQNLEGKVNWGRAEHTLLMGVDYSRYRETGETGSGFGAPLDLYQPVYGTLPDYAMSDVPKNKQQQIGVYLQDQIKFDRNWIVVAGLRHDRVANSVEGADKETDNATTKRLGLMYAADNGWSPYLSYSESFTPIAGTDNSGNRWVPMRGKQWEAGLKYMPQDTGYEATLAAYDLRERNRQTNDPSDPTNQVQTGKTRTRGIELEFRGRVTPQMDVIANYNYTDIDPQLEGLPKHTFSLWSKYRFSVGDVHGFAAGAGVRYLNAFRDGSAPETGSVALFDAMLSYDTGSWRYALNVANIADKTYEVVCLRRGDCFYGQRRTVTLSAMYRF

SEQ ID NO: 20218 - protein, 1076 aa, Bordetella parapertussis
MAQASARGMGLRITSLAAALLGVYGAAGAAENRLECIGACPPGQPVAGAHYSGTNLSANREWVVYGEGSNAVFTLQGGSVTASGGLMGAVNAADGARVYLNQVSVRTDAGNGWEAPGVRAEYGALVNVRGGSIATVGGGSYGVQSLDSGTMIELNGTDIRTTDAYSDGLRAEFGGSIRAVGLTINTTGEHAVGAMGADDGTIALRDSRITTSGVDAYGLGTESQVLSPGGVLQVSNTAIQTSGKNAHGVYLQGGSSLNMSGGSIRTTGSGAAGLRVSNGSSVALNGVEVVASGPSLLSTLSATRQQSIVVGAGSNLTRNDGRLLLVRRVAGGELGQVTLTLKSGSYAAGNIENLAADGSRESSALTIVDVQSGAQWAGLVIDDTTAIVNGSQSGQHSGFSTAGDMVLEGGSAPVTFTGVSNIGGSSSLGAGSQTTFGGATTIGQSLAVLPGGSVAFNGPLTIGESVTEGQGTALSFNAPAIIGANVQGAGGAAFTFSGPAQVGGSVQGLDGASFRFSTSAPTAIAGGLSLAGGSSLGGGSPTTPIVVIGGADAVSGAILGGNLDIGGALRMTGASLAPGNSIGTVTVGSVGALSGSTYLAEVNAKGQSDLLVVRSGNVDLAGVSLVVGQENGTGGYVLNHDYTIIKTEAGKIVGEFAAASLDESLASTLVKLDPVKYGAQATQVSLSPDADKLAAARAGLIRNQSAVLDGALSVAGRNASADAVMLMSDTGQRADALDQLSGEVHGSAVSALYSNTQLLNRTVARRMSANLGAGLLAGAPTAQAAGPAAASAMPGTAAYPLWADVVDNWSSFDAKDNAAKAKSNTAGLFIGGDAAVGAGWRVGGALGFTDGRIKADAVDSRSDVTSYTAALYGGNSWAAGKGKLNFLAGVGYTHHDIDSRRSVDVGGAQTLKADYKANTTQLFAELGYQVPVGASSSVEPYAGLAWFNNHSDSFDEDGGPAALHGSGQTDQITTFTLGLRGNTALQLGATETRLSAGLGWRHANGDVDATRKLAFIQGGGTAFTVAGSPVAREAAVLDLAAEVDVGRNAALGLAYGGQFGNGNKENTGSLYLKVRF

SEQ ID NO: 20219 - protein, 855 aa, Bordetella parapertussis
MALARPLTASFSSVLTQRLARATALTSLALCMSLPAMAQHSAPQTYQIAAMSLTEALARYADQAGISVLYEPAAVAGLDSPGLTGRYTPEQALSRLLAGTSLVASRQGDNTYVLRPAGSVSQLAPVKVETVGPRPEPAWTTITTRAALDSVMAYDWTDVGKRIEPGVTFNRQNNSINIRGLDQDRVLTRIDGIRLPYLDDGARGVKGGLETVDFNTLSRLDIVRGSDSTKGGSGALGGIAELRTLDPSDLLRPERDFGALAKLDYDSADSSRGANAALAGRIDDNTTWLIQAGARGGHALGNRADVGAYGPRRSEPTPETFSQQNFLAKLQQKVDGGHRFGLTGEYFKREGKLDNMYDQGPGTNYLYGENSTKKTTKRERVSLDYQYNAPTPGGLIDSATAALYWQRVTLDNDLSARRGVDARANIRPGDPFRYGFPSGAYGRSNSIQESLFGVTGEISRRFDGAIAQRVTLGGEWMGSRTQQYSDGYDNCPTIAPNLPAPFGPRACDLLHSNQADMPRVKGSQFAFWGQDEFSFDDGRYTLTPSLRYDHYEQKPQSSAGYDSNPNSKGILPPASSGGRFSPKLLGTWKAQEQVTLYAQYAYGYRAPSASELYTNYGGAGTYLRLGNPNLKPETSKGWELGSRLGNEDLGGALSLFDNRYQNFIDKNIPITAASAQWQPGWAGQYPLGVTGTVNRARVRIYGAEASAHWKFAPNWRTWGSVAWAVGKDQSTGQYLNSVPSLKTVLGVGYARDQWGVDAMLTAARKHDKVQNPSATPAAPYPDFQAPGYGVVDLMAYWRPAAVKGVQVQLGVFNLFDKKYWESINVPTAGGTAIPRPVDWYTEPGRSVRLSLTYQY

SEQ ID NO: 20220 - protein, 418 aa, Bordetella parapertussis
MKPTSILARLPRYLGACALAALAALAVAPLAPAQAQTPLPAGLGAAEVRQYLSGLPSDALRQQASWLAPALLRPYLSGLTDAQLRQYVQALTPGQITQGLAALTPAQRARLQREFERQARRQVQQAVRAEVAARSARAVAMGQSASMLLLDAEMGTLAQRQGDLRRGHDEGAFWARGSANRFKVDTPDTPAFDLRVEYLTLGADHGWRLDTGRLYLGAYAGVSRARMDDNDIMHGRIESRFLGTYLTYVDNGGFYVDAVSKLGRIDESVSFDLPLGLGDYDDDISHTTYTGSAEAGYHFKLPQRWFVEPQAQVIYSRSSQTSVQGRAGVRAGRDFTLAGGATLRPYVSASYLHEFSHDDSVDFGGKSYDAELPGSRWQLGAGAALDVGAHRAYADLRYGHGANISQDLSLNIGYAYRF

SEQ ID NO: 20221 - protein, 870 aa, Bordetella parapertussis
MSKPILKKRQRTTLAALLLCTAAATHAATQSPALAFDLPAQPLDAALRAYARQAGVALSFDAREAARKQAPALRATMTAQAALQHLLRGSGLTWRAAGANRYAVVRAADAAAAWPLEPVRVYGDATRERVYTEQEIAATPASNRDLSALIATHPAIRESGTAEDGANRGTLNVEDISIHGASPYQNLFLIDGVGATSRVDPANKSRNFTDVPSNPQAYFLDTALLGEVRVFDNSIPVEYGAFNGGVVDARLRRPSGENHVKLDYRWNGSNLTRQKIAPGNAEDWLQGTPDFTPSWRKRFHTASADIALGERAGLVLGLSRRISRIERWRLGAVGHLDRPERDDSLDRVDNLLGKFSLRLDADTITDLSLKYADRREHLVSNFFRDTDWRNRHGAQGAVWNIEHTLRGGKLSAQLGWDRFDSHRNSAHTEFVQHDFVDGRPGFASGGYGKDEKGQRNLTLATRLDLAPIQTGPVSHASYVGLQVEHTGARFKRYNQSYSYRAVHREDGTEKHFSKVRHLPGSVTLDYTRLGLYASDELTWRRWTLNAGLRYDRDNFLHHRTLAPRARLDWDVLGSDDTVLSAGWSRYYGGHVLKIAMQEEFSRLSEQVLDHHGDPVPNGRKITRVNYDGLRSPYDDEWAFSLAQRAYGIRGVLTFVHRNGRDQVTRRGDSRVGYRYTNEGNSRTDGWNLTLANEEAWRLGETLWHAQASWGYQRNKRNLNLAEGYESSPVERADYVYYNGKRIPAANLPPSNFNLPHKVSLDLTGHWPRHGLTWSNTVNWHGRRKEIAFVDTGPAPEYLDMYESLSAPSYWSWDTRLIWQPPFARQVTLALDVLNVLNRIAALTTNPRDSLIDARRYRTGREIWLQVGYRY

SEQ ID NO: 20222 - protein, 613 aa, Bordetella parapertussis
MFIHRKSHRVRVGRRVHRAPASWRHCWRWRLAALAGSGAICAAPAWATGAGLDDLRQWLAPPSRKTPEVSPPGKQAAAAGMAGFGSLSAGGLDQWLAPSSRPAPVRPGSPSGSPAAPVSGASPGAPAMPSPDALPHTPPASGGDRVISGILQQDLGSWLAPDAAKRSPSEPGKAPEKIGVMPNEDLGKWLVPGAQKNNPPEPRKTLDEIRAGLEKWVAPGSKPPVEPDPDKATQEYRKDLDKWLAPPAKSGPPSAPPEAPPEAPPEAPPQAQPEAPPVVPPPAEPPAARPPAVPPARPAGDAVYLPGTRTLTPTANAAVGTASAAQGLWQAEMNALGKRMGELRLTPAAGGVWGRVFTQRQKLDNGVAREFRQTVSGFELGADTALAAAEGRWHVGAVAGYSQGSLKFRHGGTGDDDSVHVGAYATYIGNSGFYLDGIVRVSRFSHEFKVHDTQGRRVRGQYRGNGVGASLELGKRFTWPGAWYVEPQLEMAAFHAQGADYTASNGLRIKDDGTNSMLGRLGLHVGRQFDLGDGRVVQPYMKLSWLQEFDGKNTVRTNGVRHKSRLDGGRAELDLGVAAQLGKHGSLYGSYEYAKGSRQTMPWTFHVGYRYAW

SEQ ID NO: 20223 - protein, 179 aa, Bordetella parapertussis
MNRARSADAAGAVTGDNTFDASSQRNVGIGATYAFSKALIGFAYSHVGVYDPTSNAYFTGTTRPAGEHWQSWKFDHFEINGRYRVTPAFYAGAAYTYTQARADSTAGAFHPKWRPLSTKLDYDLSKRSSGFAEGVYQHAQHAMNARTGTDFDHAYIPGAANIASGPNQYVVRPALPHPF

SEQ ID NO: 20224 - protein, 282 aa, Bordetella parapertussis
MNPARKKPSLLFSSLLFSSLLFSSLLFSSLLFPSAAQAAGEGNGRGPYVQADLAYAYEHITHDYPEPTGTKKDKISTVSDYFRNIRTHSIHPRVSVGYDFGGWRIAADYARYRKWNNNKYSVNIKELLRNDNANSGGNKHLNIKTRKTEHRENGTFHAASSLGLSAVYDFDTGSRFKPYIGMRVAYGHVRHQVRSVQQETIAVTTYPQNAASSVTTNAPIRKLPHHESRSISSLGFGAVAGVGIDITPKLTLDAGYRYHNWGRLENTRFKTHEASLGVRYRF

SEQ ID NO: 20225 - protein, 339 aa, Bordetella parapertussis
MKKQVLVVAVAAALAVPAVAMADASIYGRAHVSFDYLDNDGDYSATNVSNNSSRVGVRGSQQLTDDLKGFFQVESNFEAAGDSNNGRLGTRNTFVGLEGGFGRIRAGYSDTVTKGISRATDLFGDQAGDSRNMLNGIGDQRFRNALFYTSPKLGPVTVSVEYSTNDNTNSTAADSNDDQAYSLGAVYREGPLYIGLGYEARDFANGTDNKATRLGAYYDMDAFRFTGLYQAATDAADNDLNTFGLGVRYTMGKTQLKAQYYWTDNDGTDADAAMLALGVQYNLTRQTSFYAAYAMTDNDDTATYRPAGGGHGDNIPGVVGGSSPSIISFGVMHNFKFDF

SEQ ID NO: 20226 - protein, 357 aa, Bordetella parapertussis
MKQTQPIAARARMRNVVRTLGVTATLGAGLASTFVDARAAGGAEVQLYGIVGTYVGSVKRSDTPQAAALMGSGGLTTSFWGIRGKEDLGGGVSAIFALESFFQPQNGALGRNATDPFWSRNAYLGFQGDFGRLTFGRHRNPTYTAESLVNPFGSSTVFSPLVLQTFVTNYGGTMIGDTVWNNTAQYTTPNVRGFGATVIYGLGGVAGSPGIGNLGVHFSYQGHGLTAVLSGQRVRYTAAGPVGAQYAYLAGAAYDFKVATLYAAWAMTSDVSTPTGSHTYEAGLSIPFSPADFLLAEWARTKRSGPRPANNSLRNTVSFGYDHFLSKRTDIYAIYSYDKLTARATGNTFAVGVRHTF

SEQ ID NO: 20227 - protein, 417 aa, Bordetella parapertussis
MRRLFLPLGLAVAFLSPNFAVAQSDTGTSMVPVFPREAAGPLTLEAALSLAAGSNFNLSAAAKELDSTEGGIMQARVIPNPELKTLVEDTRKSTRTSTAQMNIPIRLAASARLVSMPRKGTRELAQATLAGVRGDIRAQVIESFFSVLIAQERVKLATGSADIAARGAQAASRVAAGKISPVDETKARVEQANAELELAEATASLQSARQALTALWGNASPQFAEAQGNLDALPSRPAPELLQKELENSPLVAASRAELDRRQALVGVERSRQYPDLTVSLGAKRDTEANRNMAVIGVAIPLPIFDRNQGNLYSAIRQADKAQDEYLANRISLTRNLLMASNQLSVSRASAQTLKQTVLPGAEQAFNAATIGFEAGKFNYLDVLDAQRTLFQARIRYLGVLGQTYQAATTIDRILGR

SEQ ID NO: 20228 - protein, 2152 aa, Bordetella parapertussis
MPQRSQPFNSYTGHSGVRGHGVAPTVLVLALGFHGTAAWADCQTAGSAVTCDASSPNPYTGTVGSGASSGNLTITVGPGARIESGNAHAISVGTGNTISLDGNAQVSNSVTTGGPGNYNAGLNTIEFEHTNTLMIGADARVAAEGTDPAAHAIAFTGRTNVVTNYGTVSSASGAAIWNQLEDNFVSNTIYNYGVIETTANGGDAVVIGSATGNGATDRGMTLYNYAGGRITGNVVLGEGDDTVRLEAGSTLTGSLDGGAAGTDVLYLEGTSGSGELTQDISNFDEINKIESGATWTLSGSLGANSSGKATVVNAYNGELIVTGDNSAAAAGSAMTVWGGARLQVNTTSAMAAIQSNGSGVAAFSQQTDGTYAGVLSGGGNFAKEGAGSLTLTGVNTYTGALQLKEGKVIVSAAENLGAANSRLEFDGGTLNTTSDMTSARRTTIDAGGGTFEVAGGTTLNWTGRMLGNGTLVKEGAGTLALSGFNAHGGTVVNAGTVQISNDYGLGNGALTLNNSRLASTADIYAEAAATVNGNGTFDTANGTTLQWMGDIGGAGALVKTGAGTLLLGGDSLYAGGTVVNAGTVQVFKDASLGGGALTLNNASLASLGSFSTARAATLTGNGTFDTTVGTTLGWTGDIGGAGALVKTGQGTLVLGGDNQYAGGTTVNAGAVQVSRDANLGAAAGAVALNDARLASTGTFSTARAATLTGNGTFDTATGTTLGWTGDIGGAGALVKTGQGTLVLGGDNQYGGGTTVNAGTVQVARDANLGGAAGTVALNGGTLAASASFSSARGVTIGAGNGAMSVASGASLDWQGLIDGTGALAKEGAGTLVLGNDNQYAGGTVVNAGTVQVARDANLGAAAGAVTLDGGTLAASAGFSSARGVTIGAGNGAMSVASGASLDWQGLIGGTGALIKEGAGTLVLGNDNQYGGGTTVNGGTVQVARDANLGAAAGAVTLDGGTLAASAGFTSARGVTIGAGNGAMSVASGASLDWQGLIGGTGALIKEGAGTLVLGNDNQYGGGTTVNGGTVQVARDANLGAAAGTVALNDARLASTGTFSTARAATLTGNGTFDTATGTTLGWSGDIGGAGALVKTGQGTLVLGGDNQYAGGTTVNAGAVQVARDANLGAAAGAVALNDARLASTGTFSTARAATLTGNGTFDTATGTTLGWTGDIGGAGALVKTGQGTLVLGGDNQYGGGTTVNAGTVQVARDANLGVAAGTVALNGGTLAASASFSSARGVTIGAGNGAMSVASGASLDWQGLIGGTGALIKEGAGTLVLGNDNQYGGGTTVNGGTVQVARDANLGAAAGTVALNDARLASTGTFSTARAATLTGNGTFDTATGTTLGWSGDIGGAGALVKTGQGTLVLGGDNQYAGGTTVNAGAVQVARDANLGAAAGAVALNDARLASTGTFSTARAATLTGNGTFDTADGTTLGWTGDIGGAGALVKTGQGTLVLDGDNQYAGGTTVNAGTVQVSRDANLGAAAGAVALNDARLASTGTFSTARAATLTGNGTFDTADGTALGWTGDIGGAGALVKEGLGTLVLDGDNQYGGGTTVNAGTVQVARDANLGAAGGAVRLQGATLASTGSFASARALTLGAAGGTFATLGATTLGWDAAIDGAGGLTKTGAGDLVLSQANTYAGPTLIKEGRLAVNGSIASPVTIDPGGVLGGTGRVLGAVANSGTVAPGNSIGTLTIVGNYAGTGGRLEMEAQLGGDASPADRLVIDGGAATGRTDVVVINQGGLGGQTDQGIPLVVARNGATTTADAFSLASPVAAGAYEYKLLRGTPDGTAANAQNWYLRSGLLVPPAEVPGGGPGGAPEPEFIPFYRPEVALYAGAPMLMRAVGLQALGTYHERTGEQGLMTRDDPDPVRRGAWTRAFGRTFERSGSGDVDPRFDGHVAGLQAGVDLYARRSDQGHADLAGVFGGYANARGHMDGFARGETGAYAGKPDLNAYYIGGYWTHIGPSGWYVDAVLAGTRYEQKAKSSNDLRTEAKGWGVTASVEAGYPVPIGEKWHIEPQAQLVYQRLTVSNGEDDVSSVSYRTPDSVTARLGARLSGQYAYNTTQLRPFMEVSLLRDFAGTDTVTFSGIDRIDSRYQATAVDLTAGLVAQVRKDVGLWGQVGYGKSIGGGDGSDRGWAASLGLRIEY

SEQ ID NO: 20229 - protein, 931 aa, Bordetella parapertussis
MPPPAVPPQLPEVPAADLPRVRAPLSTYRRPQRTDFVTPAGGPFIAKQDKALNTIDLKMAHDQKLRGYRVKVAVVDEGVRSDHPLLNVEKKYGGDYMADGTRTYPDPKRQGRHGTSVALVLAGQNTDTYRGGVAPNADLYSANIGTRAGHVSDEAAFHAWSDLLGHGIKIFNNSFATEGPEGEQRVKEDRNEYQRAANKQNTYIGRLDRLVRDGALLIFAAGNGRPSGRAYSEVGSVGRTPRVEPHLQRGLIVVTAVDENGRLETWANRCGQAQQWCLAAPSTAYLPGLDKNNPDSIHVEQGTSLSAPLVTGAAVLVQDRFRWMDNDNLRTTLLTTAQDKGPYGVDPQYGWGVLDVGRAVQGPAQFAFGDFVARVTDTSTFGNDISGAGGLVVDGPGALVLAGANTYAGRTTIKRGTLDVFGSVTSAVTVEPGGTLTGIGTVGTVTNQGTVVNKEAGLHVKGDYSQTAQGLLVTDIGSLLDVSGRASLAGRLHVDDIRPGYVGGDGKSVPVIKAGAVSGVFATLTRSPGLLLNARLDYQPQAVYLTMRRAERVHAVAQRAADDGRRASVLAVAERLDAAMRELDALPESQRDAAAPAAAIGRIQRVQSRKVLQDNLYSLAGATYANAAAVNTLEQNRWMDRLENHLAQTGGERVAAIAEYRHGQLRWRPDGLQGRQRGNGIMLGLAREVSAGLSLAAALTHSRTHWDESSGAPARDNAAMTTPGVLLGARRAWDDGWFVQGALGYSRYRNQATRHISLGDAGHTVGATARGHVWQADAGLGRQWTLAPGHTLAPRAGLQLTHLRQQGFSESGAQGLGLRARALTRTVPTLWAQLQSRHAFMLGATPMTAQLQLGVWHDLRARRYAASGGFAGLAQDQGASGYWPVPRTRVQGALGLRAEFAPGLALGLGYTGQLATHWVDHQLSASLTYRY

SEQ ID NO: 20230 - protein, 340 aa, Bordetella parapertussis
MSLHPVVCLDRSRRGPGDFPLLSMTAVAMRRGVSALLGVAGTLALAAPAWAQARQDAASAAHPTWMAAAGNWQVLEGGPGVARVKQRTTGVYAGSEHALGAGLRLGGVLGLTRSTARVDDLHAKGHVNSYSLALYGARTVAAGAGDFNAVAGAAYTWHDMDTRRHFHWAGTSQTLTADTHGSTFQAFGELGYRWRASARVQIEPFAALAWRDVRTRAFVESGGWAAISAGPSRLTQTTTTLGVRGEAGYMLGPAPGKLRLTLGWRRAFGDVDPQATLVLDGGNALAATGAPIARDAVLAGLGAELALSRSAAIGLAYIGQYGGGNREHTGSLSLRWLFGA

SEQ ID NO: 20231 - protein, 734 aa, Bordetella bronchiseptica
MPDPAHFSPAHSRRLRFFAHVLHLLGALFTQHALAQEARTGNDIAQLPAISVTGREISDLTEGTNAYTTEAMSTATGLTLSPRETPQSVSVVTRQQIEDQGLTDTGAILATAPGISVTRSDSNRYSFSARGFTIDNFQFDGLVSPILSQWNYGSTDMDAAIYDHVEIVRGATGLMTGSGNPSAAVNFVRKRPLREFAATFNASVGSWDYVRGDADISVPITEDGRIRSRLVAAYSQGDSYVHFLDTRRRTFYGVVSADLTPDTVLTTSVEYQHNHSNGFGSGFPLFYSDGSRTDFNRSVANNAPWARQDTEATTYFVDLTHRFTNDWKLRAAYSHTDGRYLMKHVYRGGYPDRHTGIIAAPPAFSNYDGNLDRDDIHFSLSAPFEAFGLRHEVALGWMSIDNHSDIQRYAMVGPAPAIGSFFDWRRAHIQEPSWADTLSPADDVRTKQTGAYLVGRFALAEPLHLIVGDRWSDWKTKQMYFGSRREYRIKNQFTPYAGLTYDINDTYTAYASYTEIFQPQNARDTSGGILPPIKSKSYELGLKAAYLEGRLNTSAALFQTRQDNLAQVIPGSSIPGFPNMQASRAASGAKVEGIDLEASGQILPDWNIGASYTHFTTKDASGNPINTNHPRSLFKLYTTYRLPGALHRLTVGGGVDWQSRMYQAAASPRGNVEVEQDSYALVSLMARFDFNKKLSATLNVNNLFDKKYYDQIGFYSQGWWGAPRNVMLNLRAQY

SEQ ID NO: 20232 - protein, 385 aa, Bordetella bronchiseptica
MKKTLLAAALLAGFAGAAQAETSVTLYGIIDTGIGYNDVDFKVKGANADDSDFKYNHSRFGMINGVQNGSRWGLRGTEDLGDGLQAVFQLESGFNSGNGNSAQDGRLFGRQATIGLQSESWGRLDFGRQTNIASKYFGSIDPFGAGFGQANIGMGMSAMNTVRYDNMVMYQTPSYSGFQFGIGYSFSANDKDADAVNRVGFATADNVRAITTGLRYVNGPLNVALSYDQLNASNNQAQGEVDATPRSYGLGGSYDFEVVKLALAYARTTDGWFGGQGYPVAVTLPSGDKFGGFGVNTFADGFKANSYMVGLSAPIGGASNVFGSWQMVDPKLTGGDEKMNVFSLGYTYDLSKRTNLYAYGSYAKNFAFLEDAKSTAVGVGIRHRF

SEQ ID NO: 20233 - protein, 743 aa, Bordetella bronchiseptica
MKFYSSHPMPESLAAAIAVPLLGLLPAAQAASTAVQLPSVTVEGEYSSYQPESAQSPKFTAPLADTPRTVQVIPERLIQDQGASDLEAVLRNAPGISMTAGEGGRPASDLPFIRGQNSASSLFVDGLRDPSTQSRDTFNLEQVDVVKGPDSVFSGRGGAGGSINLVTKTPRNQDFTEVQAGIGTAETYRGTIDGNWVLGENTALRLNLLGTRDTVPGRDKAVEFSRVGIAPSLRLGLSGPTRVTLGLYHYRHRRVPDYSIPYDPRTGTPITETIGVSRRNFYGLVRRDSGDTEDYAATVKWEHDLANGFKVENLARYSRATVEQITTMPELKTADLAKGLVYRNLRASYQVNDSFANRTDLRGTFDTGQWRHTFDLGGEFATSRRSRDRYKQEIPDAASPCSPVTDGNNPALCASLRDPDPHVDFPGTVRRNHNPARYHTDILSLYGFDTIAFDEQWQLNLGLRWDHYKTSGRNLPVRGAKPPVYERAARTDNLFNYQLGLVYKPRPDGSVYASYGTASTPSAVSDYAPADSISGTSQQLKPERSEAIEIGTKWQVLDRRLLVTGAMFRETRKNTSIEVAEGLRAPAGKSRVTGMELGVAGSLTPRWDVYGGYALLDSKLVRASHKSGAQGQPLPSAPRHAFSIWSTYKLLPELTVGAGAFYRSKVYGNADAGYNKDGTPKARWVPAYWRFDAMAAYQLNKHLTAQLNVYNLLDKTYYAKTYRSHYAALGPGRSAMLTFKLSY

SEQ ID NO: 20234 - protein, 1004 aa, Bordetella bronchiseptica
MEKNVIVKSLLNTCALAALASALIAPLGVAQEQDEPAATLPVTEDETATLETVVITGSRIRRDVASTPAPVVTFGEAAFEERGLVSAGDALNEITSLRPQLNQAAGDGTSSGSGQQYPELFGLGTGRTLTLVNGRRFATTSSGLGDAQVDANIIPTGLISRIEVVQAGGAAVYGSDAIAGVVNYILKDDFDGVELDLQYGDNELGNYEQITGRITAGKNFGGGRGNVALNLEASTTPVLRFSDFPESNRSRITQGNPDDTGPDDGIPSLQEVIPAYFWNFNGNGVIFNAPAPPPFLMTTVNGAPAQFAPDGSVIPYNPGNILGIPFAEGGDGTRYSDLAGLRTGVERFTGNLIGHYDISDNLRLNTELLYAQTTGESVPQGYARTVLNQTSPSLGAIMFTRNNPFLTQSAIDTLSAANPGFGAGAPLWLSRNFYNGLFPDNVQENETTTWRALAGLEGDFDAAGRNFYWSASASYADVSGEESFWDANFANFNRAVNAVSDGAGGIVCAINADADTTNDDPSCAPLNPFGAGNISEAASRYVSARNGFEYNNEQVDLLATIGTQLFTLPAGAVDVVLAYEHRREEASFTPFEANQLGLVGTGSMEEPSSGKYNTNEYSAEVLVPIIGGDLTLPGVQALDVSGTYRFVDNSIAGEESVWSLGSRWEVTDGVTFRVTRSRNFRAPTLEQLFAPQSTVLANGGFDPCDADRIDAGPNPATRRANCEAEWAANPQYGDLATFQNPAENFSVTSVLTGGNADLLNEVSETTTFGVVLDNFIVPGLTVAADRIEIDLTDGLSAFTTADFMATCYDSTPQPAAICSAFTRLQAADGSDPAGTTATGRTTTFNAGEITFRGEVYYVNYGFDLNDLFSGATGDVTLGLEATHMAKLNTSVTGTSFTRSDNTVQRPDWTARFNAAYSTGPLRLSYQMDYLDDVLARPDATIENDPNPEIDANYVHSLSALYELREGLTLRAGVTNMFDEGPSYPTFVHGDILGRRYFAGVNYRF

SEQ ID NO: 20235 - protein, 825 aa, Bordetella bronchiseptica
MFSRSQKHPSWRLSPCVLAAALCAVAVGSADTARAQAPAASAQHYEIAAGPLADALTRFARRAGVVLSFDPALVQGRSMAGLQGVYGVRDGFAALLAGSGLQARAGGGNNWSLAALPRGGDAETLAPVTVLGLEGALAPTVGYVASASLSGTKTDTPLIETPQSISVVTRDQITEQGAQTLNQVLRYTAGVATETRGATATRLDQFSVRGFSAATYLDGMRVFGGRDALPQVDAYRLERVDVLKGPASVLYGQGGPGGVVNQVSKRPLDEPLREIEVQAGNFDFRRVNMDFSGPVDEDRRFLYRVTGAAYMSDGQVDHTRERRYFISPSFTWRPSADTTLTVLTNFQRDPDMGSYGSISAMRTLLSAPDGRRLGPNHYDGDADFEKSDRRSYSLGYQLEHRFNDTFKASQNLRFQHAEGVYRSIYGASNNNYGYLDKDYHYSQRGLAISDVDVDAFTIDNNLQARFDTGALAHTVLVGFDYQRVQTDTLSGYGSAPPLDVFDPDYHMGIERPPFTSDQTQYNYQTGLYLQDQIRLDRLSLLLGGRYDWSRTHTGTDNLANGSHSSSALAAEAFTGRVGAIYNFDNGVAPYASYSESFEPQTGTGWNNTPFKPTEGKQYEVGVKYQPPGSATLLTLAAFDIRRKNLPTTDPDPTHMCGVSRCSIQAGEVRTRGIELEAKTEPLRGLSLIAAYSYLDNEYEKAYPNTTGLDLKGKKPVAVPAHQASAWARYQLQEGPLAGLGMGAGVRYIGSSYANETNTLKVPSVTLVDMMLDYDLGRASPALKGMQVALNVSNLFDKEYIGSCLSDSWCWYGYQRSIKASLRYRW

SEQ ID NO: 20236 - protein, 747 aa, Bordetella bronchiseptica
MSSPRPPAPWRAPLALAGLSLGCAAGAYGAPAPAQTVVTLPAQEVIGDSVAAARSVLRLPEIERAQADNFASLVDQLPGISMAGSPRPGGQSLNIWGMGDTEDVKIVLDGAPKGFEKYRQGSVFIEPELIRRIEVDKGPHNLVDGNGGFGGTVKIDTKDAADLLPPGARFGALAKYGRHSNDGQDIYSVALYGRTRADGADGLLYANRRDGGDLRRPDGTRFAYSRNNQRSLLAKVNLYPDDAQTITLSAMRSNAAGWQPFAAKRDDLPAPSQADIDRYGLTEAWRRKLVHRDQLDQNYSAKWNIAPSAHPWVNLTLAYARSDTRQRDRRSSRASQSAFLGTLGNKSWVDYRDDRFDLSNESHVALGTAEHVLLAGLRWHRHRRDTLMYYPPGRGEPDYNHGYFQPHYMPSGTQTVRSLYLQDAVTVGGLTVTPGVRYDHVANTGRPNDAPRYNNPAPVAGHDYRRVSYAGWTPHLGVVWKAARGVALFADAGRTWRAPVIDEQYEVQYAKSNVSGSSRALRPERIVGLRAGAVLDYNDIATRGDSVQIRTTLFRNRGKHEIFQRRGVACRGQAEGGAASDCPKPLSNYRNLPGYTIEGLELETYYDSPAMFASLSLSAMRGHRDASPRDPWGPRTWIAEIPPVSARAMLGVKLPRLDMVLGWRGEFVRRQDRSPTDGDPLAGYWALPKTAGYALHGLFASWQPRHVKGLDVRLAADNLFNRPYHPYLGEAVSGTGRNIKLSIAQRF

SEQ ID NO: 20237 - protein, 729 aa, Bordetella bronchiseptica
MVWTTAARQRAITVTVNGMFCAATAGHAYAQVAQSANDNVKPEVTLSEIKVQDAANAASVGLVGKRTATGTKTDTPITEVPQTINVVTEQQIEMTGATDLNQALRYVPGFASFGSDSRTDLYAVLRGFTPTLFIDGLQAPNTTPIASWRVDPYMIDSITVLRGPTSVLYGAGDPGAIVDVQTRRADGERVREADVQFGNSARKQIMFDIGDRLDADGKYAYRFVGDARDGNAVTGPNADRRVALAPSFRWRPDSGTSLTLTATYLQDWNDISHNFLPAQGTVVPNPNGQLSHDVYTGDPTFNDYRKKQWSLGYQFSHDLDTIWTLTQNLRWMHLSLSDASVFGGGLAQGSTTDITRYAGLFQPNYSRFDIDNNAQARFGTGQLEHIVLLGFQYNRQTTINSVWLALAPELNIYNPVYTPVTSAIFSSPASLGHQDQYTTMNTFGVYAQEQLKWNRWTLTFGGREDWVDTHLDDHEASTQTKQDVSAFSGRVGLTYEGDYGLSPYIGYSTSFNPVIGVKMFGGGLPEPTRGTQIEAGLRWQPPGKNLMLSAAAYQINQTNVVTPAPTNLDPTGTSSVQTGEVRSRGIELSAVGNVTRELSIIASYIYQDVKNVKANDASLNNWPVDIPRPRQMASLWTDWTWHTGALAGFGIGGGIRYQSASAGAPDNSLTVASYTLYDAALHYQMRDWRFMLNAANLFDRHYISGCQSYSVCAFGNGRTLLANAKYSWQ

SEQ ID NO: 20238 - protein, 250 aa, Bordetella bronchiseptica
MSDLLCSAKLGAMTLALLLSATSLSALASVTPDRTRLIFNESDKSISVTLRNNDPKLPYLAQSWIEDEKGNKITSPLTVLPPVQRIDSMMNGQVKVQGMPDINKLPADRESMFYFNVREIPPKSNKPNTLQIALQTRIKLFWRPKALEKVSMKSPWQHKVTLTRSGQAFTVNNPTPYYVIISNASAQKNGNPAAGFSPLVIEPKTTVPLNVKMDSVPVLTYVNDFGARMPLFFQCNGNSCQVDEEQSRKG

SEQ ID NO: 20239 - protein, 646 aa, Bordetella bronchiseptica
MKRLILLFSVSVLLTVQHLEAQTAVTDTIFLQLYNDSVDLNEVVVKGKRTPVANSRWSDMSPVELVTVGGANGDLYQALQTLPGTQVQGESGRLLVRGGSSDETQTYIDGMHVLNPYTATGINSPARGRYSTFMFSGVNLESGGAPLEYGDALSAVLPLETKDKSPINKLGINASTVGFGGGGTRAFDKGSLSVNLDYQDLCVYDHIYSGRTDFEDPYRMMTGSAQFRYHPDDATLFKIYGGYDHTDFSNYEGAERRLFDLNENNFYLNTTFRKRTSGGWNWFAGVAFSFFEQKIGNVSLSTDHWMEQQQELHAKAKVFKRISPAFRLDMGVESFIRRYENRYQYQMKEAEGIDSHHEINPTISAGFLSATYYPVEQLKAELSVRTEYTSLNEKVNFSPRLAVNYYLGDVVLSATAGRYTQLPVSRLLAQENKLKSESCIQYNVGAQYEGDGRFYKAELYYKKYDRLALVEKGTVDAAEVLTSGGYGYSKGFDLFFNDRVLLKNLEYQLSYTYNIAKRKFQEYTELTTPQYATQHNASLVLKYSIPRIGTIVGLTNRFSSGRPYHNPDLPGLMNDHVKPYNSLDLGLTFLPSKKVIIHASATNILCRKNEFGRVNNKAILASNDHFFYIGVFITLGKKAAYDVSNF

SEQ ID NO: 20240 - protein, 368 aa, Bordetella bronchiseptica
MKKTLLAVALATGFAGAAQAADSVTLYGLIDAGLGYEQVKFKGQSQSRIGTVQGVSSGSRFGLRGSEDLGDGLRAVFNLEAGFGPLNGNSLQSGRLFGRQATVGLDSDAWGRLEFGRQTNLASKFFGSIDPFSVSYNSANMGTTFSAANTMRLDNMVLYQTPSLDGFKFGVGYSFSADDTLDDDSNFATAGNNRVLTTGLQYLNGPVNLALTYDRFNPNDDRAGGKSDARVQQYAIGGTYDFEVVKLAAAFGQTRDGWFVGQNMGTTPDGFNKLSSFMLADGFRANSYMIGATVPLGRSSVFGSWQRATPSNDKLTGDDATFNVYSLGYTYDFTKRTNLYAYASYGKNYAFQRDAKDTAVAMGIRHRF

SEQ ID NO: 20241 - protein, 629 aa, Bordetella bronchiseptica
MKSRSLRRCAGVLACAAPLAGHAQAGAAAGQPIPELDPVVVTAARSPQLLRNVLADASVIERDTLARAGQSSLAEVLAQQHGIEFADSGGPQSVTSLFMRGANSNQTLVLLNGQRINNANGGGIALNALPPQAIERIEIVRGAASSLYGADAIGGVINIITREPGDKALSAYANAGYGTYGTSRYDAGVSGAADGFSYSLSTGYGQSHGFNATNRRSFSYNPDKDSYYQNYATGTLGYEWRPEQKVVAQVYRSRINGGYDASASYDYNDRYIQDLQAYSLASENRLTRYWKSTLRAGYVEDKNDSRAEGMFEDNNTRFRTRQMQYLWQNDFTLAAGQTLTLAYEHLDQRADGQMSTPTGIGNYTETRRHVNSYTGVYLGDFGRHHVQASLRNDDNSQFGSHTTGGLAYGFDLTPNLRATVAANTGFRAPSFNDLYTPTSAFGYRGNPDLKPEESRNAEIGLKYQDEDSELGVVYYQTRIKNLIQVTEDCSTVENVGRARLQGFTISGAHRFGNTRLRASLDLSNPRNEDTGKQLLRRARTVLRAGIDHRFDRLLVGAEWYASDERYDYGFPEEKRLGGYGLVNLTAAYDLSRNMQVQVRWNNVLGQRYTLADGYNTAGSNAFVNLSWRM

SEQ ID NO: 20242 - protein, 182 aa, Bordetella bronchiseptica
MTQYFRALAFFLLLVPATAMACDDWPSWARGACQRVDQIWNEGGNDLYLTGYSWHNRAMYSSDKIRSFNELAWGGGLGKSIYDEDGDWQGLYAMAFLDSHSDIEPIAGYGFQKIGRIGADTRLGIGYTVFLTSRSDIMSRVPFPGILPLVSAGYRDATLYATYIPGGKGNGNVLFMFGRWEF

SEQ ID NO: 20243 - protein, 215 aa, Bordetella bronchiseptica
MVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSSLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 20244 - protein, 899 aa, Bordetella bronchiseptica
MFIHKGTTPAGRLATAVRAALAAMMLTQPAVALAAQAEASSAQAAQQKNFNIAAQPLQSAMLRFAEQAGMQVFFDEVKLDGMQAAALNGSMSVEQGLRRLIGGNPVAFRLQPQGQIVLSRLPTANGDGGALALDSLTVLGAGGNNANDWVYDEPRSVSVISREQMDNRPARHAADILEQTTGAYSSVSQQDPALSVNIRGIQDYGRVNMNIDGMRQNFQKSGHGQRNGTMYIDSELLSGVTIDKGTTGGMGSAGTLGGIATFNTVSASDFLAPGKELGGKLHASTGDNGTHFIGSGILALGNETGDILLAASERHLGDYWPGNKGDIGNIRINNDTGNYDRYAESIKNNKIPDTHYRMHSRLAKVGWNLPANQRLQLSYLQTQTASPIAGTLTNLGTRPPYELGWKRTGYTDVMARNAAFDYSLAPEDVDWLDFQAKLYYVDTQDDSDTYSTSSLLDNGYATRTRLRTYGAQAQNTSRFSLAPGHDFRANYGLEFYYDKATSDSSRQGMEGVTPAGNRSVASLFANLTYDYDGWLTLEGGLRYDRYRLRGQTGLSYPDLAKDGQRYTIDNPCKALRLTGCSTTTREDWDVDRDQGKLSPTLAVAVRPGVEWLELYTTYGKSWRPPAITETLTNGSAHSSSTQYPNPFLQPERSRAWEVGFNVQQPDLWFEGDRLVAKVGYFDTKVDNYINLAIDRNKPGLVQPSIGNAAYVNNLSKTRFRGLEYQLNYDAGVFYADLTYTHMIGKNEFCSNKAWLGGRLRYGDGSRRGNFYVEPDAASNDFVTCDGGTQFGSAAYLPGDRGSVTLGGRAFDRKLDAGVTVRFAPGYQDSSVPSNYPYLADWPKYTLFDLYASYKLTDSLTLRGSVENLTNRAYVVSYGETLANTLGRGRTVQGGVEYRF

SEQ ID NO: 20245 - protein, 1040 aa, Bordetella bronchiseptica
MPSTASACHRRATVLALAISTALLPLAWVPVVQAQPAVVAPLRPYTIPEQPLADAVRAFGRQADVQVVFRSDLVEGRRSSAVKGEYSQMQALQQLLRGSGVRAQRGMDGTWSLRAAAEAGEGEGVRVTETLDVAGRLHSEGGEARDRRGYDDVFALDLTTAYSGRDRVERYRGSNPADVVKDLVGVFSGDARNSGALDVNIRGIQGPGRVPVSIDGGEQALTVWRGYNGVSNRNYIDPNLIGGIQVIKGPGLVRDVHSGIGGALVIKTIDVVDIVAAGERFGGELKMEGSSNAVAPRLPRLHTGEDYRTVPGFPQGSPNSPYDDRTLVVPVKSRSGNNPFDGEDQAWRLALGVRGDNVDLMAAYAWRKRGNYFSGSKGSAYYDQDRREQYEYQGIDYITTLARYFKPGDEVPNTSSEQESWLVKGTWQINDDQQLKATWRRTLSHYGEIMPSRILSAPDYGRIQWPLSRVASDAWNLEYRFQPAGSRWLDVYANLWRTETESDTYTAGGFPNFAPGNPAWNPGVSPILRNTALANARNDRTGLTLSNRFALHSTLDLTVGGNWQYEKLGSRDPYFGTTDGWRMFPRTGRRQEGEGYLNLEWRPVEFLTLNAGVRYSRYWAFDDFLQAHPELLTKGVGSKEATYRVNELPERPASLQAQIDALEADREFWESIGMGSVVDDALRGLLAYYETPQAVEHRVPWLPDANGNYARATNPCLNGEVAAIPGVLPLYAGSDRVCNIGNTMQSRPVDGRNDRQRDHAWLPTFSATVNLSKAARVYLRYSEAVRFPSMFESTIAFSSSLNPLYTLKPEHAYNYEFGYVHNLSGLFGNTADADVKLAYYVHKTRNVIERDAYFLFDNIDKQTIRGIELQARFDNRRFFTDLGISRTLENEVCDESSAVLLDANRGLVPNCVQDGFVSGYLLTQAIPKLSVNWSLGTRLFDERLELGSRIVHYQRHDNPDLQAYRDRLLAGGSSLLWQNVPFTWGNITTVDAYARWRVNDHASVELVGSNLGNRYYVDPATRSTLPAPGRTFKLGITARF

SEQ ID NO: 20246 - protein, 698 aa, Bordetella bronchiseptica
MLGAGITAQAQTGASGDGVTRTALEEIVVTAELRNTPWLLQPSSSSVVGAEQIKERNAIHLENLLILAPNVNLSGGTSRARFYQIRGVGERSQFVDPLNPSVGLLIDGIDFSGLGSGATLFDIEQVEVLRGPQGTLHGANALAGLINMRSAAPESEFSARLQSTVGDYGRRELGVSVTGPLAGDSLLFRLAAFEHRSDGFIDNSFLNRSDTNDRNEGVYRGRLQWLPSDRQSLDITLSHVDIDNGYDAFSLDNTRTTLSDMPGNDRQQSDALGLHHRWSGDRVLTELMASAAATDTDYSYDEDWSFVGIAPELEYSSFDRYLRERDSYSVQLRLSSADALSTGAGDLSWTAGLYALNDDESLRREYTYLAEDFRSRFTAETRAAYGQLDLAVTERWTLSGGLRLASRSMSYDDSNAVEADPDNDLWGGKLSLQYERESLGMVYLSLSRGYRAGGVNAGILAFPEDQLQSPDSLRDLQFFDEELLYNLEIGHKGEFFEGRLQSAATLFYMDRRDQQVRGSRVIPREDGSTAFVDFTDNAAAGYNLGLEWELRGAVSNSVELYLNTGLLRARFDEYINADGRDLEDREQAHAPSYQFAAGVLWRPTMHWQADLQWEGRDSFYFSDRHDEKSDAYSLLHLRLAYQRDNWEIALWGRNLLDEDYFIRGFGSFGNDPRKGYVTEAYRQFGDPRQMGLSVELRL

SEQ ID NO: 20247 - protein, 937 aa, Bordetella bronchiseptica
MLRSVSPLFSLPVSGRRQPVRMVASAARPVLAVALGGAMIGAPLARAEHWSGATIKKTGQGEIGIEVPDKTAALHTGPWGARKMTVETTGARGVGVLLDKTGVSLTLEEAAITSSGDLGLDSSYQPRGTVMVRAGALTARGTTIRNRYGSSAGDWSRRPLALRVAGPDASLILSDSTVEGEQGMQLVSRARADIVRSTVRGLHATGLSIKYAAKASLADSEVLGERAARVDGDGELAARNTRFSGRSGLLLSSGGRADLSGGSLAASNGSALDLYGGVEGQLRDVEVSAQGAPAIDLVSTLAGDSAGDSPARRDPVLRVVGGSISVAGAHAPALSLGGGQARLDTVDVRTAGSPAVELVAGALGVAGGTVNAGQAPVFVTGAYDAVLAAANVFLRPAKAAPQDGMPAVTVTLSGAKVGGAQLLRQTTPVPVRLVLRGAAVAQGDVVRAPETAPEKDGFGTPVRPGLRVGLDQAPLELDVADGAQWHGATQSLDRLALGAGGQWRMSAASSVGELSMEPGAAVVFGDAAGPGFQTLTVRTLAGAGSFEMRADAALEHADQLVVTDQAEGRHRVWLRAPAGAEPSKAQAVLVRAPADGKASFELDGSDGRADFGTYRYGLAQQPGGAWGLVRTGYSSTAAAALDTGGLGAVQGLWYAESNALGKRMGELRLNPDAGGAWGRAFSQRQRISPRAGRHFQQGVSGIELGADRAWPVAGGRWHAGGLLGYTRASRGFSGQGKGHTDSVHVGGYATYIGANGVYADATLRASRFENSFDVPGWAGRTVSGSYRANGVGVTLEAGRRLALDRHWFVEPQAELAWFRAGGGTYTASNGLRIEDDGGTSLQARVGAQAGRRFDLRGGAVVQPYAQLSWVQELKGVSTVRTNGIAHRTDLGAGRVELGLGVAAALGKGHNLYASYEYAHGPRLSLPWTVQLGYRYAW

SEQ ID NO: 20248 - protein, 877 aa, Bordetella bronchiseptica
MKYYLFTAVLAVTIPIAALGNEIPVNNNPVNQVENAKLTEIKAINLEEVDKGISIIIETASGEIPEGEIIENSTDVVIKLSNVKLNLPDGNNFIKDKPIPGINSLTVTQQSATEVEIKIVGDGTLPNVEQRESQKGLALSVIPTPKAVAAENTIELNVVGNRDANETAPANVTIIDREQIEKQQARDVRDLLRYEPGISVPYDSRGGLQGINLRGLSGNRVNLQVDGIRLPYEYSYGATRLGRDFVDIETLNALEIFRGNNSAVLGSDALGGTVNFATARTGSLLENIGKDSYTSVRAQYSSKDSGFVGTFVQANRLDNIDTLFIYTRRDSGSLKVAGGNSIYQDDQDRTRNNFLGKLTYNFNQESFLELTGEYFNNITDSRFSTANLPGMVFEASTQDLQEEVTTTRSRFSLGYQYDNPNSKSWLQFVRANLYYQNAIIEEDSNRSVRSAGTIRTEAADKDLTDRIFGANVQLRSDFNIGDIKNSLTSGLEISHNYNERNYFNFITTTGTRVNAAGFPQKDFPDSDTFRLGTYLQNEISFGDGKVKLIPGLRFDVYNLSTANNPEFTQKQQGVDAVNYSTSALSPSLGIVYEPSPGLTLFSRYSRGFRPPLYSELNFAFRADIPLRPHKGISNPNLQAETSNNFELGLRSRSQQFDFDITGFYNRYRNFIEPSVFVGFDTNDFGTFRTAGRAIPFQIFQAQNIPDAEIFGLEIKTAYRFSPEPGGFSLKGALGWQIGNDLTKDIPLTTINPLQAVIGLGYQSPNDTWGAELIGTFVAQAREQALVDDQTSVQNGGQATRKIDFYEPDAYTLVDLVGYYNINPHLTLTAGVYNIFNTEYYQYADVRTINSNATAFAAQRGRYAQPGTNFAISLNWRF

SEQ ID NO: 20249 - protein, 761 aa, Bordetella bronchiseptica
MKPHHTQLRPFRRRGISLALAAALLSAGIPTAFAVEETTKAENKQTSADQEAQPALGTVTVTATRREASLQSIPVAVSVLDGRKLEQSNLNSIQTIANEVPSLTFRQQGGNKDSSIFIRGVGTISTSPGIEPTVSTVIDGVVYARPGQATLDLMDVERIEILRGPQGTLFGKNASAGVINIVTKEPSADLHAYVDTSYYEGGEKRIRFGLSGTLVPDLLYASINGLWADYDGNVKNLLGGRLNGYEREGARAKFLLTPNEDLDITLIADYTHGTNGVIAVPYQTTDSTFTQAISPVQVSKGNRTVRSDGKNEVTDTNQGISAQVDWRINDYTLTSITAFRTWDNKQNTSVSGIGNNYDPARIATGYPATWDRGTVDSSQFSQEVRIASPKDKFVEYVAGVYYLKSKTDEVYQRYAETISGANYFGRSDYGVENDSISLFGESTLNFTPEFRGIAGLRYTHDELSFDHVRNSNVPSGIQSAVRASQPLRKGTTSASEYSGRLGAQYDLSKDAMVYATYSRGYKGPAYNVFFNMFDGNNDTAPLEPETANSFEIGLKSALLDNRLIFNAAAFYTKYKNYQANAPEHVGNNVYIYRLINAGEVSTRGVELDVNAKVTSRLSFSGSLAYVDARIDNLNCPPTDAACQVNGKPLPFSPKWKSAVRANYAIPLNNGYVIDLGTDYIWQSKQQFSLIPQTDATIQEAYGIWNASVALSTQDGWRFALVGRNLLDRSYASTLSGNASVAQRYVPRDDARYFGVQVRKDF

SEQ ID NO: 20250 - protein, 718 aa, Bordetella bronchiseptica
MKKQVVEYVRCGVPRLRPVMASLALAACHGLASAAPALPPATVGMGMHQLAVPMGTTFIPMAMSSDATVLAGTGSVPGLGPHAAMWPLSNPFPYYVIAGDRSSFHALSQDGSVGVGVVVSGGLSQAVRWDNGSWFQPLGVGTDGATQSYASGVSADGSVVVGWLTWDGAGERRPFRWTQATGVQTLSGFESYSFALASGISADGKVVVGDVYTDGALITPNAYRWTATDGIDLLPHVAGGTSSRAAATNSDGSVVVGTAYGSSFGGARAFRWTQAGGSANLGTIAGGEAGQSFASAVNADGSVVVGYVDRTGIGLLTEQSAFRWTQAGGMLTVEQWLRGHGYTIADGQTWRALAVNADGTIVMGMMQNGDTFVARTPADKVPDPVSPGGGEPAPQPGGQPGSQPGGGGLITLREFASSLGGTAALPASLTSSTDMLLHGAHGSPLRSLVPAGKVGMWTTGDWGRTEHGGQDGIAAVGEAGLSYRFNEQVQLNLAVGGGNMRQYLEYDGKSTARQTYVMPELLWNLPSTPLWLTASALYADGDLNVRRGYLNAGVDDRSSGKASLRTTAARLRLDWRDALAWERAALTPYLDYSYIRTRVGSYTEHGGGFPARWDARTDHANVARLGVDATVQVGGNVQLLGTVEASHRFESHNSGASGQVIGLMPFELDGASTQRNWLRFGAGVQAPVGLGTASLMLNTTTHSSMPSYWLAATYRLAF

SEQ ID NO: 20251 - protein, 796 aa, Bordetella bronchiseptica
MAQANRTTSFIRLFAAGSTAALALGIATPSFAQDAQAQADQAPTTGEIVVTAQFREQRLQDTPLSITAVDASLLASRNQTDISQIAAQAPNVQLTQMGGAFGSSMAAYIRGIGQYDFNPAYEPGVGIYVDDVYYATLTGSVMDLLDLDRVEVLRGPQGTLTGRNSIGGAIKLFSAKPTEGNSGTVEATYGSRQRVDLRATANFELTDGLYARISGVFKRQDGYVDQIDYGCANPDNELGIGGNASTPADCVVAKLGEKNYSGIRGSLRYNPSDTIDWIVTGDYTYENRTNAAGVMSATDPSKTGGVDFTCGKFCTYASWYMPEGGQATQAYYNPNTTKFEGWGVSSNLTVGISDSLKLQAITAYRKYNQIFGTDDDYTPYSLIGGSGFNDLDFKFFSQELRLNGQVGDNIDWTIGGFYNNQTSVYFTRQDIRYIVPIGVPSLFLQFQGNDPIKANSKAAFGTVIFHPTEAMTVTGGIRYTKEHKDYTFVRQAWDGGTLTDPFGVGALDGSKAVYDGDKVDWRLSLDYRFSPEVLAYATVSTGFKGGGVTARPFTKNQAINGTFDPETLHAYEVGLKTDLFDRRLRLNLSGFYNDYKNIQLPIGDCSALDGFEPGTDPFPCAAIQNAGDGEMYGLEAELSAHPVEGLDIDASLSWIDGKWKRIDTAAQGALRVTDPITTPAWRGSFGIQYKALLGNNAGSITPRFDLSYTGKQTIGRLINSGEFGPLQYNPSITLANARVTWKNEDENLAVSFEVQNLFDKYYYLPLRFAAVYAFVGTAYSNVGRPREWAVTVQKKF

SEQ ID NO: 20252 - protein, 990 aa, Bordetella bronchiseptica
MDVSMSNKYFELNRTTKTLGNIFPALLIFTPILASAGTIDQSTSVPQEFRDDAEYIINKDVTISSSGSTPAVNASGINITTLTNQGNISGTENGLQVNTGAQKVTIDNEAGATISSMTANALNVESMRGDIINKGSIIGRQIGVFIGENSSTINVENTTTGIIKGNTGLTAKVGIAIDNAGTISGVNGDGVALNDGNTKISNSGNIQGSQYGINITGNAKVDITNSGTLSGENAAVMFASNKNNTLVLNTGSSLTGDVISTVSTGNTLTFVGTGTEDSNFVGLNEGDGFASVKMNGESWALSGDLDIIGSGDALQVNSGNLILTGDVANSGNTLVAQNATLQLGNGQDTATLSGGMTNNGTLVFNQGSDFTYATDITGSGNIEKADAHTLTLSGKNTYTGNTVLHSGTTLVTAGAQLGVQGSNATVTIENGATFASAGQVNDNIDILSGGTLAAWNAVQGNATLSTSGVDTINGNVTNSGTVLLSAANNSVGNNFVINGDYTGSAGSQIVMNSELGADNAPTDHLTITGSSFGQSGVTVSNMGGLGAQTVNGMEIVSVGGSSEAQLTLAKPVVAGAYEYNLYQHSDGNWYLESKATPSDDPADDTDGGDKPDDGGNKPDDGGNTDGGGNTDGGGNTDDGGNTDGGGNTDNGGNSDNGGNTDNGGNSDNGGDADNGGNAAPEVMAPEVGAYLGNYLAAQSMFLHKRDDRDQITFRNEEDLNTWMYVKGRYHENDAGGDKVNYDTTTTVLQVGSDFMSKPMDNGILRAGGMFGAGQAKTHSDAKHNVRDAQGKVDGFNVGLYATWQEDQKLRLGNYIDTWAAYSWYNNKVTSNRNDEDYDSEGFAASVEVGHAWIIASENERTWKIEPQAQVIYSYLDQENHTDRDGVRITTLDNDTFFGRLGVKSSYFQQKDVKAWQPYVAVNWLKGAGQNDLAFNDETVSNDTPDDRGQLELGVTGNLNDTTTISLRASGEWGENSYAAYGGHILLNHRW

SEQ ID NO: 20253 - protein, 415 aa, Bordetella bronchiseptica
MKPTSILARLPRYLGACALAALAVAPLAPAQAQTPLPAGLGAAEVRQYLSGLPSDALRQQASWLAPALLRPYLSGLTDAQLRQYVQALTPGQITQGLAALTPAQRARLQREFERQARRQVQQAVRAEVAARSARAVAMGQSASMLLLDAEMGTLAQRQGDLRRGHDEGAFWARGSANRFKVDTPDTPAFDLRVEYLTLGADHGWRLDTGRLYLGAYAGVSRARMDDNDIMHGRIESRFLGTYLTYVDNGGFYVDAVSKLGRIDESVSFDLPLELGDYDDDISHTTYTGSVEAGYHFRLPQRWFVEPQAQVIYSRSSQTSVQGRAGVRAGRDFTLAGGATLRPYVSASYLHEFSHDDSVDFGGKSYDAELPGSRWQLGAGAALDVGAHRAYADLRYGHGANISQDLSLNIGYAYRF

SEQ ID NO: 20254 - protein, 993 aa, Bordetella bronchiseptica
MNDRKSNSMSPAARYLRFGVVAVAGVAAGALPSSDVDAQAAPAAAEVAKIEALSDADIYSDYEHEHGIVMTPDGKDDYISYRSAESGRPKPPPPLSNFKPLGNDVVAERIRVEVHGDETLGVYVDSEHRSLTVRDSTIDAYGKPPSVDSPDYYGAAAVYAGTLNIENSTVHHNYAAQPFEDAVGVGVTSLGDKAILNVTDSEVSGARGAVIGWGGEATFTDSVLRGSAFGLYAEMCDTCRDDDGTSPSIRVQGGVVQGGMGANNVAVVATGSGKVAIENAELLGASGMYATFGAQVDMKGGRILAHNTNILGSQGYADGPYGGVVVTEDGQVNLEGAKVSATGLGAAGLWLLGDKDTSPRASLRNTDVHGEVAAIALGFNGEANISGGSLSVEDGAVLTTLTPDAVEYYYDYALSMEHLPADAPLTPVRVTLSDGARASGETLIAHGGLLPMTLRLSSGVDARGDIVTLPPSAPPDSAEQPDAEPEPDAELEPDAAAQSDAKANARVMAQVDGGEPVAVPIPAPSHPDAPIDVFIDSGAQWRGMTKTVNALRIEDGTWTVTGSSTVNSLHLQAGKVAYATPAESDGEFKHLRVKTLSGSGLFEMNASADLSDGDLLVVSDEASGQHKVLVRGAGTEPTGVESLTLVELPEGSQTKFTLANRGGVVDAGAFRYRLTPDNGVWGLERTSQLSAVANAALNTGGVGAASSIWYAEGNALSKRLGELRLDPGAGGFWGRTFAQKQQLDNKAGRRFDQKVYGFELGADHAIAGQQGRWHVGGLLGYTRARRSFIDDGAGHTDSAHIGAYAAYVADNGFYFDSTLRASRFENDFTVTATDAVSVRGKYRANGVGATLEAGKRFTLHDGWFVEPQSEVSLFHASGGTYRAANNLSVKDEGGTSAVLRLGLAAGRRIDLGKDRVIQPYATLSWLQEFKGVTTVRTNGYGLRTDLSGGRAELALGLAAALGRGHQLYTSYEYAKGNKLTLPWTFHLGYRYTW

SEQ ID NO: 20255 - protein, 803 aa, Bordetella bronchiseptica
MAQTATITGVVLGENNTPLTQVNITSGNNGTTTDETGFYILELIAEQENRITFSFVGHKDVVLESLILNTNETYVFNPVLNTEIIQIDGVTVSATGEKTVQGINAISTKKVRQIPGVNAGVENILKLLPGVSSNNELSTQYSVRGGNYDENLVYVNEIEVYRPFLIRSAQQEGLSFINSNLIQKVDFSPGGFQAKYGDKLSSVLDITYKNPKAFGAQMDFSLLGASLAIETLSKNKKLSNVTGIRYRNNSLLVNSQQTNSNFNPVFADIQSYFTYRISNKVHLNILGNLSLNDYQNQPLNRQTNFGTLSEPKALLVHYTGNENNRYATALGAIKTDYHLNDDVTLKFITSIYHTTEEEYSDVIAQYELGDIDTDLGSETLGKVISTRGVGGQFTRARNDLDALIFNLEQKGVYSKANHKLEWGIKYTHEDIRDQLRESEFLDSAGYSIRPPLPEFSNNQPEMPFDSPLVPYQGISAKNFVKTNRFSAYTQFSQNQTLENSHIYYNLGIRTQHWQVKGQNIEKNSHIVFSPRGQFAIKPKWKRDMLFRASLGMYHQPPFYRELRDATGTIQPNVKAQKSIHYVLGSEYSFLLWERPFTLISEAYYKKLNNVNPYTLHDVRIRYSATNNAKAFVYGAEVRLNGAFVPGTDSWVSLGYLKTEENIDNRGYISRPTDQRFKLGILFQDYVPDIPNLKMYLNLVYNTGLPGGSPNFSDPYVFQNRLKDYKRADLGISHIFVDADKSYPENHWLNKFKELSVGFEIFNLFNNKNSITNTWVRDIDSKNEFAVPNFMTARVLNLQLKMRF

SEQ ID NO: 20256 - protein, 745 aa, Bordetella bronchiseptica
MAPIVAAAALLGAPPAGAESPASAYAPTLATRADLTLDPVVVTATRSRTALSRTPASVSVVSDTDLEEQQADNLKEALRYEPGVTVRRSAFRPTSAASSGSTGGLGGNQGINIRGLDGNRILLMEDGIRLPAAFAYGPLNAGRGDYADMALLRSIEILRGPASSLYGSDGLTGAVNFTTKNPQDLLDVFGKASYFGLRSGYDSTDRSFGTTVSTALGGERFQGMLIADGRRGHAVDNQGSNGSVGAARTTPNPQDTYNTALLGKLVFKATASDTFKLTGESVRQRIDSDALSAVTSTLRSLRSADRLENQRVSLDYDYADADNRWFQRVHSLIYFRRAEIEQAQDETNAASQRSRDNHYRDRTFGLSSQLESSFLTGTLSHKLVYGVDASVSRIDSDRSGTGPAASDNFANKVFPDTGYTLLGAFVQDEIRRGGLSVIPALRYDSYRLTPRNPGDPLYTGAQAGSSDGALSPKLALMYAFAPAATAYVQYARGFRTPTPDQVNNSFTSTAGARVYYRSIGNPGLKPETSDTVEVGLRGKLDTTQGPMHYSVAAFAGRYRNFIDQVTIGGSITSPANPLTYQYVNVSRAFIRGVEARGEWRLPVGVKLRAAAAYTRGTAEDANGASTPLNSINPLQAVFGARYEPGERWFAQTDMTWQMAKSPSAIRPPGTGATADFATPSSLVVDVSGGYRLNRHATLYLAVRNVFDRKVWNWSDVAGLGLANSTVLDAYTAPGRTFAASVKIEF

SEQ ID NO: 20257 - protein, 785 aa, Bordetella bronchiseptica
MNGRSVTAALSRTALVGGVVAAGLVLMAAAVSAQERLPEIEVISNTPLPGGGVDRDKIPSNTSSVSSTDIERSYSPNLTDTLFQRIPGVTLSDPNGNNVQQEIRYRGFAASPLQGTPQGLAVYMNGVRINESFGDTVNWDLIPTNAISRADVFTNNPVFGLNALGGAISLQMKNGFTWQGFEQVVQGGSFGRIQGATQYGAQFGNWSTYFAAEAFREQGWRTASPAKVGRFYGDVGWRDDRTELHLFATAAKTAFGVAAATPIQLLARDWSSVYTTPQTTDNDVLMIGMNGKHALTDTWSLQGNVYGRFFRQKHVDGNDAELEECNGGTLCLDDDPILSVATNLPIPCAVNCEDVPYGTIDRTRTRSDTFGGSLQATNDAKLFDHGNHFVVGGSIDRGKTNFGATSTLGYIFPDLTVGSNNSIPGNGAVIRTLSDLGYSPVTIDTKNTYYGLYIADTFDITEKLAATAGARYNLAKISVRDALGTSPDLNSDSTFNRLNPLVGLTYKVAPWLTAFGGYSESNRAPTPLELGCSNPDKPCLLESFLVSDPPLEQVVGHTYEAGLRGASPFADGKLEWKAGVFRTDSDNDIITLASTIAGRGYYQNVPRTRRQGVELSAEYKSSQWLVYAGYSYIDATYRFNAALASPNNPLADADGNIHVVSGNRIPGIPQHQFKAGVDYLVTPEWKIGADVVAVSDRYYIGDDTNQNVTLPGYAVVNLHTSYKVNKDITLFALVNNLFDKKYGLTGTYFEADGTANAGLPITLTDPRTLVPGQPFAIYGGIRVKL

SEQ ID NO: 20258 - protein, 848 aa, Bordetella bronchiseptica
MDNRSTFFTDQTQGVFMIIKIISLYHGFLFGLVLAAGLFISANVAAQSAVTQQTIAIDIAAQPLEQAITQLATQAGLLIGVDVSLVAGKQAPALNGRFTPLQAIGQLLKGSGLTVVENAPGRYTLEAAPAGHTNSNAEAVTLPEMKITSVIDPDAPDNPSYQKTKAFSATKTDTSIMETPFSVQVVPRAVMDDQKSTKVKDALENVSGVRPQPSLGGGGGFIIRGFRTGNIYRNGLLSSEGFFGDFDASNLDSIEVLKGPAQLYGRTEPGGLISVITKRGLEIPYYSVEQQFGSYDYFRTQWDAGGPVTEDKKLLYRFSGAYQSNNSFRDFISGDRKVFNPSLTWRPTDATDVTIDIEGTEKFASADFGIPVIGNRPAPIPISRNLGDPNTPTGDQSSVKVGSEINHRFSENWAIHHRFLASLTDGSTTFVNPAPAFNAVAALNPATGLLQRNIFTQNSEQEHYATNLDVTGKFDLGFSRHQVLVGFDFYRTYNKYGTKGQWIVPDPNLAINIYNPYPSYGISQSTFDTAFLTSSAPGTNFSVIYNNWYGVYFQDQITLWDKLHIIGGGRYDWAETGRGRSDNFDTADSLVKPNIRKDQGFSPKAGILYEPWKELSIYGSWTTSFGANNAPAADGRTFDPQTAEQFEAGVKTQLFDRRLTGTLAYYHLTKDNILVNDLSTADPFDKIANKQRSQGIELDISGYITDSFSVIASYAFTDTRILKDYSGATAGNRLANVPKHAGSVWLRYDVKKFAPLNGLSFGLGVFAAGKREGDVQNTFQLPGYARLDAFAAYRMKLGPTRLTAQINARNILDKRYYESTDPDSNVAPRLGVYPGAPLTILGSLRLEY

SEQ ID NO: 20259 - protein, 630 aa, Bordetella bronchiseptica
MVGRSAVIRAAVLWTSIAAGTGAAHAQQFSNFYVFGDSLSDAGTYYVVIDGQLQSVRFTVNPAPVWDMLVGEHYGLGVSPYLAIDTVTKTSTVVGGNNYAQGGACVNSGFNYTKCVAYPDNTLGETQQLEIYLASTGGVAQPNALYSMWAGANDIFTQAIYLSYQLVSEEKAIENVVAAANQHVENIATLSKAGARYIIVPNLPDISKAPVTSLLPQGQFFSDSVNAYNATLYNDLRHLGGSNIIYVDDYALVNEVIANPTLYGFTNVTDKACQQDFAITCTTNTLVAPNAQNDYLFADVVHPTPAGHELLAQYIESIIEAPGLIGLLAESPIYVGRGIYRTLDTRIGTGTPKGFQLYTNIDYSTYTLDPTRDHSGSDGSAAAGYVGLEYGFGNGISVGALLSYGSGSYNFSAQNGGYDADMFNGTIYANARFGGAFAQLSGTVGSIDYNSIKRQFLLGAAVRTNMGDTSGTYYGARLATGYDFTMGQATVTPLAQLTYQQATVDGYAETAGNSSSMLFGNQLRELFYATVGGQASYAFVLSGVTVRPNVQATYNYDFLNQDRSVTAGLLTAPVTFAMPVYQPGRSWTNLAVGLALEAANGLTCNFTLGELLGQDQVSSAYVNGGIAYKF

SEQ ID NO: 20260 - protein, 732 aa, Bordetella bronchiseptica
MKQTSLYYAALGLAGLALAAPACAQEQQVPAQLETVVVHGAPEANGPLDLDAVDSTGSRLGLTLRETPASVTVINREQIEARGALDTQEIARGIVGVDNASPPGSAGSVSYRGFSGSQVSQLFNGISVQYDVIAARPIDSWIYDRVEAIGGPSSFLFGAGAVGGAINYVTKVAQRDTFYDGQLRLGSYGARQASVGLNRQLAGEPGGRGQYLRIDANANASDGWVDGNRSHAEQVAASLLSDLGERVTHTLALEYQHETVHRPYWGTPLTTDGDGVVRGEGHIRGGTRFKNYNVDDGQYEQSVWWLRSLTEWQASDRLSFRNTLYYYRADRDFQNLETYRYNLGNSQVLRSGALLQRHEQRLLGNRIEALYHGSLGGLRSDWSFGADYSVNRQTRYPTSVAGQVDSVDPYEFDPGEFYDIPGMRRGHVPDRDNKVRTLAFMLENRTEVGGGVALVTALRHDIIDLDLTNRRAASAASPGHASRRYNPTTGRVAVNWEVSPGATLYAQYATAADPPSGVLSTATFADVLNNDKLTTGIQVEAGGKFAFWDGRGTATVAVYEIKRKNLATPDPLNPGSSLPVGSQSARGLELAGGLQLTRALSLQANLALVDPRYDDFSQNVGGVAVSRNGKVPVNTPRRLANVWLDYAFAPDWRASLAARHVGKTYADAANTVWAPAYTVFDAALSHRIDRHFSVMARVRNLTDKVYAASVTGAPMYYLGAPRSVELALQARF

SEQ ID NO: 20261 - protein, 811 aa, Bordetella bronchiseptica
MSIRLPASPLGLAIALALSSTAVPALAQDATNLDTVIVTGTRAADRTVLESTSPVDVLTAEDIRKAGVVNGELGSALQALLPSFNFPRQSNSGGADHVRAAQLRGLSPDQVLVLVNGKRRHHTALVNTDSKIGKGTTPVDFNSIPVSAIKRIEVLRDGAGALYGSDAVAGVINVILDNGGDGGEIEASYGAHHTDLKPIGRTLTDGQTGNISAKVGTSLGEDGGFLRVGLEYKHRNGTNRAGFDQIPPWDQTPDNLALQGKRNYVLGDGKSKDINLWLNTEIPVGQTSTFYAFGTFNQRDTEGANYFRYPDGDANWKQVYPNGYRPISEGENRDVQAVAGVRGQWGEWSYDGSLDYGQNDFTYRLRDSLNASLGPTSPTRFKTADYKYAQTVGNLDLSRVFTQSDSISHTLGLGVEARHERYQTRPGDPASYAAGPYTDRPTGSQAGGGLTPQDAARLSRDVASAYASLSSQFGEKFSTDLAARYEHNDDFGGELTGKLGLRYKFTPAFALRGAISNNFRAPSLAQIGYESTSTGYNAGGQLVQGRLLSVNNPIARGLGAQNLKPEKSINTSLGFTSRIGEHFDLSLDFFQIDIDDRIALSESITGAALTDYVAANYGVTGLQSASFFVNAADTRTRGAELVSNWRQSLGDGQLLLTGTYAYTKTTLKNVLATPAQLRALNPDYVLFGIEETNTLTDATPRTRGSFSAAWSNDHWSLSTRVNRYGSATRVFNFGDGYIPRQTYQAEWQLDAEVEYRITPQWSVAIGGQNLTDNYPDRSNSDIHYFGNLPYDVLSPIGSNGAYYYGRVRYTF

SEQ ID NO: 20262 - protein, 848 aa, Bordetella bronchiseptica
MNTLRGSLIASVALLPGIAQAQQSVALDEISVVATTPVGASAGTGAPALPVLGGPAGASLQLPSTERLRGGAQPLYKIPSTVESVTRAELEFDRATFNVTETLARRVPGLNISDAQGNNNRIDINYRGFQASPVTGVPQGLAVYQNGVRINEAFGDVVNLDLIPQVAISRIDIVTGNPVFGLNALGGAINIQMKNGFTWQGTELTALGGSDGRIAGSLQYGTMIGPWSFYFAGEGLKDDGWRYKSPSEIGRVYADLGYRTPDAEFHLIGQLARTFYGATSATPVDFSRVNEQAIFTNPQTITTELGTLQLTGRVDISPTWDLAGNAYFRRFSQSYVDGNDGNFENCSTRSSFRGRLCFEDDGFSPSAGQSQLDFRNQFLILGRGAAANGIPFTPGVPYGTLDVTKSESTGYGGSLQAANRDRVFGFNNSFVVGGSIDVADYSFKSSSTLGVINPTDLLVATNPSNPFYGNIPGLGTDFLRTAGALGIAPSSVIGSNLYMGLYTTDTIDLTDALSLTAGARLNFARISTQDLTGFSPDVNGTHYFAKINPLVGLTYRYSEAVSLYGGYSESNRAPTPLELACANPLRPCLLPNSLVADPPLKQVTGQTYEVGFRGTLPNFYDGGLVNYKIGAFRTDLTNDILQLATPGNAARGYFINVPATRRQGIEIGTEYVADWLSVYANYALVDATFQFTDTLSSPNNPLSDDGAINVRPGNKVPLIPAHQFKVGFDVEVLPRWRVGLALQAYSSSYFRGDESNLNRKLPSYYVLSLNTSYRVDRNLELFGYMTNLTNNRYATFGTFAEPGRVAGNFVINDPRTTTLAQPLSIYGGVRYTFGEATAPMPEPIIRKF

SEQ ID NO: 20263 - protein, 224 aa, Bordetella bronchiseptica
MLRHITFTVFITTSMNTLATGMVPETSVLLVDEKRGEASINIKNTDDHPSLLYTTIVDLPESNKSIRLIPTQPVIRVEAGQVQQVRFLLQATVPLQSEELKRVTFEGIPPKDDKSSRVTVSIRQDLPVLIHPASLPEERETWKFLEWRKNGDQIEISNPSNYVVRMTLQFKTLPSGKTGAINKTYFLPHTSTTTALTNATDTKVEFYPASRYGYRGNKYVTDLK

SEQ ID NO: 20264 - protein, 218 aa, Bordetella bronchiseptica
MIAELIAISLDATPIKNPSKAQYKEAHEKLYRSIINRQKLTRQKSGWYFLGGFGALEAIKDYQGKEVKNWIVTFNLKTGVQSFFRKYIGIRGVFAWDLGAGRVNYQRHKDPTNSFFTMLAVGLDIIMEFPLGSYKHYLGAFGGAGGALVVYADRQDFKFFRHAVYSGGLVIDGGVMLTLFLRHRLEVGFKILPTARLLSDSQRFETSPLFYAAYSYKF

SEQ ID NO: 20265 - protein, 644 aa, Bordetella bronchiseptica
MPQRLDPVEVYGDRPQEAPGSRAILDAQLIADTAADRPAEILNQAPAVNIQMNSGQEHLIAIRSPVLSGGAGQGSFLILENGVPIRSPAFGNVNSLIEPHHEVADAIEIVRGPASAKYGSNAVHGLLNFILPDAASPQSLRLSYSTLERLRADASVNLGASTRLNLSLMDDAGWRDDTESQQQKLSLITQADLAGWDSAFWLAASSLNQETASFIQGPRAYEDDALRETNPNPEAYRDAWSARLGGRLSREVGPGTLTLLPNLHTQAMIFSQHFLPYGGVEKNGHTGGGVLARYEFTPTGPVQWRLGADTDFATGYLREIQPEPNPSPNFPQGIHYDYTVDTQLFALWAEADWQLTEGLRLLAGLRGETHSYDYTTDAPTGINGRFNVPENRTDDFTFLTPKLGLVWDQPWGALYANYARGARAPQVSDLYRLQSLQLPGEIDTETLDSLEIGVRGQGLYGHLDFDVAAWWMDKENFFFRDSDGLNVPDGSTRHFGIDAQATWAFTDNLSATGNVAWSEQTYTFDRPVVAAQERIVDGNLIDTAPEWLADARLDWQATDALRLSLTGEHVGEYFMDPANTVTYPGHTVFGARAGYTFAGGMEAYILIRNLTDEKYADRADVGFGNERYFPGEPVNAVFGLTKTF

SEQ ID NO: 20266 - protein, 728 aa, Bordetella bronchiseptica
MPPLSVLTSWRSPLIPVLLSTLTLTVQANTDPKQDEKEDTEQIERLNVVGTYTRAAMNSATGLSMSLKETPQSVTLITEEMISDKGLITMESVLNHTPGVTMVGDASENSQIFVRGYALDSGVQIDGLITTSSSNVYSGSIDQGLDPVIAERVEVLKGAAGILSGLGEPSATVNFIRKRPTDDTRATASVSYGSWNTYRLEADVSGWLTDSGNVKGRFVSAVKKGDSFIDRYQRDTTVLYGVVETSLGTDTSLSLFADYQKSQTDGVYNWNSNPAFYTDGTAVEFGRSYSSSQDWTHWDVTQKSLMAEFKHRFDNDWSLVSAYRIANATIDALAFYPGDNIVKSTGEFVGPWGDTYAAQHDRESDTNSFNLYATGNFDLLGREHSAVIGFNYGDNEFDNINTNSTPQRRYNVADQGNNPKPNLPNSPTNGQKNEQSQSGVYGTVRINVLDSLKLMVGGRVSNWSYEKHDPVGNSTDATMEKTGIFIPYYGLVYDVTEQISVYASRTEIFKPGTYFGEDGQLLEPAEGTNVEGGIKVALFDDTLNMSAAIYETNKDNEPEYAGKGQLPSGDFIYESVDGITTKGYELEIAGRLTDLWDISGGYTHNDAEDEDGLRRQTYLPEDIFKLTTKYNFEDILPGVTAGASWRWQSSTFYQGTIWGVDGAPNVAYRQAQSAYSLVDLMFGYQITPSISMQVNINNIFDKNYNRSLWGYADFGEPRNATLSLRWTL

SEQ ID NO: 20267 - protein, 340 aa, Bordetella bronchiseptica
MSLHPVVCLDRSRRGPGDFPLLSMSAVAMRRGVSALLGVAGTLALAAPAWAQARQEAASAAHPTWMAAAGNWQVLEGGPGVARVKQRTTGVYAGSEHALGAGLRLGGVLGLTRSTARFDDLYAKGHVNSYSLALYGARTVAAGAGDFNAVAGAAYTWHDMDTRRHFHWAGTSQTLTADTHGSTFQAFGELGYRWRASARVQIEPFAALAWRDVRTRAFVESGGWAAISAGPSRLTQTTTTLGVRGEAGYMLGPAPGKLRLTLGWRRAFGDVDPQATLVLDGGNALAATGAPIARDAALAGLGAELALSRSAAIGLAYIGQYSGGNREHTGSLSLRWLFGA

SEQ ID NO: 20268 - protein, 711 aa, Bordetella bronchiseptica
MVCYIVSFNENGTSFCREGNMRFERHPLSAALALALAWQGAHAQASADGTPEAATLAPITVSASPLAGDLDSMTAPAAVLEGDQLLLRRQGTLGDTLDGLPGVHADTFGGGASRPVIRGQTAPRVKVLSDGSELMDASAISPDHAVTTEPLLADKIEVLRGPATLLYGGGAIGGVVNVLDRKIPTAVPQQGIEAEAELRGATGTKERAGAIGITAGSGNFAVRVEGLKRRSSDYRVPDWPDGKLAGSYSESGQGTVGMSWITPRGYVGVAFTHLESKYGLPGHNHEYEGCHPHGSHLHCGGHDDHGHDEHEEGEAEHDHGHEHGAGDVPYVKLRSNRTDLRAEYTDPFAGFEKIRFRGGLTDYRHDEIEGGQLGTRFQNRGYDARLELTHRPLYGWHGVVGVQTSYSDFRATGEEAFLPRSKTRAHGLFLLEEYRWADWRVELGARQDWQRVSPQGGAPASRTAGTSLSAAAIWDFAPQYSLALSVSRSQRLPSAQELYADGVHLATNTYEIGDPGLDRETSRNVDLTLRKHSGDTTFSVSAFHNRVKNYIYANTLDRYEDFRLIEYTQRDAEFTGVEGEIRHRFGKVFSAAVFGDYVRGRLTGGGGNLPRIPAARLGVRADAQWQNWAGGVEYFHVYRQDDIAAYESSTPGYDMVNATIRYRGKLDRTAYEIYLRGNNLLNKLAFNHASFISTVAPLPGRSVLLGVRLTY

SEQ ID NO: 20269 - protein, 740 aa, Bordetella bronchiseptica
MPALFKTRTRLLASVGALYCASFLAPSQVVAQAAAVQDPVDSSPQTLPAVNVNASAVQSDMQVKKLPSYKFTAPLLDTPRSITVIPEELIRQTNATTFADALKTVPGITFLGGDAAANPSADRPVIRGFESRNSIFVDGIRDSGVQNRETFDIENITVIKGPDSVYAGRGAVGGSIDIETKMPKNENFITGSAGVGTDAYKRLTLDVNQKFGDDNAFRFNAMGHDANQAGRNNVYSKRWGVAPSVAFGLNSPTTVTVSYYHLNSYDMPDFSVPFRSTGGTPINSDRGQFYGLNNRDYRYGQTDTGEVRVEHRFNDNLKLKNTTMFGRSTLDYIATNPQLTSANPNILSLQAKSGKYATNSITNQTELTGQATLLGMQHTMTGGVEFSHERSLYEGYLVTDSTGNNIRSGGPCSVAYNCTPINAWNPDNPWLGSILLNGDKGFPGAATHTQTNVASAYLFDSVKITDQWLFNAGARFDRFDVTATQAGAQDLTNNSNLFSYQLGLVYKPLPSVSLYTSYGTSANPPGANSGIGGGTDQITATNQDLSPERSRNIEVGAKWDVLDRLSLNLALFQTDKTNARVSDGLGGTINAGHQRVRGVEVGTAGNITGEWSIFGGYSYLDAITVDAGAANAASSGLPMVMVPRHNFTLWSFYDVMPKLKVGAGVAVASKSYASVSPTVLKWTPGYARVDAVATYRVTKSIDLQLNVNNILDRKYFSTAYPIYATWAPGRSAMLTLNFYQ

SEQ ID NO: 20270 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTNDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 20271 - protein, 348 aa, Neisseria gonorrhoeae
MKKSLIALTLAALPVAATADVTLYGAIKAGVQTYRSVGHREGKVVSVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAEREHRYLSARYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYRTWHANSHNSQTEVAATAAYRFGNLTPRVSYAHGFKGSVRSADYDNTYDQVVVGAEYDFSKRTSALVSAGWLQEGKGADKIVSTASAVVLRHKF

SEQ ID NO: 20272 - protein, 721 aa, Acinetobacter baumannii
MRIIYIIFNLMNIPPRPFKLSVIACAICYANLTYAQDTQVQALQTIQVKASNAEQSSEQTKAYNVKNSSSATKLNIEAKETPQTINVVTRQQIEDFGLTSTRDVLRNTPGVTVSNQETERTTYMARGFEISNILTDGVGFPLSGYNYNNTNPDTYFYDRVEVVKGADSLTNAFGDPSATINNIRKRPTQEFQASGGVSYGSWDTQRYEADVSGSILPSGKVRGRIMGYEQTGDSYLDRYSAEKNGFAGIVEADLTDSTLLTAGYSQEQNKPNANNWGALPLLDANGKQISYDRSYNPNPDWAHWDNETQNAFVELKQKINDQWNAKLTYNYLDTKHNSRLLYYYGYPKADGSGVSLTPWGGQEHQEKHAVDFNLEGTYKLFNREHEATLGYSYVRNHQQDKQSTGTINDSNVIKSTTTDWASWTPQSITWSDFTEAANYKQNINSIYAATRLHLNEDLKLLLGANYVQAESKGESYSSPMSYSESKVSPYVGLTYNFTPEYTGYMSYTSIFRPQTGIDKDTNQALKPIEGKSYEMGVKSSWLDDRLTGTLSVFKTEQNNYPLRNSDGNPLNRKVPTSDLESQGVEVGLSGQITDNVNLSFGYAQFSIKDTKNGGEARTYNPNQTLNLLTTYTPPVLPKLKVGAGLQWQDGIKLYDSNVNGTIKQDAYALVNLMASYEVNDHITLQANGNNIFDKKYLNSFPDGQAFYGAPANYTVAVKFKY

SEQ ID NO: 20273 - protein, 378 aa, Salmonella gallinarum
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANDRLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 20274 - protein, 223 aa, Neisseria meningitidis
THIKYNGWNWNVDENEDESLEPTGEHKNDYVNWLPSVLFKYDVNDDFKVRASFTETLSRPKYSALIPCVNINRSDNELVMGNPDLTPTISYNFDLSADYYFKSVGLVSAGIFYKKINDFIVDQVIGDYTYQNNEYKKFTQPKNAGDADLLGVELAYQRDFSFIAPALKCIGFYGTYTYTHTKVNNFNFEDVKMKKTCLFPVLRNTQPTPLSISRRKDSTYVSL

SEQ ID NO: 20275 - protein, 740 aa, Helicobacter pylori
MKKHILSLALGSLLVSTLSAEDDGFYMSAGYQIGEAAQMVTNTKGIQQLSDNYENLSKLLTRYSTLNTLIQLSADPSAINSARENLGASAKNLIGDKANSPAYQAVLLAINAAVGFWNVLGYATQCGGNGDQKSTSSTTIFNNEPGYRSTSITCSFNNLNIGYYGVMSIDNMKKLNEAYQILQTALKKGLPALKENNGNINVTYSYTCSGEGNSNCSKKATGVEIQNGGSKTTTQTIDGKQVTTTISSKVVDSGAEGNTSGVSYTEITNQLNGVPDSAQALLAQASTLINTINSACPYYSVTNKSGGPQMEPAIGKLCGFTQEISAIQKMITDAQELVNQTSAINSNEQTTQVGGSGGKPFNPFTDASFAQGMLANASAQAKMLDLAHQVGQTINPDNLSGSFKNFVTGFLATCNNPSTAGTGGTQGSAPGTVTTQTFASGCAYVEQTITNLKNSIAHFGTQEQQIQQAENIADTLVNFKSRYNELGNTYNSITTALSKVPNAQSLQNVVSKKNNPYSPQGIETNYYLNQNTYNQVQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHVAQHGIELGLKIPTINTNYYSFMGAELKYRRLYSVYLNYVFAY

SEQ ID NO: 20276 - protein, 736 aa, Helicobacter pylori
MKKHILSLTLGSLLVSTLSAEDDGFYMSAGYQIGEAAQMVTNTKGIQQLSDNYENLNNLLTRYSTLNTLIKLSADPSAINAARENLGASAKNLIGDKANSPAYQAVLLAINAAVGFWNVVGYVTQCGGNANGQESTSSTTIFNNEPGYRSTSITCSLNRYVPGYYGPMSIENFKKLNEAYQILQTALKNGLPALKENNGKVDVSYTYTCSGEGNNNCSKEATGVEQNGRSKTETQIIDGKSVTTTISSKVVDSKAAGNTSGVSYTEITNKLDGVPDSAQALLAQASTLINTINTACPYFRANNSSEANAPKFSTTTGKICGAFSEEISAIQKMITDAQELVNQTSVINEHEQSTPIGNNNGKPFNPFTDASFAQGMLANASAQAKMLNLAHQVGQTINPDNLTGNFKNFVTGFLATCNNPSTAGTGGTQGSAPGTVTTQTFASGCAYVEQTITNLTNSIAHFGTQEQQIQQAENIADTLVNFKSRYNELGNTYNSITTALSNIPNAQSLQNAVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKDSDHAAQHGIELGLKIPTINTNYYSFMGAELKYRRLYSVY

SEQ ID NO: 20277 - protein, 734 aa, Helicobacter pylori
MKKHILSLTLGSLLVSTLSAEDDGFYMSAGYQIGEAAQMVTNTKGIQQLSDNYENLSKLLTRYSTLNSLIKLSADPSAINAARENLGASAKNLIGDKANSPAYQAVLLAINAAVGFWNVLGYATQCGGNADGQKSTSSTTIFNNEPGYRSTSITCSFNNLRIGYYGVMSIENMKKLNQAYQILQTALNKGLPALKENNGTVSVEYTYTCSGERNNNCSKEVTGVSEQNGESKTETQTIDGKQVNTTISSKVVDSTASGNTSGVSYTEITNALSNVPDSAQFLLAQASTLINTINTACPYFSVNNESGGPQMKPTNGKLCGFTNEISAIQKMITDAQELVNQTSAINSNEQSTPVGGNNGKPFNPFTDASFAQGMLANASAQAKMLDLAHQVGQTLNPERLTGNFQNFVKNFLATCNNPSTAGTGGTQGSAPGTVTTQTFASGCAYVEQTITNLSNSIAHFGTQEQQIEQAENIADTLVHFKSRYSELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVY

SEQ ID NO: 20278 - protein, 738 aa, Helicobacter pylori
MKKHILSLALGSLLVSTLSAEDDGFYMSAGYQIGEAAQVVKNTKGVQQLSDNYENLSKLLTRYSTLNTLIKLSADPSAINAARENLGASAKNLIGDTKNSPAYQAVLLAINAAVGFWNVLGYATQCGGNANGTKSTSSITIFNNEPGYRSTSITCSLNGYTPGYYAPMSIENFKKLNEAYQILQTALKKGLPALKENNGTVNVTYTYTCSGEGNNNCSPGSVGTNSGSKTEIQTIDGKSVSTTISSKVVDSSASGNTSGVSYTEITNVLNGVPDSAQFLLAQASTLINTINTACPFFSVTNRSGGPQMKPTEGKLCGFTNEISAIQKMITDAQELVNQTSAINSNEQLTPVGGSNGKPFNPYTDASFAQGMLANASAQAKMLSLSEQVGQTLNPDRLTGNFQNFVKNFLATCNNPSTAGTGGTQGSAPGTVTTQTFASGCAYVEQTITNLNNSIAHFGTQEQQIEQAENIADTLVHFKSRYSELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARAKKKGSDHAAQHGIELGVKIPTINTNYYSFMGAELKYRRLYSVYLNYVFAY

SEQ ID NO: 20279 - protein, 733 aa, Helicobacter pylori
MKKHILSLTLGSLLVSTLSAEDDGFYMSAGYQIGEAAQMVTNTKGIQQLSDNYENLSKLLTRYSTLNTLIKLSADPSAINAARENLGASAKNLIGDTKNSPAYQAVLLAINAAVGFWNVLGYATQCGGNANGQKSTSSTTIFNNEPGYRNTSITCSLNEYTPGYYGPMSIENMKKLNQAYQILQTALKKGLPALKENNGTVSVNYTYTCSGENNNNCSKEVTGVNKQNGGSKTETQTIDGKQVSTTISSKVVDGRTLTNKGPSYTEITNKLENVPDSAQFLLAQASTLINTINTACPFFSVTNKEGGPQMQPTKGKLCGFTDEISAIQKMITDAQELVNQTSTINSNEQSTPVGDNNGKPFNPFTDASFAQGMLANASAQAKMLDLAHQVGQTLNPERLTGNFQNFVKNFLATCNNPSTAGTGGTQGSAPGTVTTQTFASGCAYVEQTITNLNNSISHFGTQEQQIQQAENIADTLVNFKSRYSELGNTYNSIATALSKVPNAQSLQNVVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVY

SEQ ID NO: 20280 - protein, 733 aa, Helicobacter pylori
MKKHILSLTLGSLLVSTLSAEDDGFYMSAGYQIGEAAQMVTNTKGIQQLSDNYENLSKLLTRYSTLTNLIKLSADPSAINAARENLGASAKNLIGDKANSPAYQAVLLAINAAVGFWNVLGYATQCGGNANGTESTSSTTIFNNEPGYRSTSITCNFNKLPIGYYAVMSIENMKKINQAYQILQTVLKKGLPALKENNGTITVNYSYTCSGQGNNNCDVLASNQNGKSKTETKTIDGKQVSTMISSKVVDSTAPGNTQHVSYTEITNALSNVPDSAQFLLAQASTLINTINTACPYFHVTNSNSPNAPKMEPTRGKLCDFTDEISAIQKMIIDAQELVNQTSVINSNEQTTPVGGNNGKPFNPFTDASFAQGMLANASAQAKMLDLAHQVGQTLNPDNLTGNFQNFVKNFLATCNNPSTAGTGGTQGSAPGTVTTQTFASGCAYVEQTITNLSNSIAHFGTQEQQIEQAENIADTLVHFKSRYSELGNTYNSIATALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKINTANFQFLFNMGVRMNLARAKKKGSDHAAQHGIELGVKIPTINTNYYSFMGAELKYRRLYSVY

SEQ ID NO: 20281 - protein, 734 aa, Helicobacter pylori
MKKHILSFALGSLLVSTLSAEDDGFYMSAGYQIGEASQVVKNTKGVQQLSDNYENLSKLLTRYSTLNNLIKLSADPSAINAARENLGASAKNLIGDTKNSPAYQAVLLAINAAVGFWNVVGYVTQCGGNANGTKSTSSTTIFNNEPGYRSISINCSLNGYSPGPYGPMSIENFKKLNEAYQILQTALKKGLPALKENNGTVDVTYTYTCSGEGNDNCKITGVNQQNGTKTETQTIDGKSVKTTISSKVVDYKAQGNKLGVSYTEITNALTNVPDSAQFLLAQASTLINTINTACPYFHANNSSETNAPKFSTTTGKICGAFSEEISAIQKMITDAQELVNQTSAINSNEQTAQVGGSGGKPFNPFTDASFAQGMLANASAQAKMLDLAHQVGQTLNPERLTGNFQNFVKNFLATCRNPSTAGTGGTQGSAPGTVTTQTFASGCAYVEQTITNLNNSISHFGTQEQQIEQAENIADTLVHFKSRYSELGNTYNSITTALSSLPNAQSLQNVVNKKNNPYSPQGIETNYYLNQNSYNQIQTINQELGRNPFRKVGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKINTANFQFLFNLGLRMNLARAKKKGSDHAAQHGIELGVKIPTINTNYYSFMGAELKNRRLYSVY

SEQ ID NO: 20282 - protein, 734 aa, Helicobacter pylori
MKKHILSFALGSLLVSTLSAEDDGFYMSAGYQIGEAAQVVKNTKGVQQLSDNYENLSKLLTRYSTLNSLIKLSADPSAINAARENLGASAKNLIGDTKNSPAYQAVLLAINAAVGFWNVVGYVTQCGGNANGQKSTSSTTIFNNEPGYRSTSITCSLNGYSPGYYGPMSIENFKKLNEAYQILQTALKKGLPALKENNGTVDVTYSYTCSGDGNNNCDITGVERQSGSKSETQTIDGKQVKTMISSKVVDSKALDNTSGVSYTEITNKLDRVPDSAQFLLAQASTLINTINSACPFFHANNSSETNAPKFSTTKGKICGAFSEEISAIQKMITDAQELVNQTNTINSNEQTDQVGGSNGKPFNPYTDASFAQGMLANASAQAKMLSLADQVGQTINPERLTGTFQNFVKNFLATCNNPSTAGTGGTQGSAPGEVTTQTFASGCAYVEQTITNLNNSIAHFGTQEQQIQQAENIADTLVHFKSRYSELGNTYNSITTALSKVPNAQSLQNVVSKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEYVNLATVNNVYNAKINTANFQFLFNLGLRMNLARAKKKGSDHAAQHGIELGVKIPTINTNYYSFMGAELKYRRLYSVY

SEQ ID NO: 20283 - protein, 745 aa, Helicobacter pylori
MKKHILSLALGSLLVSTLSAEDDGFYTSVGYQIGEAAQMVTNTKGIQQLSDNYENLNNLLTRYSTLNTLIKLSADPSAINAVRENLGASTKNLIGDKANSPAYQAVFLAINAAVGLWNTIGYAVMCGNGNGTESGPGSVIFNDQPGQDSTQITCNRFESTGPGKSMSIDEFKKLNEAYQIIQQALKNQSGFPELGGNGTKVSVNYNYECRQTADINGGVYQFCKAKNGSSSSSNGGNGSSTQTTATTTQDGVTITTTYNNNKATVKFDITNNAEQLLNQAANIMQVLNTQCPLVRSTNNENTPGGGQPWGLSTSGNACSIFQQEFSQVTSMIKNAQEIIAQSKIVSENAQNQNNLDTGKPFNPYTDASFAQSMLKNAQAQAEMFNLSEQVKKNLEVMKNNNNVNEKLAGFGKEEVMTNFVSAFLASCKDGGTLPNAGVTSNTWGAGCAYVGETISALTNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVNSQTNNGAMNGIGIQVGYKQFFGQKRKWGARYYGFFDYNHAFIKSSFFNSASDVWTYGFGADALYNFINDKATNFLGKNNKLSLGLFGGIALAGTSWLNSEYVNLATVNNVYNAKMNVANFQFLFNMGVRMNLARSKKKGSDHAAQHGIELGLKIPTINTNYYSFMGAELKYRRLYSVYLNYVFAY

SEQ ID NO: 20284 - protein, 743 aa, Helicobacter pylori
MKKHILSFALGSLLVSTLSAEDDGFYMSAGYQIGEAAQMVSNTKGIQQLSDNYENLSKLLTRYSTLSNFIQLASDPSAINAARENLGASAKNLIGDTKNSPAYQAVLLAINAAVGFWNVVGYATQCGGNGSQKSTSSTTIFNNEPGYRSTSLTCSLNGYTPGYYSPMGIDNMKKLNQAYQILQAALKKGLPALKQNNGKVNVTYTYTCSGEGNTNCDPSLFDITGTSKNGNGRNGGSKTTTQTIDGKPVSTTISSKVVQPTGGAAYTEITNALKDVPDSAQFLLAQASTLINTINSACPWFRVTNQSGGPQMNPTSGGLCVFKDEISAIQKMIADAQELVNQTSVINSNEQSTQQVGGSGGKPFNPFTDASFAQGMLANASAQAKMLNLSHQVGQAINPDNLSGTFQKFVKNFLATCNNPSTAGTGGTQGSPPGTVTTQTFASGCAYVEQTITNLSNSIAHFGTQEQQIEQAENIADTLVHFKSRYSELGNTYNSITTALSKVPNAQSLQNVVSKKNNPYSPQGIETNYYLNQNSYNQVQTINQELGRNPFRKLGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVYLNYVFAY

SEQ ID NO: 20285 - protein, 738 aa, Helicobacter pylori
MKKHILSFALGSLLVSTLSAEDDGFYMSAGYQIGEAAQMVTNTKGIQQLSDNYENLSKLLTRYSTLNNLIKLSADPSAINAARENLGASAKNLIGDTKNSPAYQAVLLAINAAVGFWNVLGYVTQCGGNANGQESTSSTTIFNNEPGYRSTSITCSLNNHVPGYYGPMSIENFKKLNEAYQILQTALKKGLPALKENNGTVNVTYTYTCSGKGNDNCNALVTPEKDRRNGGSKTETQTIDGKTVNTTISSKVVDSGTLGNTSGVSYTEITNALNGVPDNAQALLAQASTLINTINTACPFFHANNSSEANAPKFSTTSGKICGAFSEEISAIQKMITDAQELVNQTSAINSNKQTAPVGGSEGKPFNPFTDASFAQSMLASAQAQAKMLNLSEQVGQTLNPERLTGNFQNFVKNFLATCNNPSTAGTSSTQGSAPGTVTTQTFASGCAYVEQTITNLNNSIAHFGTQEQQIQQAENIADTLVHFKSRYSELGNTYNSITTALSKVPNAQSLQNVVNKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKINTANFQFLFNMGVRMNLARAKKKGSDHAAQHGIELGVKIPTINTNYYSFMGAELKYRRLYSVY

SEQ ID NO: 20286 - protein, 736 aa, Helicobacter pylori
MKKHILSFALGSLLVSTLSAEDDGFYMSAGYQIGEASQVVKNTKGVQQLSDNYENLSKLLTRYSTLNNLIKLSADPSAINAARENLGASAKNLIGDTKNSPAYQAVLLAINAAVGFWNVLGYATQCGGNANGTTSTSSITIFNNEPGYRSTSITCSLNGYKPGYYSPMSIENFKKLNEAYQILQMALKKGLPALKENNGTLNVTYTYTCSGSGNDNCSPKVTGVSKQDGGTKTETQTIDGKTVSTTISSKVVDSHASGNTSHVSYTEITNTLEGVPDNAQALLAQASTLINTINTACPYFSVTNNSSSNAPKMEPTKGKLCGFTDEISAIQKMITDAQELVNQTSTINANEQTTPVGGSNGKPFNPFTDASFAQSMLANASAQAKMFNLSEQVGQTLNPERLTGNFQNFVKNFLATCNNPSTAGTGGTQGSSPGTVTTQTFASGCAYVEQTITNLNNSISHFGTQEQQIQQAENIADTLVHFKSRYSELGNTYNSITTALSKVPNAQSLQNVVSKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKMNVANFQFLFNMGVRMNLARAKKKGSDHAAQHGIELGVKIPTINTNYYSFMGAELKYRRLYSVY

SEQ ID NO: 20287 - protein, 737 aa, Helicobacter pylori
MKKHILSFALGSLLVSTLSAEDDGFYMSAGYQIGEAAQVVKNTKGVQQLSDNYENLSKLLTRYSTLNNLIKLSADPSAINAARENLGASAKNLIGDTKNSPAYQAVLLAINAAVGFWNVVGYVTQCGGNANGQESTSSTTIFNNEPGHRSTSITCSLNGYKPGYYAPMSIENFKKLNEAYQILQTALKQGLPALKENNNTVNVNYTYTCSGEGNNNCSSQIIGVSKQNGGSKTETQTIDGKQVSTTISSKVVDFGATGNTLGVSYTEITNALTGVPDSAQFLLAQASTLINTINTACPFFRANNSNEANAPKFSTTSGKICGAFSEEISAIQKMITDAQELVNQTSVINSNEQTTQVGGSNGKPFNPYTDASFAQGMLANASAQAKMLSLSEQVGQTLNPERLTGNFQNFVKNFLATCHNPSTAGTGGTQGSAPGEVTTQTFASGCAYVEETITNLNNSIAHFGTQEQQIEQAENIADTLVHFKSRYSELGNTYNSITTALSKVPNAQSLQNVVSKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKINTANFQFLFNLGLRMNLARAKKKGNDHAAQHGIELGVKIPTINTNYYSFMGAELKYRRLYSVY

SEQ ID NO: 20288 - protein, 744 aa, Helicobacter pylori
MKKHILSLTLGSLLVSALSAEDDGFYTSVGYQIGEAAQMVTNTKGIQELSDRYESLNNLLTRYSTLNTLIKLSADPSAVNAARENLGMSAKNLIGDKANSPAYQAVLLAINAAVGFWNVVGYITQCGGNANGQKSTSSTTIFNNEPGYRSTSITCSLNGYNPGYYGPMSIENFKKLNKAYQILQTALKQGLPALKENNGTVSVTYTYTCSGNGNDNCSKEATGVDNQNSGTKTETQIIDGKSVTTTISSKVVDSSASGNTRGVSYTEITNKLDGVPDSAQALLVQASTLINTINEACPYFHASNSSEANAPKFSTTTGKICGAFSEEISAIQKMITDAQELVNQTSVINEHEQSTPVGNNNGKPFNPYTDASFAQGMLANASAQVKMLNLAHQVGQTINPDNLTGTFKNFVTGFLATCDNKSTNGNHYNQGSAPGTVTTQTFASGCAYVEQTITNLENSIAHFGTQEQQIQQAENIADTLVNFKSRYSELGNTYNSITTALSSIPNAQSLQNVVSKKNNPYSPQGIETNYYLNQNTYNQIQTINQELGRNPFRKVGIVSSQTNNGAMNGIGIQVGYKQFFGQKRKWGARYYGFFDYNHAFIKSNFFNSASDVWTYGFGADALYNFINDKATNFLGKNNKLSVGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 20289 - protein, 744 aa, Helicobacter pylori
MKKHILSLTLGSLLVSTLSAEDDGFYMSAGYQIGEAAQMVKNTKGIQELSDNYENLSNLLTRYSTLNTLIKLSADPSAVNAARENLGASAKNLIGDTKNSPAYQAVLLAINAAVGFWNVVGYVTQCGGNANGQKSTSSTTIFNNEPGYRSTSITCSLNGHMPGYYGPMSIENFKKLNEAYQILQTALKNGLPALKENNGTVNVTYSYTCSGEGNDNCSLQTTGVTNQNNGTKTETQTIDGKSVTTTISSKVVDSQAYGNTTGVSYTEITNKLDGVPDSAQALLAQASTLINTINTACPYFHANNSSEANAPKFSTTTGKICGAFSEEISAIQKMITDAQELVNQTSVINEHEQSTPIGNNNGKPFNPFTDASFAQGMLANASAQAKMLNLAHQVGQTINPDNLTGNFKNFVTGFLATCNNPSTAGTGGTQGSAPGTVTTQTFASGCAYVEQTITNLTNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHAAQHGIELGVKIPTINTNYYSFMGAELKYRRLYSVYLNYVFAY

SEQ ID NO: 20290 - protein, 744 aa, Helicobacter pylori
MKKHILSLTLGSLLVSTLSAEDDGFYTSVGYQIGEAAQMVTNTKGIQDLSDRYENLNNLLTRYSTLNTLIKLSADPSAINAVRENLGASAKNLIGDKANSPAYQAVLLAINAAVGFWNVVGYVSQCGGNANGQESTSSTTIFNNEPGYRSTSITCSLNGHSPGYYGPMSIENFKKLNEAYQILQTALKQGLPALKENNGKVDVTYTYTCSGAGNDNCSPKVTGVSKQNGGTKTTTQTIDGKTVTTTISSKVVDSGVPSNTQHVSYTEITNKLDDVPDSAQALLAQASTLINTINTACPFFHANNSSEANAPKFSTTTGKICGAFSEEISAIQKMITDAQELVNQTSVINEHEQSTPVGNNNGKPFNPFTDASFAQGMLANASAQAKMLNLAHQVGQTINPENLSGNFKNFVTGFLATCNNKSTAGTGGTQGSAPGTVTTQTFASGCAYVEQTLTNLENSIAHFGTQEQQIQQAENIADTLVNFKSRYNELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATFNNFYSAKMNVANFQFLFNMGVRMNLARSKKKGSDHVAQHGIELGLKIPTINTNYYSFMGAELKYRRLYSVYLNYVFAY

SEQ ID NO: 20291 - protein, 742 aa, Helicobacter pylori
MKKHILSLTLGSLLVSTLSAEDDGFYMSAGYQIGEAAQMVKNTKGIQDLSDRYESLNNLLTRYSTLNTLIKLSADPSAINGVRNDLGASAKNLIGDKTNSPAYQAVLLAINAAVGFWNIVGYVSQCGGNANGTKSTSSTTIFNNEPGYRSTFITCSLNNHNPGVQGPISIENMKKINEAYQILQTALKNGLPALKENNGTLKVEYTYTCSGEGNNNCSKEATGVEKQNGGTKTETQTIDGKTVITKISSKVAHLSDGTAYTEITNQLNDVPDSAQALLAQASTLINTINSACPWFNATSSSSPHAPQWKWSPYSGGLCGAFKDEISAIQKMITDAQDLVNQTSVINNNEQSAQVGANNNGKPFNPFTDASFAQGMLANAQAQAKMLNLAEQVGNAINPEKLTGNFQYFVKEYLATCNNPSTAGTGGTQGSSPGTVTTQTFASGCAYVEQTLTNLNNDIAHFGTRAQQIQQAADIADTLVNFKSRYNELGNTYNSITTALSSIPNAQSLQNAVSKKNNPYSPQGIETNYYLNQNTYNQIQTINQELGRNPFRKVGIFSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHAAQHGIELGLKIPTINTNYYSFMGAELKYRRLYSVYLNYVFAY

SEQ ID NO: 20292 - protein, 739 aa, Helicobacter pylori
MKKHILSLTLGSLLVSTLSAEDDGFYMSAGYQIGEAAQMVKNTKGIQDLSDRYESLNNLLTKYSTLNTLIKLSADPSAINAARENLGASAKNLIGDKANSPAYQAVLLAINAAVGFWNVVGYVTQCGGNANGTKSTSSTTIFNNEPGYRSTSITCSLNGYNPGYYGPMSIENFKKINEAYQILQTALKQGLPALKENNGTVSVTYTYTCSGEGNDNCSLKATKATGVEQNGRSKTETRTIDGKQVTTTISSKVVDSTASGNTRHVSYTEITNTLSGVPDSAQALLAQASTLINTINEACPFFRASNRSEANAPKFSTTTGKICGAFSEEISAIQKMITDAQELVNQTSVINSHEQSTPVGNNNGKPFNPFTDASFAQGMFANASAQAKMLNLTHQVGQTINPENLTGTFKNFVTGFLATCNNKSTAGTGGTQGSAPGTVTTQTFASGCAYVGQTITNLKNSIAHFGTQEQQIQQAENIADTLVNFKSRYSELGNTYNSITTALSNIPNAQSLQNAVSKKNNPYSPQGIETNYYLNQNTYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVY

SEQ ID NO: 20293 - protein, 745 aa, Helicobacter pylori
MKKHILSLTLGSLLVSTLSAEDDGFYTSVGYQIGEAAQMVKNTKGIQDLSDRYENLNNLLNRYSTLNTLIKLSADPSAINGVRNDLGASAKNLIGDKANSPAYQAVLLAINAAVGFWNIVGYVTQCGGNAKGTESTSSTTIFNNEPGYRSTSITCSLNGHMPGYYGPMSIENFKKLNEAYQILQTALKNGLPALKENNGTVKVEYTYTCSGKGNNNCSKEATGVDNQNGGTKTETQTIDGKSVTTTISSKVVDSTASGNTRHVSYTEITNKLEGVPDSAQALLAQASTLINTINTACPYFHANNSSEANAPKFSTTTGKICGAFSQEISAIQKMITDAQELVNQTSVINSNEQSTPIGNNNNGKPFNPYTDASFAQSMLKNAQAQAKMLNLAHQVGQAINPERLIGTFKNFVTGFLATCNNPSTAGTGSTQGSAPGTVTTQTFASGCAYVGQTITNLKNSIAHFGTQEQQIQQAENIADTLVNFKSRYNELGNTYNSITTALSSIPNAQSLQNAVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHAAQHGIELGLKIPTINTNYYSFMGAELKYRRLYSVYLNYVFAY

SEQ ID NO: 20294 - protein, 744 aa, Helicobacter pylori
MKKHILSLTLGSLLVSTLSAEDDGFYMSAGYQIGEAAQMVKNTKGIQDLSDRYESLNNLLTRYSTLNTLIKLSADPSAINGVRNDLGASAKNLIGDKANSPAYQAVLLAINAAVGFWNVVGYVTQCGGNANGTKSTSSTTIFNNEPGYRSTSITCSLNGYTPGYYGPMSIENFKKLNEAYQILQTALKNGLPALNNSNGKVNVTYTYTCSGEKNNNCSKQVTGVNEQNGGTKTETQNIDGKSVTTTISSKVVDASASGNTQGVSYTEITNQLSGVPDSAQALLAQASTLINTINSACPYFHANNSSEANAPKFSTTTGKICGAFSEEISTIQKMITDAQELVNQTSVINSNEQSAQVGGNNGKPFNPFTDASFAQGMLANAQAQAKMLNLAEQVGQAINPDRLSETFKKFVTGFLATCNNPSTSGAHTTQGSAPGTVTTQTFASGCAYVGQTLTNLNNDIAHFGTRAQQIQQAADIADTLVNFKSRYNELGNTYNSITTALSSIPNAQSLQNAVSKKNNPYSPQGIETNYYLNQNTYNQIQTINQELGRNPFRKIGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVYLNYVFAY

SEQ ID NO: 20295 - protein, 442 aa, Helicobacter pylori
MKKHIALSAIVVGLLGSVNVQAAEDLSTMFSEGKTSGQIRTFYINRDDNTKAGNQIATAVGGHLKYETAAYKGLSLGAAFHTTNRILQGLEDDVMGPNTTLLKNDGSSYSILGEAFIQYNAKDLGTKTTFKMGRQMLNTPLAGADDARMIPNMFEAYVLTNSDISNTTVVAAHVTKFAAGTFANAYNGGIVGATGGYTSVAGNTAKYQGEFTNMGTWAVGKETAGVSTVGAIFKNDNFKVQLWDYYAYDILNAVYAQVDAKWKCLLSDSVKPFASVQFIKEDGMGSVASVKDIDSMYWGAKVGAGIGGFKAYVAYSQQSDAEAGKSLENSTITPWGGMPAFTQGMVTRHMFLAGTKATKVAATYSFKEHGVNLSATGYYASFDMDANSGYGTARTAKEPGFDVIYYPDVVKKLQLRVRGNFPTDFGDNRDWSEYRFIANYNF

SEQ ID NO: 20296 - protein, 129 aa, Helicobacter pylori
SLQYYAAYRLFEQTAAARFQGIGPILGLSANTDGGVFGYGGAYVALRVLNRIHLLPSAGIGGYARGHSKNLGGVFEFHLGAALFYQPLSNDWLPADLRLGVTYTHISNAFIHDRNPGADNIADNILVSI

SEQ ID NO: 20297 - protein, 694 aa, Helicobacter pylori
SLSLSFLLHAEDDGFYTSVGYQIGEAAQMVKNTKGIQQLSDNYEKLNNLLNNYSTLNTLIKLSADPSAINDARDNLGSSGRNLLDVKTNSPAYQAVLLALNAAVGLWQVTSYAFTGCGPGSNESANGGIQTFNNVPGQNTTTITCNSYYEPGKDSTISTENYAIINKAYQIIQKALTANGSNGDGVPVLSNTTTKLDFTIQGDKRTDAKPNEKLIYPWSHGEAISTSWNGGESTPTTEQINTTNSAQELLKQASIIITTLNSACPNFQNGGSGYWAGISGNGTMCGMFKNEISAIQGMIANAQEAVAQSKIVSENAQNQNNLDTGKPFNPYTDASFAQSMLKNAQAQAEILNQAEQVVKNFEKIPTAFVSDSLGVCYEVQGGERRGTNPGQVTSNTWGAGCAYVGQTITNLKNSIAHFGTQAEQIQQAENIADTLVNFKSRYSELGSTYNSITTALSKVPNGSSLQNAVSKKNNPYSPQGIETNYYLNQNAYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVYLN

SEQ ID NO: 20298 - protein, 696 aa, Helicobacter pylori
SLSLSLSFLLHAEDDGFYMSAGYQIGEAAQMVKNTGGIQKLSDNYENLSKLLTRYSTLNNLIQLSSSPSTINEVRDNLGSSGRNLLDVKTNSPAYQAVLLALNAAVGLWQVTSYAFTACGPGHNQNENGGIQTFNNVPGQNTTTITCNSYYQPGHGGPISTENYAKINKAYQIIQKALAANGSNGDGVPVLSNTTTKLDFTISGDKRTGAREGDRYRYTWTHGQYVPTQWVEGTSTSTIENINTTNNAQELLKQASVIITTLNEACPNFQNGGMGYWPGISGNGTMCGMFANEISAIQGMIANAQEAVVQAKIVSENAQNQSDLDTAKPFNPYTDASFAQSMLANANAQAEILNQAEQVVKNFEKIPTTFVKGSLGVCYKVEEGERRGTDPGQTTSNTWGAGCAYVEQTITNLNNSISHFGTQEQQIQQAENIADTLVHFKSRYSELGNTYNSITTALSKVPNAQSLQNVVSKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKMNVANFQFLFNMGVRMNLARAKKKGSDHAAQHGIELGVKIPTINTNYYSFMGAELKYRRLYSVYLN

SEQ ID NO: 20299 - protein, 696 aa, Helicobacter pylori
SLSLSLSFLLHAEDDGFYMSAGYQIGEAAQMVKNTKGIQQLSDNYEKLNNLLNNYNTLNTLIKLSADPSAINDARDNLGSSGRNLLDVKTNSPAYQAVLLALNAAVGLWQVTSYAFTGCGPGSKESANGGIQTFNNVPGQNTTTITCNSYYEPGKDSTISTENYAKINQAYQIIQKALTANGANGDGVPVLSNTTTKLDFTIQGDKRTGGKPNDPLIYSWSHGKAISTAWNDTKATPTETKINTENNAQELLKQASIIITTLNEACPNFQNGGSGYWQGISGNGTMCGMFKNEISAIQGMIANAQEAVAQSKIVSENAQNQNNLDTGKPFNPYTDASFVQSMLKNAQAQAEILNQAEQVVKNFEKIPKNFVSDSLGVCYEVQGGERRGTNPGQVTSNTWGAGCAYVGQTITNLKNSIAHFGTQEQQIQQAENIADTLVNFKSRYSELGNTYNSITTALSNIPNAQSLQNAVSKKNNPYSPQGIETNYYLNQNTYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVYLN

SEQ ID NO: 20300 - protein, 697 aa, Helicobacter pylori
SLSLSLSFLLHAEDDGFYMSAGYQIGEAAQMVTNTGEIQKLSNNYESLNNFLTKYSTLNNLIQLSSSPSTINEVRDNLGSSGRNLLDVKTNSPAYQAVLLALNAAVGLWQVTSYAFTACGPGHNQSENGGIQTFNNVPGQNTTTITCNSYYQPGHGGPISTENYAKINQAYQIIQKALTANGSENGDGVPVLSNTTTKLDFTISGDKRTSAHEGERYKYTWTHGQYVPTQWVGGASTQTETKINTENNAQELLKQASVIITTLNEACPNFQNGGNGYWSGISGNGTMCGMFANEISAIQGMIANAQEAVAQAKIVSENTQNQSDLDTAKPFNPYTDASFAQSMLASAQAQAEILNQAEQVVKNFEKIPTAFVNGSLGVCYQMEGGERRGTNPGQTTSNTWGAGCAYVKETITNLNNSIAHFGTQEQQIQQAENIADTLVHFKSRYSELGNTYNSITTALSKVPNAQSLQNVVNKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKINTANFQFLFNMGVRMNLARAKKKGSDHAAQHGIELGVKIPTINTNYYSFMGAELKYRRLYSVYLN

SEQ ID NO: 20301 - protein, 694 aa, Helicobacter pylori
SLSLSFLLHAEDDGFYMSAGYQIGEAAQMVKNTKGIQQLSENYEKLNNFLNNYNTLNTLVKLSSDPSTVNDARDNLGSSAKNLLDVKANSPAYQAVLLALNAAVGLWQVTSYAFTACGPGSNKNANGGIQTFNNVPGQSTTTITCNSYYQPGHGGPISTENYAIINKAYQIIQKALTANGSNGDGVPVLSNTTTKLDFTIQGDKRTGGEPNPKERFPWSHGEYIHTQWIHTTSTPTTEQINTTNSAQELLKQASIIITTLNSACPNFQNGGSGYWAGISGNGTMCGMFANEISAIQGMIANAQEAVAQAKIVSENTQNQNSLDTGKPFNPYTDASFAQSMLANAQAQAEILNQAEQVVKNFEKIPTAFVNGSLGVCYEVQGGERRGTDPGQTTSNTWGAGCAYVGQTITNLKNSIAHFGTQEQQIQQAENIADTLVNFKSRYNELGNTYNSITTALSSIPNAQSLQNAVSKKNNPYSPQGIETNYYLNQNTYNQIQTINQELGRNPFRKVGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVYLN

SEQ ID NO: 20302 - protein, 694 aa, Helicobacter pylori
SLSLSFLLHAEDDGFYMSAGYQIGEAAQMVTNTGGIQKLSDNYESLNNLLTKYSTLNNLIQLSSSPSTINEVRDNLGSSGRNLLDVKTNSPAYQAVLLALNAAVGLWQVTSYAFTACGPGHNQDENGGIQTFNNVPGQNTTTITCNSYYQPGHGGPISTENYAKINRAYQIIQKALTANGSNGDGVPVLSNTTTKLDFTISGDKRTGGKPNEPLIYPWSHGKAISTSWNGGTSTPTTENINTENNAQELLKQASVIITTLNEACPNFQNGGSGYWEGISGNGTMCGMFANEISAIQGMIANAQEAVAQAKIVSENTQNQNNLDTAKPFNPYTDASFAQGMLANASAQAEILNRVEQVVKNFQKIPTAFVNDSLGVCYEVQGGERRGTNPGQTTSNTWGAGCAYVKETITNLNNSIAHFGTQEQQIEQAENIADTLVHFKSRYSELGNTYNSITTALSSLPNAQSLQNVVSKNNNPYSPQGIETNYYLNQNSYNQIQTINQELGRNPFRKVGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKINTANFQFLFNLGLRMNLARAKKKGSDHAAQHGIELGVKIPTINTNYYSFMGAELKYRRLYSVYLN

SEQ ID NO: 20303 - protein, 695 aa, Helicobacter pylori
LSLSLSFLLHAEDDGFYMSAGYQIGEAAQMVKNTKGIQQLSDNYEKLNNLLTKYSTLNNLIQLSSSPSTINEVRDNLGSSGRNLLDVKTNSPAYQAVLLALNAAVGLWQVTSYAFTACGPGSNENANGGIQTFNNVPGQNTTTITCNSYYEPGHGGPISTENYAKINQAYQIIQKALTANGSNGDGVPVLSNTTTKLDFTINGDKRTNATPNKKLIYQWSHGKAISTSWNGGASTPTTENINTENNAQELLKQASIIITTLNEACPNFQNGGSGYWQGISGNGTMCGMFANEISAIQGMIANAQEAVAQSKIVSENAQNQNNLDTGKPFNPYTDASFAQSMLKNAQAQAEILNQAEQVVKNFEKIPKNFVSDSLGVCYEVQEGQRRGTNPGQTTSNTWGAGCAYVGQTITNLKNSIAHFGTQEQQIQQAENIADTLVNFKSRYSELGSTYSSITTVLSKVPNAQSLQNVVSKKNNPYSPQGIETNYYLNQNSYNQVQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARAKKKGSDHAAQHGIELGVKIPTINTNYYSFMGAELKYRRLYSVYLN

SEQ ID NO: 20304 - protein, 385 aa, Helicobacter pylori
LSGKAFNDKLDYLVGAYYFSEGGRESEDVAFPGGLLQIVGNYRFNTKSYALFTHLNYRVNDLIGITLGGRYTKEDKTLVGSQRDLNMLLTKLGTPAFLFPDPTDLSQFYPTGEQKLSFSNVSPRVGIELHPTERIMLYGSFSKGFKSGGWTTRVAAPVPPDPTKPADKQAPSFNPEKADTFEIGFKSQLFDRMLQVNAAAFYTDYKGIQIQIQRGIGASFENAGNARIKGFEVETIFAPSRVFRVSASAGYIDAYYRRINDPSGTITLASRLPRVPKWTATLSPEFNVFLANEGRVTLRADYSYKSTMAADAENTPELFSGNVSLVNASLTYSAPGDDWSLAIGGNNVFNKRYIANGVNQLNGAGLLSAVPNRPSEYYATLRFKF

SEQ ID NO: 20305 - protein, 694 aa, Helicobacter pylori
SLSLSFLLHAEDDGFYMSAGYQIGEAAQMVTNTKGIQQLSDNYEKLNNLLTKYSTLNTLIKLSADPSAINDARDNLSSSSRNLLDVKTNSPAYQAVLLALNAAVGLWQVTSYAFTGCGPGSNESTNGGIQTFHNVPGQNTTTITCNSYYEPGKDSTISTENYAKINQAYQIIQKALTANGSNGDGVPVLSNTTTKLDFTIQGDKRTGGSPNTPEKFPWSDGKYIHTQWINTTPQSTETKINTENNAQELLKQASIIITTLNEACPNFQNGGSRYWAGISGNGTMCGMFANEISAIQGMIANAQEAVAQAKIVSENAQNQSNLDTGKPFNPYTDAKFAESMLANAQAQAEILNQAEQVVKNFQKIPTAFVSDSLGVCYEVQGDERRGTNPGQVTSNTWGAGCAYVGQTITNLKNSIAHFGTQEQQMQQAENIADTLVNFKSRYSELGNTYNSITTALSKVPNAQSLQNVVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVYLN

SEQ ID NO: 20306 - protein, 694 aa, Helicobacter pylori
SLSLSFLLHAEDDGFYMSAGYQIGEAAQMVKNTKGIQELSENYEKLNNLLTRYSTLNNLIQLSSSPSTINEVRDNLGSSGRNLLDVKTNSPAYQAVLLALNAAVGLWQVTSYAFTACGPGSNKSANGGIQTFNNVPGQNTTTITCNSYYQPGHGGPISTENYAKINQAYQIIQKALTANGSNGDGVPVLSNTTTKLDFTINGGKRTNAHEGDRYKYPWTHGEYVPTQWVGGTNQNTTETIHTENNAQELLKQASVIITTLNEACPNFQNGGSGYWAGISGNGTMCGMFANEISAIQGMIANAQEAVAQAKIVAANTQNQSSLDTAKSFNPYTDAQFAQGMLANAQAQAEILNQVEQVVKNFEKIPTAFVNDSLGVCYEMQNGERRGTNPGQITSNTWGAGCAYVKETITNLNNSIAHFGTQEQQIEQAENIADTLVHFKSRYSELGNTYNSITTALSKVPNAQSLQSVVSKKNNPYSPQGIETNYYLNPNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEFVNLATVNNVYNAKINTANFQFLFNLGLRMNLARAKKKGNDHAAQHGIELGVKIPTINTNYYSFMGAELKYRRLYSVYLN

SEQ ID NO: 20307 - protein, 694 aa, Helicobacter pylori
SLSLSFLLHAEDDGFYMSAGYQIGEVAQMVKNTKGIQELSENYEKLNNFLNNYNTLNTLVKLSSDPSAINDARDNLGSSSRNLLDVKTNSPAYQAVLLALNAAVGLWQVTSYAFTACGPGRNKSANGGIQTFNNVPGQNTTTITCNSYYEPGHGGPISTENYAIINKAYQIIQKALTANGSNGEGIPVLSNTNTKLDFTIQGGKGTGGKLNDPLVYPWSHGKAISTQWIDTKQTLTTENINTENNAQELLKQASIIITTLNEACPNFQNSGNGYWQGISGNGTMCGMFKNEISTIQGMIANAQEAVAQSKIVSENAQNQNNLDTGKPFNPYTDASFAQSMLKNAQAQAEILNQAEQVVKNFEKIPKNFVSDSLGVCYEMQGGERRGTNPGQTTSNTWGAGCAYVGQTITNLKNSIAHFGTQEQQIQQAENIADTLVNFKSRYSELGNTYNSITTALSSIPNAQSLQNAVSKKNNPYSPQGIETNYYLNQNTYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNAANFQFLFNMGVRMNLARPKKKDSDHAAQHGIELGVKIPTINTNYYSFMGAELKYRRLYSVYLN

SEQ ID NO: 20308 - protein, 694 aa, Helicobacter pylori
SLSLSFLLHAEDDGFYMSTGYQIGEAAQMVKNTKGIQQLSENYEKLNNFLNNYNTLNTLVKLSSDPSAVNDARDNLGSSAKNLLDVKANSPAYQAVLLALNAAVGLWQVTSYAFTACGPGSNESTNGGIQTFNNVPGQNTTTITCNSYYEPGHGGPISTANYAKINQAYQIIQKALTANGSNGDGVPVLSNTTTKLDFTIHGDKRTGGKPNEPLIYPWSHGKAISTSWDNTTATQTTEQINTTNSAQELLKQASIIITTLNEACPNFQNGGRGYWQGISGNGTMCGMFKNEINAIQGMIANAQEAVAQSKIVSENAQNQNSLDTGKPFNPYTDASFAQSMLKNAQAQAEILNQAEQVVKNFEKIPKNFVSDSLGVCYEVQGGERRGTNPGQVTSNTWGAGCAYVEQTLTNLNNDIAHFGTRAQQIQQAADIADTLVNFKSRYNELGNTYNSITTALSKVPNAQSLQNAVSKKNNPYSPQGIETNYYLNQNSYNQIQTINQELGRNPFRKVGMVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVYLN

SEQ ID NO: 20309 - protein, 697 aa, Helicobacter pylori
SLSLSLSFLLHAEDDGFYMSAGYQIGEAAQMVKNTKGIQELSENYEKLNNFLTKYSTLNNLIQLSSSPSTINEVRDNLGSSGRNLLDVKTNSPAYQAVLLALNAAVGLWQVTSYAFTACGPGHNQSENGGIQTFNNVPGQNTTTITCNSYYQPGHGGPISTENYAKINQAYQIIQKALTANGAANGDGVPVLSNTTTKLDFTISGDKRTNAHEGDRYKYSWTHGQYVPTQWVDGSTQSTTENIHTENNAQELLKQASVIITTLNEACPNFQNGGSGYWAGISGNGTMCGMFANEISAIQGMIANAQEAVAQAKIVSENTQNQSDLDTAKPFNPYTDAQFAQSMLANANAQAEILNQVKQVVKNFEKIPTAFVNDSLGVCYEVQGGERRGTNPGETTSNTWGAGCAYVKETIMNLNNSIAHFGTQEQQIQQAENIADTLVHFKSRYSELGNTYNSITTALSKVPNAQSLQNVVSKKNNPYSPQGIETNYYLNQNSYNQIQTINQELGRNPFRKMGIVSSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEYVNLATVNNVYNAKINTANFQFLFNLGLRMNLARAKKKGSDHAAQHGIELGVKIPTINTNYYSFMGAELKYRRLYSVYLN

SEQ ID NO: 20310 - protein, 695 aa, Helicobacter pylori
LSLSLSFLLHAEDDGFYMSAGYQIGEAAQMVTNTKGIQQLSENYEKLNNLLNNYSTLNNLIQLSSSPSTINDARDNLGSSSRNLLDVKTNSPAYQAVLLALNAAVGLWQVTSYAFTACGPGSNENANGGIQTFNNVPGQNTTTITCNSYYQPGHGGPISTENYAKINRAYQIIQKALTANGSSGDGVPVLSNTTTKLDFTINGDKRTGGKPNEPLIYKWSHGKAISTAWDTTHTTSTTETISTENNAQELLKQASVIITTLNEACPNFQNGGSGYWPGISGNGTMCGMFANEISAIQGMIANAQEAVAQAKIVSENPQNQSNLDTTKLFNPYTDASFAQSMLANAQAQAEILNQAEQVVKNFQKIPTAFVSGSLGVCYEVQGGERRGTNPGQTTSNTWGAGCAYVEQTITNLSNSIAHFGTQEQQIEQAENIADTLVHFKSRYSELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGVKIPTINTNYYSFMGAELKYRRLYSVYLN

SEQ ID NO: 20311 - protein, 695 aa, Helicobacter pylori
LSLSLSFLLHAEDDGFYTSVGYQIGEAAQMVKNTKGIQELSDNYEKLNNLLNNYSTLNTLIKLSADPSTINDARDNLGSSSRNLLDVKTNSPAYQAVLLALNAAVGLWQVTSYAFTACGPGSNESANGGIQTFNHVPGQSTTAITCNSYYQPGHGGPISTENYAKINQAYQIIQKALTANGSNGDGVPVLSNTTTKLDFTIQGDKRTGGEPNEKLVYSWSHGKAISTQWINTTSQPTETKIDTTNSAQELLKQASIIITTLNEACPNFQNGGSGYWQGISGNGTMCGMFKNEISAIQGMIANAQEAVAQSKIVSENAQNQNNLDTGKPFNPYTDASFAQSMLKNAQAQAEILNQAEQVVKNFEKIPKIFVSDSLGVCYEVQEGERRGTNPGQVTSNTWGAGCAYVGQTITNLKNSIAHFGTQAEQIEQAENIADTLVNFKSRYSELGNTYNSITTALSNISNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKGSDHAAQHGIELGLKIPTINTNYYSFMGAELKYRRLYSVYLN

SEQ ID NO: 20312 - protein, 694 aa, Helicobacter pylori
SLSLSFLLHAEDDGFYMSAGYQIGEAAQMVTNTKGIQQLSENYEKLNNLLNKYSTLNNLIQLSSSPSAINDARDNLGSSSRNLLDVKTNSPAYQAVLLALNAAVGLWQVTSYAFTACGPGSNESANGGIQTFNNVPGQNTTTITCNSYYQPGHGGPISTENYAKINQAYQIIQKALTANGANGDGVPVLSNTTTKLDFTISGDKRTGGSPNEKLVYSWSHGKAISTAWNTTQVTQTTQAISTENNAQELLKQASVIITTLNEACPNFQNGGSGYWQGISGNGTMCGMFANEISAIQGMIANAQEAVAQSKIVSENAQNQSNLDTTKLFNPYTDAKFAESMLANAQAQAEILNQAEQVVKNFEKIPKNFVSDSLGVCYEVQGGERRGTNPGQTTSNTWGAGCAYVEQTITNLSNSIAHFGTQEQQIQQAENIADTLVNFKSRYSELGSTYNSITTALSKVPNAQSLQNVVSKKNNPYSPQGIETNYYLNQNNYNQIQTINQELGRNPFRKMGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKINTANFQFLFNLGLRMNLARAKKKGSDHAAQHGIELGVKIPTINTNYYSFMGAELKYRRLYSVYLN

SEQ ID NO: 20313 - protein, 739 aa, Helicobacter pylori
MKKHILSLTLGSLLVSTLSAEDDGFYTSVGYQIGEAAQMVKNTKGIQDLSDRYESLNNLLTRYSTLNTLIKLSADPSAINGVRNDLGASAKNLIGDKANSPAYQAVLLAINAAVGFWNVVGYVTQCGGNANGRESTSSTTIFNNEPGHRSTSITCSLNGYKPGYYGPMSIENMKKINEAYQILQTALKQGLPVLKENNGTVNVTYTYTCSGEGNNNCNALVGNGNGKDERNGGIKTETQTIDGKSVTTTISSKVVDSRASGNTLGVSYTEITNKLDGVPDSAQALLAQASTLINTINTACPYFNAPNSQAGGPKWEWPSDKMCGAFSQEISTIQKMITDAQDLVNQTSVINEHEQSTPVGNNNGKPFNPFTDASFAQGMLANAQAQAKMLNLAEQVGQAINPERLTGTFKNFVTGFLATCNNKSTAGTGGTQGSAPGTVTTQTFASGCAYVGQTITNLKNSIAHFGTQEQQIQQAENIADTLVNFKSRYSELGNTYNSITTALSSIPNAQSLQNAVSKKNNPYSPQGIETNYYLNQNTYNQIQTINQELGRNPFRKVGIVGSQTNNGAMNGIGIQVGYKQFFGQKRRWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHAAQHGIELGVKIPTINTNYYSFMGAELKYRRLYSVY

SEQ ID NO: 20314 - protein, 694 aa, Helicobacter pylori
SLSLSFLLHAEDDGFYMSAGYQIGEAAQMVKNTKGIQQLSDNYEKLNNLLNNYSTLNTLIKLSADPSTINDARDNLGSSSRNLLDVKTNSPAYQAVLLALNAAVGLWQVTSYAFTGCGPGSNESANGGIQTFNNVPGQNTTTITCNSYYQPGHGGPISTENYAIINKAYQIIQKALTANGSNGDGVPVLSNTTTKLDFTIQGDKRTGGKPNERLIYQWSHGKAISTAWNTTQTTSTTETINTTNNAQELLKQASIIITTLNEACPNFQNGGSGYWAGISGNGTMCGMFKNEISAIQGMIANAQEAVAQSKIVSENAQNQNNLDTGRPFNPYTDAGFAQSMLANAQAQAEILNQAEQVVKNFEKIPKNFVSDSLGVCYEVQGGERRGTNPGQVTSNTWGAGCAYVGQTITNLKNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKINTANFQFLFNMGVRMNLARAKKKGSDHAAQHGIELGVKIPTINTNYYSFMGAELKYRRLYSVYLN

SEQ ID NO: 20315 - protein, 273 aa, Vibrio harveyi
MRKSLLALSLLAATSAPVMAADYSDGDIHKNDYKWMQFNLMGAFDEKGAGPESSHDYLEMEFGGRSGIFDLYGYVDVFNLASDPGSDKAGAEKIFMKFAPRMSLDALTGKDLSFGPVQELYVATLMEWGGNSGVNNQKIGLGSDVMVPWLGKVGLNLYGSYYGNNKDWNGFQISTNWFKPFYFFENGSFISYQGYIDYQFGMEDKEGNKFNTNTSNGGAMFNGIYWHSDRFAVGYGLKLYKDVYGFEDGKALPWTQTVDSSGVAHYVAVTYKF

SEQ ID NO: 20316 - protein, 884 aa, Moraxella catarrhalis
MIHFSPVKSPLSLALLLAINTLPAIAADSSATEPTTQLQRIEVTGTAIRRVDAETAVPVTILRVEELQKQGVTTTEELVSRISANQSSVGSGRSVGSSSGGASYADLRGIGPNKTLVLLNGRRLSNNATNAINGSGVDLNTIPFAAIDRVEVLRDGASALYGTDAIGGVINFITKTSLTEGQISTNYDTPTHSGGGESRNFSGSWGFGDLQDDRFNVFGVVSYDKQNRLAADDRGYTYNYQPGRGLDYTSGTASPANWSQGSNATNPLAGSGCNAPGLLSRNGICRQSLWNYLDLVPETEKTSAFAKATGKLSDDHNVSLEYFWARNENRTQIGPGTLMGNQVNPGTAFYPGNGITPGPSGFALDPTQPVDVNWRETAVGARQHEDDNTGQRLLLSFDGTLVGWDYNLGASYNQNKVVNTIRSGYVNDRAVSQGIANGVINPFGPQTAAGSALLADNEVDGDYATAVGRVKAIDGRISREIGDWFGAGPSALALGGEYRKEDFHQDFAAFAGDVQSLGVDPNGSVKGDRSVSAQYAEVNVPVFDSLELSAAVRHDKYSDFGSTTNPKYSFRFQPFKELVVRGAYSEGFRAPSLYELYNPTFTSFTNANYNDPRLCAGGNPSNGGIANRDCAQQFNRTSGGNTDLSPETARNVTLGFVYQPFDRLTTGLDFWWIDIANQIAEFPESAVFENPELYPERLIRKPDGSIDHIVTGLANLGKIKTNGVDVSFDYRLPSTPYGDFGIGLQGTYVTRYDYQQQLKGDYIDKLGDFRGGDFASAGAVARWRHSLTGSWNYGPFGASLTNRYTSGYHDSDRETHDYVGSYNVWDVAGTYTWRKTLAVTLGVKNLFDREPPFSNQTYTFQSGYDPKYGDPFGRTLYTRINYKF

SEQ ID NO: 20317 - protein, 196 aa, Wolbachia endosymbiont
GPISDEETSYYVRLQYNGEILPLFTKIDGITNATGKEKDSPLKASFVAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVAFNF

SEQ ID NO: 20318 - protein, 728 aa, Ralstonia eutropha
MSRRLTSLYWISGTSALALAGAAQGATPAAPAEIDANAAPAVEQVVVTAERRVTDLQKTAIAISAFSGQLLADRKIDSIRDLSGQIPNFSISRVTISHTTQTYALRGVGESDPIQEPVLAVYVDDVYIPRQIGSMVEFNDLERVEVLRGPQGTLYGRNSSAGALRIITRDPGEAFRAKAEVGLGNYGAVDVRGLIEGPLVEGKVSGSLSYIHHSRDGVTFDPTLNHDVNRIDLDAYRAKLRWTPTDRLDVLLTLNALKDRSDTRSYVPVKQPGGGFRNDRSYSEVEPTQDLDQVSGALRVQYTLNDNLKLKSVSSYGGFNLNPVAYDNDGEAALIQKNLIHYNDQYVTQEIQLNGDYGKLTFTSGAFYLHERFFVQRDGYSRRNAVPSDPVTTPGSYGFARAHNITNTDAYALFGEATYALSDRLSVTGGLRWTNEKKDFLFDNKVLNLAGQVTGQSIAGHADKIFSAVTPKLSAQFQWTPDVLQYVTYSRGFKSGGFDNRATRLDLATRPFAPEKVDTYETGLKTELLNHRARLNLAVFYNDYKDLQVSYSDPAYPGNSVRGNAGKAHTYGVELESDVRATERLSLQASAGYLFAVYDKYKNAGGLGVDADGHRLLNSPRWSVSGGVTYDVPVGIPGSIRVGLNAQFQTKTYFSALQRPQDQAPAQTFVNGTVTWQSPDPRWSVQLSGRNLLDSDEPVSATYTPSTGVYYKNYPDPRTWLVTLKYAL

SEQ ID NO: 20319 - protein, 1156 aa, Ralstonia eutropha
MIQAQDNQRISVDLREETLESVLWYLQNRTKFIFMYATEDIANITDISVRAKDKTITEILDECLEGTNLTYEISGSAIVIKKRKTDKITISGWIRDTSGEALPGATVSVRGSKQGAIAGLDGHYTFSIPAQEGLILTYSFIGMEKKTVKYTGKRTINVTLNNSSNTEIDEVVVTGYQNIQRRDLVGSITTVKAKDIIMPSYTTIDQMLQGRVAGMVVTNTSSRVGTAPKIQIRGTSTLLGNQDPLWVVDGIIQEDPLELDATSLMTNDLKNIIGNQISWLNPADIESISILKDASATAIYGSKASNGVIEITTKKNTTDRLSVNYTSNFIIGTRPNYDQFNYMNSKERVLFSQEAFNWGTPYSAEPIKQMYTYEGLLNMYLSHDISSEEFLAQRNVLETQNTDWFKLLTRRAFSHNHNLSVSGGTNKYSYSASMGYSKSEGQEIGNDSERMTGRLAITIRPVQKLTINAAINGSVNTNKGFAGGVNPLGYATTTNRSIDPDVYYQMKASYPYNEGVRSLSYNFINERENSGSKSASSYLSASLDLKWNILDWLTYQFTGGYSDNNSTNEAWESERTFYIAENYRGYDFNSVSPASKEFKAALLPFGGELFTNNTHQYSYNIQNKLQFSKAFNDENRLNALIGMELRSTTNKGINNTVWGYVPDRGEVITSPTTLQAFEPITGSQNSGWGILQRIYDGGWRKVNTTDNFFSVFATLAYSFKNRYVINANVRNDASNRFGQDTNHRIDPTYSFGFSWRASEERFMRKYVGWITNLNFRGTYGIQGNALTRLSPDLILNQGTVADLYNRYQSTISQIPNPTLSWERTKSWNFGIDLELFNLFNMNLEYYTRRSNAIVELDLPYEYGISSMKRNGGIIHNRGIEYTLTFTPIQKRDYALSVSLNASKNWNEGGHTDIEVKASDFLNGRSDIILKQGYPLSSFWSYSFAGLNGQTGEPQFNLLDIPDDQRSRLIDPTTYLVYSGQRDPYFTGGLSLSFRYKSLTLNSSFSLLLGNKKRLPSPYSQFSSSYYMPDPYTNINRDLLNRWKEPGDEAHTIIPSLPKGNMSLIQLPNGESTFKIPVWEQSDAMVVSGSFLRCRNIGLSWQMKREWCEKIYMKNLSLNFNMDNIFVIASKRFNGFDPEISNSVLPRNYSLGINIGF

SEQ ID NO: 20320 - protein, 718 aa, Pasteurella piscicida
MNIKLSFIASSVLLAVSTPSLANSNNEASIFDEVVVSGTRSEQSVKNIPSTVSKVTAEQMEKNLATDVKQALKYEPGVTVNGRGRFGMQDFTIRGMSGNRVKMLIDGVEQPVSYNPGADVMRKNSNTIEVDTLTAIEINKGPSSSLYGSDALGGTVFLRTKNPEDMLGAGDDSHVGVTSGYSSADEQYKLGFEVANRTGDLESMLIYTYRNGHETDTYYKDSNEIGDARKAANPFDIASHNVLAKIFYQINDANRVGFTAEYYTRSADGRILSSDGKTISMRPPMPPIMYSNNRADDHDHRLRLGLEHEWLAEIAAFDSLEWKLNWTESESKHNSYDKTNYYGNRNRYRDGTDDTIQLDIQMKKELELANNRHEITYGVSGTNNTFDITYTDYNLDKGTSKLGPEEVPKSKSEKRAVFVQDQMFMLDEKLVVTAGLRYDDYQAEPDSDTLKDHKSDAFTGRLGAVYHFTDNFSTYGQFTQGFRAPTIHELYYDKENLAHGYKVISNPNLKPEESDAVELGLRLNGHLGSVATSVFYNNYKNFIKDVTTYDSNNIQITTNENVDKAKIYGAELKTSIWLDEALNAPMGTYANFSVAYTRGEDKKTGRELDTVAPLTAVLGLGYDSPDEMWGGVVDVTMVATKDKWQEEDHFNTPGYTVVDMTTYYRPSKDLTVRAGLFNAFDKKYWQYQNVDGIIVGKENFNCKTEPGRNWGVNVKYDF

SEQ ID NO: 20321 - protein, 355 aa, Burkholderia thailandensis
MDKSKRHLAWWVVGLLAVAAIVAWWLLRPAGVPEGFAVSNGRIEATEVDIASKIAGRIDTILVKEGKFVREGEVLAKMDTRVLQEQRLEAIAQIKEAQSAVAAAQALLEQRQSETRAAQSLVNQRQAELDSVAKRHTRSRSLAQRGAISAQQLDDDRAAAESARAALESAKAQVSASKAAIEAARTNIIQAQTRVEAAQATERRIAADIDDSELKAPRDGRVQYRVAEPGEVLAAGGRVLNMVDLSDVYMTFFLPTEQAGTLKLGGEARLILDAAPDLRIPATISFVASVAQFTPKTVETSDERLKLMFRVKARIPPELLQQHLEYVKTGLPGVAWVRVNEELPWPDDLVVRLPQ

SEQ ID NO: 20322 - protein, 99 aa, Wolbachia endosymbiont
  misc_feature (93)..(93): Xaa can be any naturally occurring amino acid
LEIGGRAEARMSLKDGKAEDKTRVRLNFLGKTQITDSLYGLGFYEAEYTTADNTVTVDGKTTDGDNIEHRYTYAGIGGDFGEVTYGKNDGALXVITDFT

SEQ ID NO: 20323 - protein, 429 aa, Shigella flexneri 2a
APASTHTATGAPFVSDQSEANGIVEDAKLTETLKNYYFNRDNKIGGRDQKDWTQGFLGNFTSGYTQGTVGVGIDAYGYLALKLDGGDGTSGSGNMSRSDTVNPNNGARDVNDSQGKAGASVKFRVSKTELNFGDMQPSTAPVFAVGGSRILPQTATGFQLQSSEVKDLDLEAGHYYSASSQDKNARNGGLYANYAGVEADSIDYFGGKYSITENLSASLYGAKLEDIWNQYYANVNLTTPFSGDTSLNTDFNIYRTTDTGDKLAGDISNTAFSLATALSILKAHTFTLAFQKVNGDTPFDYIGVGKNNRGGDSIFLANSIQYSDFNGPGEKSGQARYVLKMAEYGVPGLSFMVRYVKGWDIDGTSTPAGSPYTGLYGEDGKHDVTIFEAEYVVQSGPAKDLSLRIRQAWHFANADGGEGVTKEFRLFVD

SEQ ID NO: 20324 - protein, 234 aa, Wolbachia endosymbiont
LPGYDEKTPVPGGIIAGVFVPFGEKDFVYGSTPPPQGYIDCRYTTPCYQNNVRKNLALLLRKTTYKHHSYNLGLNLDPTDWLRVQLKYANGFRAPTSDEIYMTFKNPQFSILPNTDLKAETSKTKEVAFTFYKNSSYITLNAFQNDYRNFIDLVEVGERPIEGGSTIPYPFHQNQNRDRARVRGIEIASRLEMGDLFEKLQGFHLGYKFTYQKGRIKDNGLHPKYKEFLELNKT

SEQ ID NO: 20325 - protein, 250 aa, Wolbachia endosymbiont
YSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHIESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARF

SEQ ID NO: 20326 - protein, 694 aa, Serratia liquefaciens
MPLIYSTRLRLSALSLAIACTLPTVTFAQTSETPSSSSATAPVKKDKASDETMTVAATGNARSSFEAPMMVTVIEADTPQSQTATSAGDMLRRVPGITVNGTGRSNGQDVFMRGYGKNGVLTLVDGIRQGTDTGHLGATFLDPALVKRIEVVRGPSALLYGSGALGGVIAYETVDAADLLLPGHNSGYRVYGTAGSGDHSLGMGASTYGRTDNLDGLLSFGTRDVGNLRQGNGFDAPNDETISNLLAKGTWTLDENQSLSGDLRYYNNRAQEPKNPQESASSSGNQMTDRSTIQRDGQLGYKLKPVGQDWLDAEAKIYYSEVEINAHTNGSEDEARKQTTRGAKLENRSRLFADTFASHLLTYGSEAYKQEQTPGGATESFPQAKINFASGWLQDEITLRDLPVTLLAGTRYDNYKGSSDGYADVDADKWSSRGAVTVTPTDWLMLFGSYSQAFRAPTMGEMYNDSKHFSIPMGPTTITNNWVPNPNLKPETNATQEYGFGLRFDDLLLADDSLQFKASYFDTKARDYITTDVTMELGRGPRGPYCISCTTFSTNIDRAKIWGWDATLSYKTAIFGWDLAYNRTRGKNESSGEWLNSINPDTVTSTLDIPLGETGLSTGWVATVAQRATRVETGTAEQGGYGVNDFYLSYKGRERLQGVTTTVVLGNAFDKEYYSPQGIPQDGRNAKLLVSYQW

SEQ ID NO: 20327 - protein, 241 aa, Yersinia pestis
LTAKLSYPIYDDLDIYTRLGGMVWRADAKNNVVGGDRSNHDTGVSPVFAGGVEYAWTPSIATRLEYQWINNIGDAGTVGTRPDNGMLSVGVSYRFGQDEAAPVVAPAPAPAPQVQTKHFTLKSDVLFNFNKSTLKPEGQQALDQLYTQLSNLDPKDGAVVVLGYTDRIGSDAYNQRLSQQRAQSVVDYLVSKGIPAGKITAQGQGESNPVTGNTCDNVKKRAALIDCLAPDRRVEIEVKGV

SEQ ID NO: 20328 - protein, 115 aa, Wolbachia endosymbiont
SKWRHMVNVRYGFDRYTMGLRWRYIGKMNYEDTDGTPGSTDKLLVNGGNRVSAYNYLDLTGSIQLDNDITWTMGLNNVFDREPPLVGSSLSYNGNALKGYDQAGRYFFTSIGLKF

SEQ ID NO: 20329 - protein, 754 aa, Sphingomonas elodea
MTLANDAPAPSRTAASDVAELLLQFDLNQQGLDDTVLLLKTKGGELYASAEDLKRWRLRQPEATPLAHNNEVFYPLKAITGLSYQLDETLLTVAVTAPAQAFLPNAFDEANKPVALSLKPGFGGFLNYDLLAEHATGQTRSSGLFEAGVFNGLGVGVASFVANSGDTEHRLIRLETTWTKDLPDHLSSVRLGDSISRAGAWGRSVRFGGIQYSTNFAVQPGFVALPLQSIGGQAALPSTVDVYVNNVLSSRKDVAPGPFSITNVPVVTGQGDVRVVVRDLLGREQVISVPFYASASLLAKGLHDFSYEAGAERRNFGTDSNDYGRAFAAATHRLGFTDWLTGEVHAESQLERQTVGLGTVMLAPSVGVFSAAAAASRGRQGSGGLVSVGFERQASPVSVGVHAQLASPRFTQLGLELDMPAPRLLSSVNVGMALPGGGSLGLAYVYLDNRDGHPTQLASASYGTQLGRFGFISLALSKTLHQPGGLMVGLNWTLPLGERTTTSINMTQQQGRTEVQAQVQQGLPPGDGFGYSVRASQLGAWDAALNAQNRVGTYLLEAAGDRGQTGVRMGASGGIAILDGLHLSRRISDSFAVVKVPDFPNVRIYADNQLVAKTNASGEALIPRLRAYEKNAISLEQLDLPFDAKVGTLSLDAVPYYRSGMVLDFPVTHAHDALMTLKLENGSDLPAGATVQISGQKEAFPVGNDGVVYLTGLAAQNRLQANWRGQSCDISVPFTPGADPLPDLGIFVCKGVRP

SEQ ID NO: 20330 - protein, 234 aa, Uncultured Acidobacteria bacterium
MMINTISGRHAVFGLVGISACVLYSHSAFAWQQEYIVSDAHNNTAERYTWDADHQPRYEDILAERINTSQNSAGFTLNTASGLPSEAPEGVSIGWNFPLQGQMTTGPVAEWRYDGSAPSMANEFGDTLTTQSLTDPLWHASISSLGWRLNTKVGDLRPWAQISYNQQFGENQWKSQYGMPQTPAPAQSGNWMDVTVGTDIPFNTHMAAYASLAQGEGNIAGEETLYTLGVSAKF

SEQ ID NO: 20331 - protein, 714 aa, Uncultured Acidobacteria bacterium
MCVKNALLSTAAATVKGATATIGAGAWLCVAGVAIAQEPNETEAKSADKGEIETVLVMGKRQGSYTIITEDTLKLVKMPGALGDPLGAITALPGVITPAAGGEPAVRGSSPSDNRYFVDGMPAGYIFHEFNTSIIDENIIQDFQLYPAGFSAQYANATGAVFDIRLRDPVQQDFTTTLTASMLRSGVLFESALSENSAFYLSARHGMLPLFLPEEDTPDDDGIRIISAPTDSDYVSKFLWSNSEKNRLSVNFMGATDKGKAEFSELSDMVAENPDFAGEAEIQDKFDSQSVVWDYQLASGAELHILAAHYKDEENLHWGDNYFQNIETENALLKTNVAFAVAANHIINIGAEVDNMDYAFKVRQPLFTCTEFDADCQANRRDVIDVTLPLTVKQQSLFAIDQWQATDALQLELGLQWHANDQTDQTFIHPRGSFALAVSERVTLKGSAGSYNRLPDVQYSMPELGNPKLQSYQSKHYSLGLEGKGLEGKGLEGKGLIGRALSDWNWSLELYHKTFSELPRTLAADEPNAEDIYANGTEGEARGIDIFINKNFSNRWYGWVALSYSESTRTNTATDQTLDYTLDTPLVLNVVGNYQLTHNWNIGFRYTAKSGEANTQIVGVKQNPNFAGHYLPVYGEPFADRLPMQSRLDFRAERPITVFGKEGVFFVDVINLLNRKNVSEIVLDHEKVKETGELHLVKNVDMEIFPSIGMSLSF

SEQ ID NO: 20332 - protein, 1029 aa, Pseudoalteromonas haloplanktis
MKSMRERLLASSMICGAALLGLSATQASAQEVSEVVVTGSRIPQPNLTSASPVTVVGAADIATRGITRTEDLVNQLPQVFAAQGSSYANGATGTATVDLRALGANRTLVLIDGRRLQPGTPAAGATNTAPDLNFIPAALVERVEVVTGGASAVYGADAVAGVVNFIMQKNFEGVRLDAQYSGYQHTNENDRIQDLLRRRGSTALNPAAFAIPEKDVWDGGVTDLNLVVGINSPDDRGNITAYVGYRNVQAVTQNNRDYSACTLARSTSDPSGFTCSGSGTTSPARFISGGGGGDNDVTIDPAAPGGRGFRDYVGSRDAFNFAPYNYYQRPDTRYTMGAFANYEFNEHAEFYAQLMFMDDHTAAQIAPSGIFGQNMNINCEGNPFLTAAMAEAFCAPTIDQLPDDANFPNTIGVNTDADPITPGQQASVAVLRRNAEGGGRVSDLRHTDYRGVLGMRGEIGSGFMYDVFAQYGVVEYQNIYFNDFSLSRAAKAMDVVVDPATGLPACRSAVPSLAGNNVDAACRPYDIFSIAGPSQASIDYLQTPGFQNGTYEQTVVSGSITGDLGQYGVKAPWAADGVGIAVGTEYRRERLKLNTDIAYQTGDLAGQGGATLPSEGAYDLYELFGEARIPLVQDQPFFQNLSMELGYRWSDYSLGFSTDTYKIAGDWSPNSDLRFRASYNRAVRAPNIVELFSTANVVLNGSIDPCEGTTPDATFEQCARTGVTAAQYGNIAANSAEQYNGQTGGNPDLDPETSDTYSVGVVLTPTFMPGFSLSVDWFNISLKDRIGQIGQDVTLERCLETGDSFYCGLIQRAPGTGSLWLSQNGYIVDTTFNTGKLEVEGVDVEANYRFDFGDFGMTSGLDQFGGLSFNFQGSYLDKYAVTTLPGDEPYDCAGYYGGTCTSSGTPASAPMPEWRHKLRATWRTPWDFELSTTWRYVSSVKSDRFVFDEAATETWRDDKLTDKNYFDIAGTWAVRENMTLRFGVNNVFDNEPPLVSQSNCPSGPCNGNTYPQTYDALGRYLFVGIRADF

SEQ ID NO: 20333 - protein, 344 aa, Neisseria gonorrhoeae
MKKSLIALTLAALPVAATADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQTYSMPSLFVEKLQVHRLVGGYDNNALYVSVAAQQQDAKLYRAMSGNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 20334 - protein, 464 aa, Erwinia sp. Ejp 556
MKKSTLSLAIGLLLACSTGMAKTQHLMLEQRMALLEERLEAAEMRAAKAESQVKQLQTQQAAEIREIKAAQGNTPVNGQATAESAKKNATSPNLLLSGYGDLKIYGDVEFNMDAESNHGLLAMTNADVNSDPTNEQWNLNGRILLGFDGMRKMDNGYFAGFSAQPLGDMHGSVNIDDAVFFFGKENDWKVKVGRFEAYDMFPLNQDTFVEHSGNTANDLYDDGSGYIYMMKEGRGRSNAGGNFLVSKQLDNWYFELNTLLEDGTSLYNDGNYHGRDMEQQKNVAYLRPVIAWSPTEEFTVSAAMEANVVNNAYGYTDSKGNFVDQSDRTGYGMSMTWNGLKTDPDNGIVVNLNTAYLDANNEKDFTAGINALWKRFELGYIYAHNKIDEFSGVVCDNDCCIDDEGTYTIHTIHASYQFANVMDMENFNIYLGTYYSILDSDGDKKHGDDTDDRYGARVRFKYFF

SEQ ID NO: 20335 - protein, 186 aa, Helicobacter pylori
MIKRIACILSLSASLALAGEVNGFFMGAGYQQGRYGPYNSNYSDWRHGNDLYGLNFKLGFVGFANKWFGARVYGFLDWFNTSGTEHTKTNLLTYGGGGDLIVNLIPLDKFALGLIGGVQLAGNTWMFPYDVNQTRFQFLWNLGGRMRVGDRSAFEAGVKFPMVNQGSKDVGLIRYYSWYVDYVFTF

SEQ ID NO: 20336 - protein, 162 aa, Wolbachia endosymbiont
  misc_feature (6)..(6): Xaa can be any naturally occurring amino acid
  misc_feature (62)..(62): Xaa can be any naturally occurring amino acid
  misc_feature (72)..(72): Xaa can be any naturally occurring amino acid
  misc_feature (84)..(84): Xaa can be any naturally occurring amino acid
  misc_feature (116)..(116): Xaa can be any naturally occurring amino acid
  misc_feature (123)..(123): Xaa can be any naturally occurring amino acid
  misc_feature (136)..(136): Xaa can be any naturally occurring amino acid
SYYVRXQYNGEVFPFKTRIDGIEYKKGAEVHDPLKASFMAGGAAFGYKMDDIRVDVEGLYSXLNKNDVSGAXFTPTTVANSVAXFSGLVNVYYDIAIEDMPITPYVGVGVGAAYIXNPSEADXVKDQKGFGFAYQXKAGVSYDVTPEIKLYAGARYFGSYGA

SEQ ID NO: 20337 - protein, 605 aa, Xanthomonas vesicatoria
MASTLCPIRSLMAIAIALAATPAMAESAFDRTVFFGDSLTDSGYYNPLLPAASRAVTGKFTTNPGWVWAEYVADHFGTNAAPNGNGQIGDNYAAGGARIQASAVSALGAAPSVSSQINTYLTANGGRADPNALYTVWGGANDLLAAATVPAQAQAIIGSAVTAQVGAVAALQNAGARYVMVPTIPDVGLTPRFRAGGAVGMAQGTGAATAYNNALFNGLQSAGLRVIPVDTFHMLQEIVASPGTYGFSNVTNTACNPAVPLPACNPTSLVAANAQNTYVFADGVHPTTAVHQILGEYAISLLEAPRLQQVLIHSAQAVGRARADQVAWHLDGKPDADGMRWWGSVRGDMQRYDHADLYDGMAPAGLFGVDWTAGDMVFGGFAGFGRMDADFGHRNGSFKQDDSTLGGFFGWYTGPVWVNAQVSYSWLSYDVDREVQLGPATRVHRGSPDGSNLTAALNAGYSLGEGNVKYGPVAGLTWQKIKLDGYTESNDTSTALGYASQDVDSLVGRVGFQVRLDGAMVKPYLQATYDHEFKEGGEASAWLQSMPDVGMYTVPGQDFDRNYATVVLGARTGLWGLQSNVGLSTTTARRSARDATLFVNFSGNF

SEQ ID NO: 20338 - protein, 1674 aa, Rhizobium fredii
MRTLTQTILPGWRWLAGLSMLGHIGTCIRAGMRRSVLAMLALGACQMMLSSPVWAAACTVTFSTTANTQKAYVFTSTNTSNCDPFLIGIAYDSAGDANSSSGPVVNTATTQGGTVAIYNGSVPPSGDPNTNGFVYTPPTNFSGTDTATFYTSNDGVSWLPNGTLSITVTSTGPTVTGISPSSGSTSGGTSVTVTGTGFTGATAVKFGSTNASSFTVNSATSITATSPAGSAGTVDLTVTTSGGTSATSAADRFTYVAPPTANASSATVAHGSSSNAITLNITGGTPTSVAVSTAASHGTATASGTSITYTPTASYSGTDTFAYTATNAGGTSAPATVTITVSNATVSYAPSAPAGGTVGTAYSQSVASASGGTSPYTYALASGSLPPGLSLSTGGTLSGTPTSSGSFSFAITATDSSTGTGPFSATSGTLSLTVSAPTITLSPSSLTSATVGGASSQSVSASGGTSPYTYAITAGALPAGMSLSSAGVLSGTPTAGGSFSFTATATDSSGGTGPYTGSRAYTLTVNAPTLSITPAAGSLSATGGVAYSQSFVAASGTAPYTYALAVNSGTLPTGLSFNTATGVLSGTPTTTGTVNFTVTGTDSSTGTGPYTVSAIYTLTTSAPTVSLSPTTLSSATVGTATSQSVTASGGASPYSYAVVSGALPAGLSLNASTGTLAGTPTAAGTFSFTVRATDANAYSGTRSYSLTVAAPTIALSPTTLAGATVSTAYSQSVTAGGGTAPYTYTVTSGALPTGLSLSSAGTLSGTPTAGGSFSVTISATDSTTGTGPFTGSRAYTLSVGSPTLAIAPASTAGLTAVAGAGYSQTFTASGGNSPYTYALTVNSGTLPTGLAFNTGTGTLSGTPTTAGAVGFTVTATDSSSGSGPYAVSGTYTLTVSAPTLTVAPATLPNPALGTAYSQTLTASNGTAPYTYAVTSGALPAGLSLSSAGVLSGTPTAGGSFSFTATATDANSFTASRAYSFTIGAATVVLNPATVPGATLNTAYSQTLTASGGIGPYTYAVASGTLPAGMSLNGTTGVLSGTPTALGSSTVTVRATDSSTGTGAPYSGTRSYTLTVGQTIGAAPPVTATTTSTAPVTLHPTANATGGPFSAVTIVTAPASGTAVVNGLDIVYTPTPTTSGNVTFTFALVNTAGTSAPIQATVTVNAVPIAVTQKTASTASGQAVNVDLTDGATGGPFTGAAIVSVVPANAGTATIAQQTSQATTGIKPLAAAAPVYLLSFTPASAFSGTATLTYTLSNAVATSAPAVVQVTVAPRRDPSTDPDVNGLINAQIQAARRFATTQIGNYHQRLEALHGTGRAPSGNGLTVALPSPRGDAQARCQDVFGIAARDACLRGDGSAGQPALARGKRNGETRNDAGNADAGPDLPGANADATADTSQPDLAFWTAGTLDFGFANTSAQRSGFRFTTGGVTAGADYRVSDRLSVGAGFGYGRDSTDIGNAGTKSTGDSYSLALYGSYRPLPTLFVDGVAGFGTLSFDSRRWVSDANDYAMGSRNGHQIFASVSAGYEHRDNVWLISPYGRLSVSESTLDQFSETGAGLNALTYFQQTVTTVSGTLGLRTEYAQKTRWGTFLPYARVEYQHDFNGQSNAGLAYADLASAGPAYYVMGSPYGRDRMQVGLGTKFRTGPLTFGLDYSVMVGMGGLQQGVRLTFAAPF

SEQ ID NO: 20339 - protein, 1069 aa, Rickettsia sp. Chad
ITLQAGGSLVANNIDFGARSTLEFNGPLDGGGKAIPYYFKGAIANGNNAILNVNTKLLTASHLTIGTVAEINIGAGNLFTIDASVGDVTILNAQNINFRARDSVLVLSNLTGVGVNNILLAADLVAPGADEGTVVFNGGVNGLNIGSNVAGTARNIGDGGGNKFNTLLIYNAVTITDDVNLEGIQNVLINNNADFTSSTAFNAGAIQINDATYTIDANNGNLNIPAGNIQFAHADAQLVLQNSSGNDRTITLGANIDPDNDDEGIVILNSVTAGKKLTIAGGKTFGGAHKLQTILFKGAGDCSTAGTTFNTTNIVLDITGQLELGATTANVVLFNDAVQLTQTGNIGGFLDFNAKNGMVTLNNNVNVAGAVQNTGGTNNGTLIVLGASNLNRVNGIAMLKVGAGNVTIAKGGKVKIGEIQGTGTNTLTLPAHFNLTGSINKTGGQALKLNFMNGGSVSGVVGTAANSVGDITTAGATSFASSVNAKGTATLGGTTSFANTFTNTGAVTLAKGSITSFAKNVTATSFVANSATINFSNSLAFNSNITGGGTTLTLGANQVTYTGTGSFTDTLTLNTTFDGAAKSGGNILIKSGSTLDLSGVSTLALVVTATNFDMNNISPDTKYTVISAETAGGLKPTSKENVKITINNDNRFVDFTFDASTLTLCAEDIAADVIDEDFAPGGPLANIPNAANIKKSLELMEDAPNGSDARQAFNNFGLMTPLQEADATTHLIQDVVKPSDTIAAVNNQVVASNISSNITALNARMDKVQSGNKGPVSSGDEDMDAKFGAWISPFVGNATQKMCNSISGYKSDTTGGTIGFDGFVSDDLALGLAYTRADTDIKLKNNKTGDKNKVESNIYSLYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYRINYDTNIGSKYFAQQGSVKVRVNF

SEQ ID NO: 20340 - protein, 355 aa, Aeromonas veronii
MKKTILAIAIPALFASDANAALVYDKHGTTFDVYGRVQANYYGDHNTADSTAASGYKDVDGELVGSSRLGWSGKIALNNTWSGIAKTEWQVSAENSANKFDSRHIYVGFDGTKYGKIIFGQTDTAFYDVLEPTDIFNEWGDAGNFYDGRQEGQVIYSNTYGGFKGKLSYQTNDDKAVKVTDVGQGIKETAVYGADVKRNYGYAAAAGYDFDFGLGLNAGYSYSDLENTKTNNTGDKKEWALGAHYAINGFYFAGVYTQGDLSYDNTTGGDKDKGRGYELAASYNVDAWTFLAGYNFKEAKVKSNTAGAEYKDLLDETLLGVQYAFTSKLKAYTEYKIQGIDKLDDEWTVALQYNF

SEQ ID NO: 20341 - protein, 1060 aa, Rickettsia heilongjiangensis
ITLHAGGSLDANNIDFGARSTLEFNGPLDGGGNAIPYYFKGAIANGNNAILNVNTKLLTAYHSTIGTVAEINIGAGTLFAIDASAGDVTILNAQDINFRALDSGLVLSNLTGVGVNNILLAADLVAPGADEGTVIFNGGVNGLNIGSNVAGTARNIGDGGGNKFNTLLIDNAVTITDDVNLEGIQNVLINNKADFTSSTAFNAGAIQINDATYTIDANNGNLNIPAGNIQFAHADAQLILQNSSGNDRTITLGANIDPDNDDEGIVILNSVTAGKKLTIAGGKTFGGAHKLQTIVFKGAGDCGTAGTTFNTTNIVLDITGQLELGATTANVVLFKDAVQLTQTGNIGGFLDFNAKNGTVTLNNNVNVAGTVKNTGGTNNGTLIVLGASNLNRVNGIAMLKVGAGNVTIAKGGNVKIGEIQGTGTNTLTLPAHFNLTGSINKTGGQALKLNFMKGGSVSGVVGTAANSVGDITTAGATSFASSVNAKGTATLGGTTSFAHTFTNTGAVTLAKGSITSFAKNVTATSFVANSATINFGNSLAFNSNITGSGTTLTLGANQVTYNGTGSFTDTLTLNTTFDGAAKSGGNILIKSGSTLDLSGVSTLALVVTATNFDMNNISPDTKYTVISAETAGGLKPTPKENVKITINNDNRFVDFTFDASTLTLFAEDIAADVIDKDFAPGGPLANIPNAANIKKSLELMGDAPNGSDARQAFNNFGLMTPLQEADATTHLMQDVVKPSDTIAAVNNQVVASNISSNITALNARMDKVQVGNKGPVSSGDEDMDAKFGAWISPFVGNATQKMCNSISGYKSDTTGGTIGFDGFVSDDLVLGLAYTRADTDIKLKNNKMGDKNKVESNIYSLYGLYSVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQRKTSFDVGVGVTAKYKMMEYGINYDTNIGSKYFAQQ

SEQ ID NO: 20342 - protein, 116 aa, Rickettsia heilongjiangensis
FADHLHPGPQVHTIIAQYIQSIIAAPVQATYLNQSVQSMAQGSRTTLNSRYQQLRQGENPVGSLGMFGGYSGGYQRYDNNEAEGHGNHNNLTVGVDYQLNEQVLLGGLIAGTLGKK

SEQ ID NO: 20343 - protein, 199 aa, Shigella flexneri
MRKLYAAILSAAICLAVSGAPAWASEHQSTLSAGYLHVSTNVPGSDELNGINVKYRYEFTDTLGMVTSFSYAGDRNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIMGVGYKF

SEQ ID NO: 20344 - protein, 746 aa, Shigella flexneri
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 20345 - protein, 1609 aa, Chlamydophila caviae
MVAKKTVRSYRSSFSHSVIVAILSAGIAFEAHSLHSSELDLGVFNKQFEEHSAHVEEAQTSVLKGSDPVNPSQKESEKVLYTQVPLTQGSSGESLDLADANFLEHFQHLFEETTVFGIDQKLVWSDLDTRNFSQPTQEPDTSNAVSEKISSDTKENRKDLETEDPSKKSGLKEVSSDLPKSPETAVAAISEDLEISENISARDPLQGLAFFYKNTSSQSISEKDSSFQGIIFSGSGANSGLGFENLKAPKSGAAVYSDRDIVFENLVKGLSFISCESLEDGSAAGVNIVVTHCGDVTLTDCATGLDLEALRLVKDFSRGGAVFTARNHEVQNNLAGGILSVVGNKGAIVVEKNSAEKSNGGAFACGSFVYSNNENTALWKENQALSGGAISSASDIDIQGNCSAIEFSGNQSLIALGEHIGLTDFVGGGALAAQGTLTLRNNAVVQCVKNTSKTHGGAILAGTVDLNETISEVAFKQNTAALTGGALSANDKVIIANNFGEILFEQNEVRNHGGAIYCGCRSNPKLEQKDSGENINIIGNSGAITFLKNKASVLEVMTQAEDYAGGGALWGHNVLLDSNSGNIQFIGNIGGSTFWIGEYVGGGAILSTDRVTISNNSGDVVFKGNKGQCLAQKYVAPQETAPVESDASSTNKDEKSLNACSHGDHYPPKTVEEEVPPSLLEEHPVVSSTDIRGGGAILAQHIFITDNTGNLRFSGNLGGGEESSTVGDLAIVGGGALLSTNEVNVCSNQNVVFSDNVTSNGCDSGGAILAKKVDISANHSVEFVSNGSGKFGGAVCALNESVNITDNGSAVSFSKNRTRLGGAGVAAPQGSVTICGNQGNIAFKENFVFGSENQRSGGGAIIANSSVNIQDNAGDILFVSNSTGSYGGAIFVGSLVASEGSNPRTLTITGNSGDILFAKNSTQTAASLSEKDSFGGGAIYTQNLKIVKNAGNVSFYGNRAPSGAGVQIADGGTVCLEAFGGDILFEGNINFDGSFNAIHLCGNDSKIVELSAVQDKNIIFQDAITYEENTIRGLPDKDVSPLSAPSLIFNSKPQDDSAQHHEGTIRFSRGVSKIPQIAAIQEGTLALSQNAELWLAGLKQETGSSIVLSAGSILRIFDSQVDSSAPLPTENKEETLVSAGVQINMSSPTPNKDKAVDTPVLADIISITVDLSSFVPEQDGTLPLPPEIIIPKGTKLHSNAIDLKIIDPTNVGYENHALLSSHKDIPLISLKTAEGMTGTPTADASLSNIKIDVSLPSITPATYGHTGVWSESKMEDGRLVVGWQPTGYKLNPEKQGALVLNNLWSHYTDLRALKQEIFAHHTIAQRMELDFSTNVWGSGLGVVEDCQNIGEFDGFKHHLTGYALGLDTQLVEDFLIGGCFSQFFGKTESQSYKAKNDVKSYMGAAYAGILAGPWLIKGAFVYGNINNDLTTDYGTLGISTGSWIGKGFIAGTSIDYRYIVNPRRFISAIVSTVVPFVEAEYVRIDLPEISEQGKEVRTFQKTRFENVAIPFGFALEHAYSRGSRAEVNSVQLAYVFDVYRKGPVSLITLKDAAYSWKSYGVDIPCKAWKARLSNNTEWNSYLSTYLAFNYEWREDLIAYDFNGGIRIIF

SEQ ID NO: 20346 - protein, 866 aa, Chlamydophila caviae
MKHPVYWFLVSSGLLASTSLSFAQAVKENLNPSHSYDGNTTTGAFQTKETSTGAEYTCEGNVCITYAGKGTALTKSCFSDTTENLTFIGNNYSLCFDNINTTAKPAAIEVTQADKTLSISGFSSFSCSYCPPGTTGQGAIKSGGAATFDNNSNVLFNRNCSTAEGGAINCKSLTLKNSSGCANFIQNSSDKKGGAIYCSDGELRLENNDQILFSGNTSKEGGGAIYTKKFMLTSGGTTIFSNNSVTHNTPKGGAISLADADSTCSLSADRGDIIFDGNKVITSGGNTTTKRNSIDLGSGGKFTQLRAKDGFGIFFYDPIANNGDTATELEINKTEGTSTYSGRIVFSGEKLTEDERKVADNLKSTFKQPIKIVSGSLVLRDGATVEAKKVSQTGGAVVMDLGTSLTTATTGEDITLSNLVINIASLGGGGPSPAQISAGATNKSVTIQAVNLVDSDGNAYEYPVFSTTKPFSAIEAKANGTGTATTPTDKLTNYVPSAHYGYQGVWTETWTQGATTATQTATLNWKQTGYNPNPERQGPLVPNTLWGSFSDVRAIQNLMDISVNGADYQRGFWVSGLANFLHKSGSATKRKFRHNSAGYVLGVFAHTPSDDIFSAAFCQLFGKDKDYLVSKNNAHIYAGSVYYQHTSFWNAWDRLLQNTLGAQAPLVLNAQLTYSHTSNDMKTNMTTKYAPHNVVYPEIKGDWGNDCFGVELGATVPIESPYSSLFDMYSPFLKFQLVHAHQEDFKENSSAEGRYFESSNLTNLSMPIGVKFERFSDNDNASYNLTLAYAPDLARSNPDCTTSLLVSPTTAVWLTKASNLARQAFIVRAGNYLSLSSNFEIFSQFGFELRGSSRTYNVDLGSKIQF

SEQ ID NO: 20347 - protein, 926 aa, Chlamydophila caviae
MRPSLYKILISSTLTIPISFHFSQLHAEVALTQESILDANGAFSPQSTSTAGGTIYNVESDISIVDVGQTAALASSAFVQTADNLTFKGNNHSLSITNANAGANPAGINVNTADKILTLTDFSKLSFKECPSSLVNTGKGAMKSGGALNLANNASILFDQNYSAENGGAISCKAFSLTGSSKEISFTTNSTAKKGGAIAATGIAHLSDNQGTIRFSGNTAVNSGGAVYSEASMTIAGNNHVAFSNNAVSGSSDGCGGAIHCSKTGSAPTLTIRDNKVLIFEENTSSAKGGAIYTDKLILTSGGPTAFINNKVTHATPKGGAIGIAANGECSLTAEHGDITFDNNLMATQDNATIKRNAINIEGNGKFVNLRAASGKTISFYDPITVEGNAADLLTLNKAEGDKTYNGRIIFSGEKLTEEQAAVADNLKTTFTQPITLAAGELVLRSGVEVEAKTVVQTAGSLILMDAGTKLSAKTEDATLTNLAINPNTLDGKKFAVVDAVAAGKNVTLSGAIGVIDPTGKFYENHKLNDTLALGGIQLSGKGSVTTTNVPSHVVGVAETHYGYQGNWSVSWVKDNNSDPKTQTAIFTWNKTGYVPNPERRAPLVLNSLWGSFIDLRSIQDVLERSVDSILETRRGLWVSGIGNFFHKDRNAENRKFRHISSGYVLGATTNTSREDSLSVAFCQLFAKDKDYLVSKNAANVYAGSVYYQHVSKFDDLTRLFNGPNTCCSGFSKEIPIFLDAQITYCHTANNMTTSYTDYPEVKGSWGNDTLGLTLSTSVPIPVFSSSIFDSYAPFAKLQVVYAHQDDFKEPTTEGRVFESSDLLNVSVPIGIKFEKLSYGERSAYDLTLMYIPDVYRHNPSCMTGLAINDVSWLTTATNLARQAFIVRAGNHIALTSGVEMFSQFGFELRSSSRNYNVDLGAKVAF

SEQ ID NO: 20348 - protein, 700 aa, Chlamydophila caviae
MKHPVYWFLISSSLLASNSLSFAQVTNETLTSSDSYNGNVTSDEFEVKETTSGAIYTCEGNVCISYAGKDSPLNKSCFSETTENLSFIGNGYTLCFDNITTTASNPGAINVSGDQKTLNVSGFSLFSCAHCPPGTTGYGAIQTKGVSTFSGNNKLIFDNNCSTGEGGAIKCATGSNAELKLEGNSYVVFSGNSSQKKGGAIYTKKLTITADGPTLFSNNSVSASSPKGGAICLDDTSSECSLTANLGDITFDGNKVIKTNGGSSTVKRNAIDLGSGGKFTKLNAKEGFGIFFHDPIANTGGSTEIELNKTESDTTYTGKIVFSGEKLSDEEKTVPDNLKSYFKQPLKIGAGSLVLKDGVTLEAKKITQTKGSTVVMDLGTTLQTPSSSGETITLTNLDINIASLGGGGGTAPAKLATNTASQAISIAAVNLVNTDSNTYEDPILSASKSFSAITATTSSSTVTPPETNLKNYTPPTHYGYQGNWTLAWPPGETMQLKTATLNWEQTGYSPNPERVGSLVPNTLWGSFSDIRAIQNLMDVSVNGADYSRGFWVSGLANFLNKSGSDTKRKFRHNSAGYALGVYAQTPSEDIFSAAFCQLFGKDKDYFLSKNSSTIYAGSIYYQHISYWNAWQNLLQNTIGAEAPLVLNAQLTYCHASNNMKTNMTNTYTPKNVTPSEIKGDWGSDCFGVEFGAKAPIETAS

SEQ ID NO: 20349 - protein, 866 aa, Chlamydophila caviae
MKHPVYWFLVSSGLLASTSLSFAAAVQETLNSSDSYNGNATTDAFQTKETTTGAEYTCEGNVCITYAGKTTPLTKSCFTETTENLTFIGQGYSLCFDNITATAKPAAIEVSAADKTLSISGFSLFSCSYCPPGTTGQGAIKSGGTATFDNNSKLLFKSNCSSEEGGAINCKSLTLKNSSVCANFIKNSSDKKGGAIYCSDENLQLENNDQMLFSENTSKEEGGAIYAKKLSIISGGPTLFSNNSTSKAADPKGGAICIADADSECSLTAENGDIIFDGNKIITTGTPSTKRNSIDLGSGGKFSQLRARDGFGVFFYDPIANNGSDTDTLEINKADGAATYSGRIVFSGEKLTEDEKQVTDNLKSFFKQPLTVGSGSFVLKNGVTVSAKQITQSGGAIEMDAGTNLTSTTEDISLSNLVINTASLGGGGVPLAAQISAEGTNKSVTISSLNLVDADGNGYEYPVFSTTREFPSIIEAKANGTGTPTIPTTHLTDHAPAAHYGYQGLWTTSWAQGTATTSQLATLAWQQTGYNPNPERQGPLVPNTLWGSFSDVRAIQNLMDISVNGADYQRGLWASGLANFLQKSGTETKRKFRHHSAGYVLGAYAKTLSDDVFSAAFCQLFGRDKDYLVSKNNSNIYAGSIYYQHTSFWDAWDNLLQSTLGAQAPLVLNAQLTYSHTSNDMKTNMTTKYAPQGVVYPEIKGDWGNDCFGVELGATVPIESPYSSLFDMYSPFLRFQLVYAHQEDFKENNSTEGRYFESSDLTNLSMPIGVKFERFSDNDIASYNVTLAYAPDLVRSNPDCKTSLLVSPTTAVWLTKATNLARHAFIVKAGNYLSLSSNFEIFSQFGFELRGSSRTYNVDLGSKIQF

SEQ ID NO: 20350 - protein, 683 aa, Chlamydophila caviae
MKNSIVLWGSLGLASVLMADSSVYELGRVEINEKSDISKNPSLEIVTQETIRETEAKSVVDALQSVPGIYTDYAGARGETKVRLRGFSSTRVPLYIDGIPIYVPYDHNIDLGRFKTYDIGEIDVSKGYVSPMYGANTMGGAINLVTRRPTKEFEGEVGAGIFSGKGQEQYLTLGTKQELFYGLISASNVQRDYYKLSGDYEEAGHQQGKKRSNSESKDQKVNLKVGYTPNDTDEYSFNYIVQRGEKEQPWFAMERRKNSDGSWKDGSGMYNRNWDWADWDKTSYYLITKTAIKEHYLKTRWYYDTFYNKIFFRGTPGSPTQNIITETSEYDDNTFGGMVEGDLQLAKGHLLKLFVSQKYDNHKDKNYVDSSNTRYADLKDEGKTTSLGAEYSWLMSDQWTWTLGGSYDKNEVTKAEYRNSAGTQILGEFPKYETNAFNPQTILSYKAKEGLTFYGSISKKSNMPTLKDRYSSKFGDYVLNPGLDSERSTTYELGSNWAVNENHYAKTALFLTKTKDYIASYSGVSNSDSTLGCVGANCKQMQNFDQEEHKGVELTLDSYWSDQFKSTLSYVYIDASIEDSQTKDAKYTTDTPDHTLYASVTYSPFYSINITPVVRYESERYLSVDGSDKSTPHTLVDLRVAYRPVKSFEVAAGVKNMFDKNYYISYGYPQEGRNYYLNVRYSF

SEQ ID NO: 20351 - protein, 843 aa, Chlamydophila caviae
MKNSLYGFLIFSSFTASIAFHNYANAEDLASSASFDGSTGNGQFTAKQSSAGGGTTYTLTGDVSIAHVKTINPANTSCFKNTTGNITFTGADHSLLFEDITSTAQGAAISTNTDGKTLTMSGFNVLSFISAPNAATGKAAIYGIASITIKDNKQLVFDKNSSTAAGGAIHCAKTGATVATLTLQSNESMTFRDNFSATTGGAIHAEKLILKTGGTTIFENNHATQKGGAISIVGSGEISLLAEDGNIIFRGNTITDAGNKVNNAIHVAANGKFSKLGAKESQSILFYDPVVVEGTSAENLEINKTDGGTSYTGSIIFSGRYIPSTQEIMKHVSKFSQPITLSAGSLVLEKGAHLEAKSLTQTAGSKVILDQTSSIETKENLDIKELWLRLEDFTNPTATKISTAGNAHTVTVQGPLGIFADHETFYANQSLAHNVDQELLKLVDKDITKITLVDVPEDVRKNMDSHRGYQGSWTVDWKSVPGSSDGGVETPGTKTASIHWKPTGYIPFGGSQEITTPIVLNTLWGNASDMCNLERVVGSLAVNSMFSEGFWATGIKSFLRSNGPATNYDFQHSNAGYVIGMSKISPLGKVFSAAFSQLFGKDCDGANGQVNHQTLAGSLYAHHVGSLPMLRFLCGGSTDCPPELQVTPSIPVIINAQISYSHSHNHMTISHEDKTKTTGSWSNYSVASELGSTFEYTLNRCPSLLRHVSPFIKLQGVYSELRKFTEQGLRCCMFSNTYLANLALPLGVKIHGVCPKELFAYDLSAMYVYDVFRINPESMTLFLIGGLTPWSTPATNLDTKAIVVQGSGIFAVRPNIEIFAEGNCELRSSSHSYNYDFGAKIHF

SEQ ID NO: 20352 - protein, 867 aa, Chlamydophila caviae
MTQRPNLWIFCCCAMSWFYFSSAYSAVLKTLDSTDNFNGINNAAFTVKASDNAEGTTYILSDDIFIQNVSATNPANTSCFKNTKGDLFFNGNNRSLIFDKIHMETEGKIVFNAAESFFTMSCFSQLKFLEPTSSRKGKSVLLSKGSLMFRCNDELTFEGCYSANKGGAIFCVPDPGSRRSSLTFFRNRKITFSNNLSINRGGAIYAKEMRLTAMGPTLFINNTASGGVNARPGGGAIAIAPDGELSLFAEEGDITFAGNTTVRGGHVEKNAIHLEQDAFISYIGARKGRIVKFYDAITATSPSTVPLLINQITDGGIYQGTVLFSSTDCISSCSSLKSTNMSRILQDIILVGGTLDLNSGAILSALNFIQRPDTTFVLDQSTMLRIQENAEFLNITVPVKLKLLDIRPKHWKIKFQTLASREPGQLLLLSRDKKLALLGSINVDFQDEDFYENLELAKSVKIPLIKIESRELTDVNVELEHLNVPSSPYGYQGSWHLEWQDTPPQQISSRSTIDAQKIAQLVWTPSHYRPHLIDSQGNSLVPNSLWNAFVNLRGIHDLMDTVSDGSLYRNGLWVSEISRYFHKDNHKDDRGFRHTSGGYALGLSQQTPSTNIFNLGFFQMFGVSKDASLAKNHEAILAGSVYIQHSTPIKPLINWSLGNLFFHTDLPSKVSADLPLILNLQATYSHSKNKLTVARQSSEITHGYWNTHCVGAELGSSLSFDFYEEHNIFHQILPFMNLQGVYAYQRKFQEEGEKRHDISSSQLGNLSLPIGVRLEGHASQWPVFYSTSVAFIADVFRKNPCSIITATYDPFALWTTSGTNLSRQALSAQVSMHCAILDNITLFSKFCTELRKSSQYYSGDIGGQFLF

SEQ ID NO: 20353 - protein, 798 aa, Chlamydophila caviae
MKASKHKIAAGLMMSMAAAVASAQQDNAPQSATTLEEVVITATRRGNTDMMSTPVAVTAITAYDIERYSPNDLNDIAAMVPNLSAGTISGFNSASFAMRGVAEQTIIVYKESPVGVVIDDFVVPHVQTQNLEMFDIEQVEVLRGPQGTLFGKNTTGGVINVRTKRPDLDQASIDLRLKAGDYGKKEMQVAFNAPLTDTLAFRFAGLQQESDGYYKNGSEWGPLNVAPTTGVAGTSNRGDGRDLGGADVFSARAKLLWQPSDNFSALFQYEIIRDEGDTPPAVNESVPGYIFEGWGFAENPGDPLDNAGITNVDDRLINMSKGHRVDIDGYYLNMEWDLGNYTLFSSTGYREQESRLPNTYSGVSDIVLFDATRDDNRETFQQEVRMVSDFDGPFNFVTGAFYQTNDVEFCVVQLVGFVDLLLGDPIATGLTNLPLILCNEQEATSYAAFIDGTYTISDRMRLSAGVRYTHEEKEWTGRPRIAIQQLDGGFDPALNWETLGEPLDGADWDRFPSGVQRDDESWSEPTYRLTLDYDLTDTLFAYATYSHGFKSGGYNDQTGTVLNPVPELALQPTEPETAESFEFGLKASLLDNTMDVSATAFFVTYEDAQRSLNASFDTGQETLFFNAAELEVQGIELEMNWLVMEGLVVRGNASFQDAEFNEFAADTNFDGIIDVDLSGEAPVRAPDKMATLGATYTHSVPGGMLSWNARVSYEDESIAQYSDVGPQYHATMNSKTLIDANITWESANEQYLVRLVGKNLNDDRYRTGSQSVANFWIFSAYGPPRYLGLEVEAKFDLW

SEQ ID NO: 20354 - protein, 1075 aa, Chlamydophila caviae
MPLSGVASPLQEIRITIQQKNVPLSKVFKEIEEKTDCSFLIRNNDVNTNEKVSIDAKNKTVAEILGILFDGKGIKYEVNGKRISVYKAVRQHTIGGKRKVTGQVTDNMEEAVIGASVFVMGASNGTITDMNGHFSLELPDDNAKLQVSYIGYKTQVINVGNKSSVNIVLVEDSKALEEVVVVGYGTQKKVNLTGAVETVKSDRLANKPVTSIASALTGEAAGVTVTQNSGQPGPNQGTVRVRGIGTWGDASPLVLVDGVSMSLNDVIPSEVESVSVLKDAASAAIYGSRAANGVILITTKKGKEGKLTFNYSGNVGFQFATRVPESVTSWQYAELYNQMQYNEGKSSSLFPQDRIDRMKAGGDPDKLEGNTDWYDELLRSGAPQHNHQLTVSGGSDKITYMISAGYSDQWGIIPSTDYERYNLRVNTTSKLTSWLKLDVNMAYLNSTQEESAAGAAEAYRRTMRALPYLPVQFSDGTYSYDAAPSNPVRMVNGDYGMRRKNNDCMTLLIAPEINILDGLNIRGTFGYESNIYKEKIFNKTVTYGSFEPAGQSGLTEVSRNKQTDRWDQYRNLTANVTASYEKTIGKHDFKVMAGGSLETFKWAYTKASRMDFPNDDFGEINAGDATTAAAEGNSTYSALASLFGRTNYVYADRYLFEFTARYDGSSKFARGHRWGFFPSVSAGWRISEEAFFEPLKKHVQNLKLRASWGELGNQRINDYQFISNVGNGGSYLFGGTPIIGYKEALMGNEIITWESSRNLDFGIDFALFDNRLQTTFDWYCRTTSDILLNLEAPGALGIKPAMENAGKMENKGWDLTVSWRSNIGKDFKYNIGFNLSDVKNKVIDLRGYKSSTTELTAKIEGQPLNAIFGFETLGICDNQELYDKYAPMMQKYNPKWGMGDIIIKDRTGEGVINDEDRTVIGNSIPRFTFGLNLGFEYKGFDFSCFFQGVGKADGYVTMEAIQPMGINGARKEHYKESFNPQDPKPGAYFPRILSSDYNYAYMSHWVQDASYIRLKNLQIGYSFKIKGLNQLRVYASGENLFTATKYRTWDPETPVGARGFYPNVAVYSMGVNLNF

SEQ ID NO: 20355 - protein, 356 aa, Chlamydophila caviae
MGSKITKYLTSISLTFALFGNLYADDEPQPPADQTTQEVKIKTDRKGDFVANILWQNTYATTSGMNASRISLESLCDTSVYFDLEGGALGLCLNQHNMEEKSGFHMDGSGYYAGISCGSPSLYKIGVKFVSQHTNAKAHLGHDEVATDYLSLGGFWEVHGFKGRLIVVGNYLYTHGFHNLNHTHRQLIGACHASFESQTVGSALSFYFPLKARTNNRLTVIPFFRYQAFASKQNDFKEKGARVRSFVTPDSLVDISVPFGLHNKLAFHGYFPSLWELEVSYKPTLLRQKHLVGSVLVADDGTWISSPTEVCYHAFSINLKNETQVFKHLHINFDYQCDASSSTCSHYILAGGKLVF

SEQ ID NO: 20356 - protein, 433 aa, Chlamydophila caviae
MFPRMFSPFPLAPGRRVTGLFLLCAGVNAQAAGFLEDASAKIEARNVYFNRDFRDGYSSSSQGASKREEWAQGFILNVQSGYTQGPVGVGVDALGMFGFKLDSSPADSNSGLLPSSGHDPRRSADQYAKMGLAAKVKVSNTVLKYGSMMPDVPLLKYNDGRLLPTLFHGAMLTSEELHDLKFTLARLDKYTARDSTDRQDIRVHCKNKRYACDTEADHFDLAGVDYRFNERFSAQYQVAKLENIYRQHFLGLVASQPLPVGSLSADMRLIKSDDIGNARAGEIDHRAFSGMLGYSLGGHKLSAGWQRMYGNSAMPYLDGSNPYLVNYAQVNDFAAAQERSWQVRYDYDFKALGVPGLTFFTRYINGDNIKVPGSSVEGKEWERDTEFKYQVQSGTFKDVSVRLRNSTYRSNYERWARDMDETRVIVSYNFSIF

SEQ ID NO: 20357 - protein, 1042 aa, Chlamydophila caviae
MKHKAMQKGRFCSMRILFFSLTILFVCASNSYAQSTVNGVVIDATGLPLPGVSVTVKGSATGTTTDLNGHFTLNAPRSATLVLSYIGMITQEVKVNSRSMINVTLQEDINSLDEVVVVGYGTQKKIHLTGSISSVSSKELLKSTTSNVSQALVGKLPGLISQQATGAPGADDVSLLVRGHSTYNGGDGPLILVDGVERSMAYINPNEVESVTILKDAASCAVYGMKAAAGVILVTTKRGTEGKTAINYKGSLTLSHATTLPKFMNGTHYMQWYNYARRMDGEKAYFTDEEIAMTTNGDPTDGFENTDWQEPIYRTTLMHQHNLSISGGNEKTRYFLSGGFMKQNGFIKGFELERGNFRSNIDTQVTKDISVSLNVAGKINDYYQPGGDSYENQTTNNVVGVLLYAAPFVPLEYEGMPTSGYRGASNPEYAAGHSGYSKTRTMRLETSAKIEYSFPFLKGLKAGMFVGWDWQDRDSRSFKYSYELMLYKPESKKYVRQYASNLQPTGGMSVGDEKEQQVVLRPSISYNQKFGLHDVGALFLYEQTERKGNTLTGYRSDFALLDIDELPFGSTIHPTDGNFSSSIRQGYAGYVGRFNYAYNNRYLAEFTFRYDGSYHFKKGNRWGFFPSASLGWVASEEDFFKELFPQVERFKLRASFGILGSDNVDPFLYRKQYAWAKNSTVFGTTPQAVNTLYNKVSYPMENLTWEKCRSINVGFELSAWNGLLGIEFDVFYKYTYDILRSIGGVYPPSLGGHYPSIENSGTFDNRGFEMTVKHRNHIGKFNYSLNGNLSFARNKILRMTQADNTKPWQNRLGTSVGSIWGLKSLGLYQTQAEIDAAPLPISETPRLGDIRYLDYNGDGLISWDDEVKIARPTTPEMMFSLMADANWKGFDLSVQLQGAALCDKLLCGEWNNGARDQTPLTRPFYAGWDNAPYYLVENSWRPDNTNAEYPRLSTVAYANNAQVSDFWKRNGAYVRLKNVTLGYTLPQSWVKKSGISNLRLFASGHNLFTLTEFKYLDPESANVIQGYYPQQRTFTFGVDVTF

SEQ ID NO: 20358 - protein, 716 aa, Chlamydophila caviae
MISASAWGAPQKEETLVVAASRTGHSAADMAQTTWVIEQADIEQQVQGGKELKEVLAQLIPGMDVSSQGRTNYGMNMRGRSMMVMVDGVRLNSSRSDSRQLDSIDPFNIERIEVISGATSLYGGGSTGGLINIVTKKGQPETQVEFQTGMKTGFNSHNDHDENMAAAVSGGNDNASGRLSVAYQRYGGWYDGNGDESIIDNTQTGLQYSDRLDVMGTGTLNIDDHQQLQLTTQYYKSQSDGKHGLFLGENFSAVTGNGTAYNKGNLDSDRLPGTERHLINLQYSNSDAWGQDLVAQIYYRDESLTYYPFPTLNGDKTRVTSIGASQQKTDFWGGKLTVNSKPLDSLSLTYGVDAEHETFNANQQFFDLNKAAASGGMKLDNAYNVGRYPDYSITNLAPFLQASYDIDAITLSGGVRYQYTENKVDDFVGYTQQQGIATGKATSADAVPGGKTDYNNLLFNAGILGHLSERQQLWFNFSQGFELPDLAKYYGSGTYRLENGHYRLLKSVNVNDSRLDGIKVDSYELGWRYTGDNLRTQLAAYYSVSDKTININKTDMTITLDDDKRRIYGLEGQVDYFFSDSAWSTGANFNAIKSETRVDGDWKKLTVDSASPSKVSAWVNWAPDNWTLRLQSTQTFDVSDDAGKKIDGYNTMDFIGSYALPVGKIAFSVENLLDKDYTTVWGQRAPGLYSPTYGSPDLYTYKGRGRTFGLNYSVLF

SEQ ID NO: 20359 - protein, 161 aa, Chlamydophila caviae
MEIPLLAVSTPISAGDRGFLYGFVAGYELQPHFAIELNYTRFPNTTVVFDPDFYTIKPIVSMRSFTYAYNLVGKFMAQLGESGFRGFANAGASFTHRNDLLVKGAHICPTFGVGINYVFIKRIMLEMGFQYYAGYGKAVINPGVNYVPFLYALTLKLAYRF

SEQ ID NO: 20360 - protein, 1080 aa, Chlamydophila caviae
MKQLYTNGVRQLLYLHHHSITCLIFLLTLFLAMPSASAQQGSKIRISGVVKDTTGVGLPGVSLYAADNKNNGTMTDVNGRFAFEVTAGAKITVTSVGFIQTSFIADPKQLQVSIMMKSDDGNLSEVVVTAFGRKQRKEAVVGSVSSIDPAKLKIPSSNLTNALAGQIAGVVAYQRSGQPGLDNSTFFIRGVTTFGYKQDPLILVDNVELTSNDLARLQVDDIASFSILKDASATALYGARGANGVILVTTKEGAEGSAKVNIRFENSISQATQDLEIADPITYMKMYNDAITTRNPLGVPRFTQNDIYFRQQTLDNAPGSNKYVYPAVNWLDELFKKNTSNQRLNGSVSGGGKIARYYIATSYNVDNGILKVSPVNNFNNNVKLENYQLRSNININVTPTTEVVIRLSGTFDEYNGPITDDGSFSSDLYRKALHTSPVLFPASFPANPSLGIDTHILFGNSATEGTGNDVAYANPYADMMKGYKSFSRSRMSAQLELNQKLDFFTEGLNFKGMFNTNRYSYFDLTRQYNPFFYNVSSYDRMTNDYTLRWINSNPGQATEYLSFDPGFKDINTFLYFQGVLDYAKVIGEKHNVNATLIGTRQQRLYANAIDPATNTPSLQYSLPYRNVGLSGRAGYNYDSRYFVEFNFGYNGSERFAEQNRFGFFPTIGGSWVISNEKFWAGSISNVVNKLKVRASYGLVGNDAIGDQRFFYLSNVNLNGGNPAYFGQNNGVTRPGVSITNYANDQVTWETSRQTNLGLELSLFKSFNLIAEVYKQHRYNILMQRASIPSTTGLESAVSANLGTADSRGMDLSADYSKTFNGGFWMSGRANFTFSQNKYGTYEQPAYQEPWRILSGQKIGVRWGYIAERLFVDDAEAAAAPSQLFGTGATAPKGGDIKYRDVNGDGKITAADQVFLGLPSTPEIVYGFGISSGYKNFDLSAFFQGVGRTSFFIDPSAVSPFLENRQVLQAFAESHWTEENQNLYAKYPRLGTNSTELTNNLQTSSWWMRDGAFIRLKSLELGYTLPQKLAKKLFLANCRVYFNALNPLTWSRYKDWDPELASNGFSYPLQKVYNFGINVNL

SEQ ID NO: 20361 - protein, 1788 aa, Chlamydophila caviae
MKWLSATAVFAAVLPSITVFGEPLSKELNSSYRGSGLSASDSASKNFTQQTQDDSGTTYTITGDVSFRNFTNIPDPKPRTVEPDPAPAPAPDTQSNTVSSKPKSESKPSLSTGYENTVTQPQETLYHGPDDLHVTSFASHVVEGNQAISDIGKFADEKSHPLSFSLSSSSHAVSTSTTDASTSTPAPKGGGAFYNDKAGPITFITHAGNPGSLSCTLIRMTGQGGAIYSKGPISFDGLENLTFRDDLSQQAGGALFTDSTLTIRNILDSIEFTNNSARVPIPLVPVLPAKSAPGAGVGGLVPPKLKETHLLPRYFSQEIKVQDAESQTSIFPTYTTETAGNGGAIFAKGAIVISTYKDMTFRSNSAEFPLIIDVIKEQIDAQKKAASLPSASEKIHASADVAKQQVREAPPVIKGSGGAIFGLDTITIRDGSEDTLFILNTATGAGGAIYGDKDISLNNIANLRFQSNSADTRGGAIYAKGNLTIQDSTVLTQFNANSGKTGGGAIYCLGNVTLSNLSQVRFGVNKAGNYDLKITIPGKEASTAHVLSSVVEEQKAPVPIEPPLGKGGGIYVEKAFTVSHVTSILEFINNQATDHGGGAYVKGALNYSNSHRIQFTTNTSKKSGGGLYCESDVTFSNLTGKTLFQGNKAEENGGGICLADTKSLTLSNLENFCLVNNTTSKSGGGAYIPKALSFTFSNPDTVSSTTPATVPVFGSAVITGNKAEENGGGVYTTKAALTNLESIDIGQNSAKNGAGLCTTSAPAAGVAAIGEEELDFKVDYVVTANVTKNNATESGGGVYGKKGKISRLDHLNITGNSAGKSGGGLYFTEKLTLEGIEISKISDNTAKESGGAIYAKALTCTNFPDGLTVSNNKAQVTSTTTSSPQKASIPTAITGGAFSAETLILEKLQGNCTFSGNAAIDNNTASLSSDPTDPNIQGGALYAKTSLTLQNSSGSLTFSGNSATTKRSSTTGQVAGGAIYSPTVTIQNCSQPISFVGNSALCTPAEQPPAEDPAPKATFGGAIAGTTSITFTGNQALFFKENSADNGSAIGCKNGSNGTVTFSDAVFCSFEGNIAKNRGTIYADTLSIPQGYMNFSNNSSANDGSAIYFTKKADITAAASILFLDNKVTLAQTSDKQRSQVNNLGAAIYGEGNSTDAELNLTALGGSITFKNNQCAPQGKKSNPSFCSITGKVKLTLNAAANQSINFYDAVRTQTVQSSGSNYTTLDINKTSSEGNPPKYTGTVLFSSEYHENKSVIPQKVVLHDGTLILGKNTELNVVSFDQKAGSSLVMGPGAVLSTQQKTGGSSGATGGIAINNLTIDFSDIVSEDGTATPPALKLGVAPAAAAAGARAHVARNNVLPRADVSNPDVTKEKVYLTGTITLIDPAGTFYQNPYLGEDRQIELLKLPESGKVEISDLTLEGDTKPLKGYIGSWTLGPGDQNGTLKANWKFEEYRRWIYIPRDNYFYVNSILGSQNSLIAVKQGIVNNMLNNARFDDAAYNNLWLCGIGSFLQKEQGEESRSFSYHSRGYSLAIDAKPRPEFILGASFSQVFGHSKSEKAVDNYKHKGSDHSFQGTLYAGKSFYLPYRRTQSPQPILLQGVMTYGYMKHDTTTYYPSIHERNLGNWEDLGWLFDIRMILDLKEPSQNSTTRFSFYSEAEYTGVRQKQFTELDYDPRTFDSFAYRNLSIPLGFVFEGALMQYNILMYNKLSLAYVPVIYRNKPKCNYRVNSTGQTGQVYGVIPTRNTGRVEYSSQLYLGSYWTLYGTYTVEAGMSSLVQMANCGARMIF

SEQ ID NO: 20362 - protein, 428 aa, Nitrosomonas europaea
MNKRLITLAVSTALLGTVTQVQAAGFQLAEYSATGLGRAYAGEAAMADNAAAQFRNPAMLTYLEGTQMTTGAILVMPNIDVDGTVSFAGQSTPSSAKDIAGDAVVPNFYVSHQLNDQWFLGLALGSNFGMATELDDSFLGTQFGNEASITAIEVNPNVAYRINDQFSVGAGVRLVLGEGSFGAQAPTSVGPLQGTTLKYMEGDDISWGWQLGGAWQINANNRIGFNYRSEVDQNLEGEARGLGFDFAMIAQGKAPSSHYDGAMELALPATAEIASFHQLTDKLAIHASVNWTDWSSFEKLEAMIPEISADPILVKQENWEDNYRFAVGATYQLSQKSTLRTGIAYDQAAVSDANRTTTIPEVDRLWLSVGYGYQYSDNLDFDFGATYIFADESPIHEHDEDSAMFGGTFEGQVSGNIILVGVQATYRF

SEQ ID NO: 20363 - protein, 922 aa, Nitrosomonas europaea
MSIRFTHKRFKPLALFVAVSSAIVCQSAAAQEVAFSLPEQALATSVAQITQQGNIQLLYDKSQLNGLRAPALSGHYTAQTALQKILIGSGLELVSDNGIFVIRSQNLNQGTLVLPETQVSGVVQQNHPATDVMSAPQYVTSEEISQRNTGDGNITDLMKTNPAVQFANNDSNSMNQGEIKPSRISIHGSSSYQNAYRLDGVSFNNDFDPADSGLGETATRLSSSDQGIYIDSRLIDSMAVYDNNIPVEFGGFTGGTVEVNSRRWQGENSAHAYYRLTRSGWNNLFHDSSLGIDTTKNDTANPARFQNRYDKDDFGGWFELGVSENSGIVFSASRRSSTIPMTVTGGDSVIFDENNQVEMVNFASGEKKQHRTSDNYFLKYSLDLSDKSTLDLSANYASYDSRLFSASVMNSGYDSTHDGLGFTAVFKHQFDIGQFELTANTQTLKDDRTDDQKYSLTVRAIDYSTYQTTESSSGGLGDLTSKQKNHGLKGVMRFNTMEDGIGLTHKPTLGAELNYTKGTYRRDKDYFRYTYTGSIDDSGMYNGYLSNVTRFQAGSHAADYTNYAVFLDDNIQYGKLTIRPGIRLDRDDFVNRTNIAPRLSGNYDVFGDGKTQIIAGANRYYGRSMLTYALYGAQNDGMQLCNSYDGCSLDPNKNDWDNKKDYEGLDSLKTPYNDELTLALQQEILSTTWRLQYVHREGYDEVRTRTKYDTRDASKRSIRTFDNGGRSSHDTVTLSVNNSQPWEWAEASHVMTASLTWQQSESNTPKDAGYNSFDPANKVNLNKVWYDGKVIDASKLPSTSFNSPFKLNLELTSVWDDYDLTWYNRLQWWGARDQAVRYDNAYAFDPEYGQVRKYTKQHFSSKYTWDTRLGWKPDFAYGFGFSVEVNNILNNKNIADRFVFEDRVLKSYDPGRQFWLQVNYDL

SEQ ID NO: 20364 - protein, 695 aa, Nitrosomonas europaea
MPMPVRRRLALLLASTVLTATVLTAATPAGAQDRQPQDRNRGAATFELGEIVIVGRRTDRLAIGSTSLSDAAIYRFNRPTLDEAASLVPGVTASNSGGSRNERLISVRGFDRFQVPLSIDGIRVYLPADNRLDFGRFLTADVAEVQIAKGYASVLDGPGGMGGAINLVTRRPTEEIELEASATVSLDREADFAGKTLFGLAGTRQQGWYAQLSAARNDRDHDTLPEDFAPTATEDGGRRNRSETEDWRVNAKVGLTPNDTDEYSLSYTRQEGSKNAPLHVTDPASVQRYWRWPYWDLDSLYFLSTTRIGAGTTLKTRAYYNGFDNLLQAFDDAAQTRQTQARAFDSHYDDEAYGGSLELTVPVAERDTLAAAVHYRRDRHGEWQTSFSPSRFTEPEQVSTEETWSAALENRLSLTPTLLLTAGLSYDWRDLKRAEDWAGGATGSPVIYPTRDSDAWNWQAALSQSLGDDAELHARLSSRTRFPTLFERFSSRFGGATSNPDLKPERATNIDLGGSWTAGMLSVEAAVFYNDVDDYIVAVPFLYNGQSVTQSRNVGSGEFYGAELSLAVELTQTLTLGGNYALVKRDIDDPTSAALKPTGVPAHTAFLYADWTPLPDLRLTPTVEVAGERWTATTDGRLYYRTGAHTLVGLRADYSLTDAVEVGAGVRNLFDRSYQLTDGFPEAGRSFYLSARARL

SEQ ID NO: 20365 - protein, 238 aa, Nitrosomonas europaea
MIKRFALPSTLALLFSGAAFADTVAVPETKKTAELGDAGYYATGRIIGAFDNAVNMELTSPRVASRVGGPDTGSNVTGSLGLGYQFGNGWRAEGEYVFKRTNNFTSYWAPFDANANEFHVSAQRLMLNGYKDFDLGRGFSVYGTLGIGVAIVSADGWQTNDTRRFASKTQTNLAYSAGAGVSYAINKRFSIDLGYRYVDMGNVETGFNTFANRVNARDEQLKSKLSSNEVFIGLRGRF

SEQ ID NO: 20366 - protein, 1062 aa, Nitrosomonas europaea
MDNRNYFTMAIPALLLGVAYLQPINAAPAEDLPNVTGRMTITQQTFTVSGVVTDTNGEPIIGANVIEKGTTNGAVTDFDGKFSLSLQNKQSILVVTYIGYNTKEIPAGNGSPLTIQLQDDTQNLDEVIVVGYSVQKKKDLTGAVSVLEVGDLKDTPVSSVDQMMQGKLSGVNVIPDNMPGGGVAVRVRGFSTIRNNDPLYIIDGVPVEGGINFLNPNDIESMQVLKDASSASIYGARAANGVVIISTKKGKEGTFRVNLDAYVGVQTSAKQMRMLNAQEYGDLLWQAQRNDGKSPVSDVYGSGETAVIPEFLDADHRLPSGDVDWVDEIMQKAMVQSYNLSLAKADKVSSHLFSLGYFNQDGLMKYTGFERISGRFNNEFKLFNDRLKIGENATLSHAWGTSVTNNAALGGMLYNAYKTVSITPVYDLDGNFGSNPIADISNPLGELYRNKDNKDRTTRLFGNLFAELNILEGLYFKTNFGADYKNLYKRSFKAKYNELNTQQPLSTLSTQNRWNFNWVFTNTLNYLRTFDKHTIGALLGIETNRYQEEYFSASREGFASDDDNFHFLDAGDSGSQKNAGSAFTSKMMSYFGKIDYNFDNRYLFAATFRRDGSSKLGNNKWGNFPAVSAGWRISSEPFYDIPAISNMKVRIGWGQNGNSDIPAYSTIDSYMSNPNHSNYPIDGSQSSVTTGYTQTRYGNANLKWETTTQTNVGLDLGFLDNSLTVVLDWFNKDTKDLLWERPLIGTVGGTNQTVWDNVGKMRNRGFEAEVSYNKSINKDFGFNVAFNMSAIKNKMTELDGDVSYIGLPTSVIHSLNFDQEVSRSAIGQPIGSFYAYKEDGLFQSEAEIKSYTNNKGELLQPNAKPGDIKFVDVNGDGVIDGNDRDYIGNPLPDVTAGLTLGVNFHNFDLSLFFQGMFGNDVYDLTRYVGDFYNQSQYNKNSRVVNAWTPTNTNTDIPRVTMDDPNNNIRPSSYYVQDASFVRLKNMKIGYSVPQSILSKIKFNSLYIYAQATNLFTITGYDGIDPEVGLQSYSSDYRNLDMGVDRGIYPLSRTFTFGVNVSF

SEQ ID NO: 20367 - protein, 765 aa, Nitrosomonas europaea
MKSIAGLFSLLLLLWANTANAQNDIPYSFNLPAQPLSSTLNHLANITGIKLIYADEITRNHLSPPLHGNFTLAEALNQVLNKNRLKYEMVDNSMVVISQAAANTVLPEITITTDSSAAGNEASLTVPNTAQATANIQYTPGAVEVISDARFKSTPAQTIKDIVGWIPGVIAQPKSNIDNRISIRGSGLTRNYGNRGINMYMDGIPINTADGLFDVFEIDPGAYRYVEVFKGANALRYGANSLGGAINLVTPTGYDASRFSGRVDTGSFGYMKGQVSTSGIHGPHDYFITASAQREDGYRDHSNGHMVLGSANFGYRFLPDAETRFYLNANTWRQRLPGELTKRMVLDSPRSADPEFVRQDQQRNIDSVRLANKTTLRFGPTTVDFGLFGHHRHVDHPIYRYLDYYVHDYGGFARATDDRLIAGFRNRFVAGANVHNGKINYKEYINPGDAVKSALAMSTVDKSQNYSIYVENSFYFLQNVALVAGGQFLHAIRDRNDRFLADGDQSGRRAYSIFSPRGGLLWDIAPDVQIFANISRSAEVPTFDTNTFMTPASSELDAQTATTYEIGTRGHRADFKWDIAFYRAHIRNELQCLRTSPFSPCTVVNADRTVHQGIELGFGAAFLKGIAARKDLLWLDIAYTYNDFFFDNDTLYGNNKLPGVPPHYLRAEVLYKYPNGFHAGPNVEWMPRAYYADNANNLSIGSYALLNFRISYDPGKKWSGYLEGRNLLDTRYISTTITSGTADATSALFNSGYGRAIYGGIRFNW

SEQ ID NO: 20368 - protein, 658 aa, Nitrosomonas europaea
MSQPLLRALFAPSSRSYVPAVLLSLALGIQAAHAENSGGNAFVPAGNQQEAHWTINLKDADIREFIDQISEITGETFVVDPRVKGQVSVVSKAQLSLSEVYQLFLSVMSTHGFTVVAQGDQARIVPNAEAKTEAGGGQSAPDRLETRVIQVQQSPVSELIPLIRPLVPQYGHLAAVPSANALIISDRSANIARIEDVIRQLDQKGSHDYSVINLRYGWVMDAAEVLNNAMSRGQAKGAAGAQVIADARTNRLIILGPPQARAKLVQLAQSLDTPTARSANTRVIRLRHNDAKTLAETLGQISEGMKNNGGQGGEQTGGGRPSNILIRADESTNALVLLADPDTVNALEDIVRQLDVPRAQVLVEAAIVEISGDIQDAVGVQWAINKGGMGGTKTNFANTGLSIGTLLQSLESNKAPESIPDGAIVGIGSSSFGALVTALSANTKSNLLSTPSLLTLDNQKAEILVGQNVPFQTGSYTTNSEGSSNPFTTVERKDIGVSLKVTPHINDGAALRLEIEQEISALLPNAQQRNNTDLITSKRSIKSTILAENGQVIVIGGLIQDDVSQAESKVPLLGDIPLLGRLFRSTKDTHTKRNLMVFLRPTVVRDSAGLAALSGKKYSDIRVIDGTRGPEGRPSILPTNANQLFDGQAVDLRELMTE

SEQ ID NO: 20369 - protein, 1019 aa, Nitrosomonas europaea
MKKLDRLLNTHVCVALFFMVGFQWTAFSQTTLKGTVTDEAGVESIIGAIVQVKGTNTGTATDIDGNYALQIDTFPSTIVISSVGYITREIALATPTTQLNITMIVDQEEEEIVIVGYGEQTKHDLVGAVSKIDPAETKTIPAGSFDAQLQGKATGVQIATNSGVPGSDVFIRVRGATSINASNDPLYIIDGVFVNNQSLQNTTANGLAQDRATSPMADINPNDIESIEVLKDASAVAIYGSRGANGVVIVTTKRGTWGAEKVKINFNASEGLTWAPKGRIWKTATGPEQAMLLNEYNRNMGLAEPFRPKDQIVNGVAGRGLPQDQPTYDRLSYLYQTGHIRNYDLSFAGGSNTTRYYIGAGYNYQDAVWKPMDFQRQALKFNLDQKIGRRVTVGISNTFTRVYRDQARPANGGNGTLLQASLSIPAYLPIFDDNGTPLKWVNFDNIYTLTSKVNLWSTSYHYIGNLYADWEIIKNLKFHTSTSLDYNLYDEKQYWQKSTQLGVAGGLGSNSITQSTQVMNEQTLRYNTTFARRHNVGALVGNTLQSVVLTNVTANGQGFPNDSYTQISAASIQTGSQYKTNNTLASFFSRVDYNYNHKYYLELTGRADGSSRFGENNKWGFFPAVGTAWRINKENFMADVKPISNLKWRTSYGITGNQAGINDFASRGLWNAGYGYSDKPGVSEGPGTAPFQAANPDLKWERTAQFSTGIEIGLFKDRINIEANYYNKYTTNLLLNLPVPSSTGFTSYTANAGAVRNKGFELGIQTVNIENKNFTWTTELTVSRNKNKVEKLPNTVQGFDTRNLTSIQEGYSLYSYWVYNQTGVNSQTGAIEIEDVNKDGKITTADRKIMGSVFPKLFGGFNNKFTYKGIDLGIFFIYSYGNKTWNQNEALGEQGGTLGDNRVLMAGQLDRWTTPGQETMVPKLTAANYQYFEVSRFLEDASFIRLRSLTLGYTLPKKWSSAVKTEKIRFYFTGTNLLLITKYTGSDPESNLGQGNLQGYDYDTPPQPRTIQFGLNLTL

SEQ ID NO: 20370 - protein, 688 aa, Nitrosomonas europaea
MFSPRVLPLAVASPFLCLPAAAQTAADSVSTLGEVSVRTGTSGPLVPNTLLTSVDILGADKIENQNVGTSWELVGQLPGIQLTETRMGAESGKATFRAFNGEGYINGIKVLIDGIPSNVNSGNQRFIDMIFPLEIDYIEVVRGTNDPRYGLHNIGGNINFGTRQGGDYTEGRLTYGSGATREAQLALGRESGGFAQNYFLAKQESNGYRPHAHSDKYSLGGKWFLTSEGGALKGGIVARLYSHQAEEPGFLTAEQLARDRNQSPAKNANDGDDRDMRHLSAHLDWQIDPRLFLSNKLYLNRYEDDRRITFTDSQAASLFNGPRQLRRWDETQHGLLSTLTWRASKSLSVDGGINVERQRNTYERYRYPYAVPTNFDVPGAVSNNDRYTLNNVGAYVQAVVQATDRLKLVPGIRADRFTGHTVPNTGAQGSLQDYGWIHQPKFSLVYGATDTVSVYANWGRTFQILTGSRAPAYITSPTQPRFAPSMNTGKELGVKFTPGPGTEMRAAVWQQDATDEVANMPATGTTVGLGQTRRRGLDVQASTKVGGRWQLWASHSLQEAKVVSAFTADGASLAGKEVFSTPRHISNVGVEYRATPELRLGLQGRAQGSYYIDSLNAKGKYGAFVLFDANVRYELTRAVSLDLQVKNLAGRKSVYAWDDIFFWPAGSTQPMFAPGPGRAVYVSLNYKM

SEQ ID NO: 20371 - protein, 1079 aa, Nitrosomonas europaea
MKQFLQRISGRQPYFRSVGLLVLIMMTVTLQSFAQSQVKGNVIDKSGLGMPGVSVLEKGTQNGTITDLDGAYTLELSTENPVLVFSFIGYKTIEKPVGAQSTIDLTLEEEETLLEQVVVVGYGTQRKVNVTGAVDQLSGEEISDRPIANVMQGLQGMSPGLNITYQGGKPGSVPNINIRGFTSINGGDPLIIIDGIAGNNSDLLRLNPSDIESYSVLRDAASAAIYGARAAFGVILITTKKGAEGNQRITYNNYFAWGRPSVLPEPVTDPYIHSRVLETSTNNTPWDYVNYSDAHYAWAKERSEDPSIEDTRLDPNNPNLWAYMGNYDWYDYFFNKSSFSTNHSLAISGNSGGKMPMGYYVSGDYTNENGLNKLADDYWKRYSLRARVTAKPLKWLDVDNNLNIYQTKREDPTNNITSVYNLRPIDVAVNPDGSWANTETGRLAARLVDGGENQENMFGFQNILGATATTLNGDLVFKGTASFKREQWKYHWDRKKYNIGFGPEDIRTEGGDGSVIERNGTLNTTIFDFYGKYSKTFGKHDFNVLAGYNQENYDYSTIQAERRVLISSSLPYIGLTTGESFITPSYSAYSLRSLFGRINYTFADKYILEINGRYDGSSRFPSDNRWGFFPSVAASWLMMDEDFFQPLTSAVSTFKLRASYGSLGNQNVSNFGYIQALPTNLSSYLIDGSKRTIISSAPSLAVDPNFYTWEEVISTNVGLDFGFLGDRISGTFDYFIRDTKGMLTDPVELPGVLGTAPPKQNAADLRTKGFDLSIGYRDQVGSTSNPVQYGVKVILSDSRSTITKFQNDQNLFSNWRVGQEVGEIWGLESDGLFANEDEIAQLDQSSIVPWGALDIVPGWPKYVDLDNDGKIERGQTSDDPKDLKLIGNSTARYRYGANIDVSWSGFDLSIFMQGVAKRDYYPSRYLFWGPYQQPYGNVYPWNLDFYRGQADGADLMDQHSQSYIDAGLADQNLDSAYPVLQSWMADANYGSGLDIPQTNYLLNGAYLRFKNITLGYSLPQALIEKMKVSKVRIYVTGENLFEISEIKRYVDPESINASSGDADAYPFQRKFAFGVNIDL

SEQ ID NO: 20372 - protein, 218 aa, Nitrosomonas europaea
MKGSRMVRSLLLASLAALPAATSAAVMDQAEKFGYEHIHLDVGAGTTNEEWLDNSNATTIGLGGNYLFTENWLFNVDYSAQFFHPDDFTLRIDRLLFGGGYRYGITDQFDIYGKYGIGAIKAKATDDKTDNTLSSDSELLQAVTVGVNYLFSEKLIATAEVEVNRSDIVDENNFKIGFNYQWHDVIGTGLFYQFRDTDYSGESSDYVNEVGLSLKFVY

SEQ ID NO: 20373 - protein, 990 aa, Nitrosomonas europaea
MKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILVVDTKRDGHEIENYDYKIYPNKQADLSKVGPTREKADPYQITRQSTLIKLGFQPNENHRLSVALDDSTLETKGMDLSYIFNQCKNSQCGEKYGERLINDQSKRKNIQFSYENFSQTPFWDHIKLSYSSQKITNKARSDEYCHQSTCNGVLNPQGLHLVEEGGVYKIVDKNGDEFTSKKEGYYNRFKNKQGKDVDNDIDSSAGTLDSVLIDCEQLNCNNKFRVFVEKDEEGEDKYQYENRDITIKDLNGKKYGEIPLKSKTKTIGNWSYEQQETARFLFPKSSGYSTDFVNDRDLNTNTQQIKLDLDKEFSLWHTQHSLKYGGFYEKTLKSMVNHQYDTVANVQWWAGNFFCNKLANGKRTPAPDYSAHRCKLMNTDKGKETYLIPVTTKNNVLYFGDNVQLTSWLGLDLNYRYDHVKYLPSYDEKIPVPNGLITGLFKKFGPKDRVYGSKYSIPNGYNDCTYNSDCYKKNFKDNLALLLRKTDYKHHSYNLALNLDPTDWLRVQLKYANGFRAPTSDEIYMTFKHPQFSIQPNTDLKAETSKTKEVAFTFYKNSSYITLNAFQNDYRNFIDLVEVGERPIEEGSTIAYPFHQNQNRDRARVRGIEIASRLEMGDLFEKLQGFHLGYKFTYQKGRIKDNGLNPKYKEFLDLNKDKHPEYEAIARKPQPMNALQPTTSVYNIGYDAPSQKWGMDVYITNVAAKKAKDTFNSQWTSMVKRKEKIYGNEKEMDASKANGKEVKDSRGLWRNNRYTVIDTIAYWKPIKNLTFTAGVYNLTNKKYLTWDSARSIRHLGTINRVETATGKGLNRFYAPGRNYRMSVQFEF

SEQ ID NO: 20374 - protein, 769 aa, Nitrosomonas europaea
MIVCVKDRGVGSLGLVSALALTLSIGGFQPAFAQMKLPDVTVDAPKPKTRQATQRSQAASTRNTQRRVAARNLPPRAPVPYVTPSTGTIGAPPSLYAGGQVASGGGLGLLGNRGVMDTPFNQTSFTAQLIQNQQARTIRDVLINDPSVRAVQAAGGGADGLFIRGFYYDSGDYGLNGLAGIAPYYSTGANFIERVELLKGPAALLNGMTIGGTGASSGGAVGGSVNLVTKHAPLEDITQLTTTYASKSQLGEQIDVSRRYGEHKEWGVRLNSTYANGDTAWNRQHDEFGNAHLAVDYYGENVRVDADVGYQADKLNPPLRFLGVGPSVTSIPSPPSAGTNFQVPWAYYAPTDFFSTVKGEVDLNDRITAYAGFGYHDSNINYRYPSPTLATNAGLLSGTPGSASETYKTFAGEAGLRMTADTGPINHAINVGYSITDRTYTQLLVVGKSATWSLYTEPTSVALPGFATLQGNQTVGANLWSIGISDTMSLLNKRIQLTVGVRRQTAGTEVTNDLAPAASRPFEDQSVWTPAYALVVKPVERVSLYANYIEGLQTPAVVATGYTNSGQVFPLGQTKQAETGIKVDFGRITTTLSAFDISRPSVITTASSSGALTQVMNGLQRNTGAEFNVFGEVTPAFRLLGGMAYIHGAQEQTASATTDGKRAIGVPELTVNLGAEWDTPFVRDLTLTGRVVYTGAQYVNATNTLSLPDWTRIDLGARYTFKSPWNGKPIVVRGSVENVFNTAYWASAYSGVITLGAPRTYLVSTTFNF

SEQ ID NO: 20375 - protein, 576 aa, Nitrosomonas europaea
MKQYRFTWLAGFATVTSLTTFPGSAGAQMLYEDVDPMVITPVQELTTLLDQPMGQVTSVSELRDVQPTDWAYEALKSLVERYGCIVGYPDRTFRGDRALSRWEFAAGLNACMNVMERLIQENVAVIRADIDKLQRLAREFEAELAALGARVDNLETRTAYLEDNQFSTTTKLNGEVIFSISGATGGEPDSDNAQIVFNDRVRLNLTTSFTGKDALITGLQAYNFTAGKPITGTGSVAETLFPNDASILGEGMTSFNYEPQFAGFNPQNLQPSCGNNSVCLYKLLYVTPVADNFTVFVGPKAEVTDAFPTIVPFASEGQGTLSRAFAINPVLRVSGGTTETGLASAAGFIYKPNDVVDWRALYGSVNAAIPQNEGFPGTPLGAGLFNGSFVAATQLTLYPTENLDLGFNYAYSYHQLNILGTGLTGAAAGTLGGLPLTTPVNVNSVGATLTWRINSSIYFTGYGAYFMVDQANGGSAFTDLASWMAGLYFPDAFVEGNTAGLMFGQPLTRVGAGNGATLTPANISNRATPYQIEAFYNYKINNNLSITPGAFVIFNPEGDSNNSTTGVFALRTTFTF

SEQ ID NO: 20376 - protein, 431 aa, Nitrosomonas europaea
MPRLTLLAAATAVAFTGFANAQDLTPQELQAQLTQLTQEVNQLKQQQAANATVTPSKPSAPAFEIGGRIQLDYNLFNGAYNAEHNGSSAQDIFPRRVRTFVEGELQDWDYKLLLEFAENTAEIVMARMRYSGFENGPKLQFGKLREDISLDALTSSNHIALIERSSLADTMSPYFRWGVSAYQYFPSTGLRYALGVYKNDAFGSDGKDETDDLNYALSSRVTWSQAKEPGQVLHAGLWYSARQMGGDDLSASFARGELRETNTRLINYVAGGETAAIDRLNQAGLELAFQHKALLLQGEYAQRNLTTQDPLSVLDGERYQAYYLQASYFLTGEQRSYSKGSAVFSQPKGVTDAWELAARFSSVDASSDFQGTQAQGTRAQTYTLGVSYYFNPKIKVMANYIHSSVDGAGTIALVGNEDVGDAFAARLQYVF

SEQ ID NO: 20377 - protein, 482 aa, Nitrosomonas europaea
MLFASIVKSVRKAVRALISLVRAAAAGCRPPIFAAMVLLWVSAQAADAAEALASVPAAATPLIAGGEFGDRFGFHGQSTWVWQAKPAFKSPYSGDNSLTADRATSYSFSTTLDLGMRLWRGAEFHFNPEVVMGKAFSDLHGLGGPTNGELAKVTGTDPTLYRARVFLRQTWGLGGDTEKVDADFNQFADVVDKRRVVLTVGNLPVLDVFDAVEYAHDPRTQFLNWSFMTHPSFDYAADARGYSWGIALEYTDSEFGWAVRAGRFLQPVESNGLPLDTRFLKHYGDMLELEKSFTLFGQEGKVRLLGWRNFARMGRFDDAIALGQATAGQPDLSLVRREHAKVGVGLSFEQKVGENLGLFTRLNWSDDKTETYAFTEAGRNVSFGGLLKGASWGRPDDVLGAAFSLNMLGPDHRAYLAAGGNGAFLGDSALNYGHERILEVFYSFQPVKGIMLSPDFQLIQNPGYNRDRGPAKFFGLRVHAEF

SEQ ID NO: 20378 - protein, 338 aa, Nitrosomonas europaea
MYKALIALALLAPGSAVLAADADFYGRINLSVTDSDLGVAAQNGKAGTVLENNSSRIGVKGSEAIGEGLEVFYKLEFGVDNFDNSGKTFKPRNTYIGVKTDFGAVSFGRNDSVFKTAEGTVDAFNGLNSDINQLLPGQDRFGDSVTFNSPKLGKLVTLNGTYLVSDNYDSSNAAYAISATLGDAKLKKQDWYLAFAYNDGLKSIESSRVVGQIKLGDLMLGGLYQQSEHQSKSNLDGNSYYANVTYSIGKTDLKLVYGHDDAGLGKYVSNFIKSQTSGSTSQVADVDLNQLSVGVNHKLAKSTQIYGHYTRYDGDLLLDGVNVSLDDDLITLGIRYDF

SEQ ID NO: 20379 - protein, 420 aa, Nitrosomonas europaea
MLFANHSIKLNPIALSLLGLFVCNGSHASALEQSGQSILPFLENGNYAEMNLFAVDSSVSGVIRDRPDIVRENQNRDTGDIGKNTQFYTAALKLQLTDQLNFGVLFDQPFGAEIAYPLRPNNTYSDNDTSKEGTSVKVETQNISMLLGYAPFKNFQIYGGPVYQEVKGKVSFRGAAYTEAYNGYNANFKKDAELGWLAGASYQIPDMALKAAITYRSKIKYDFQVDEDIFGQPIELVAPAKTRLETPQSINIDFQTGIAEKTLVYTSLRWVNWKKFETRPNQFGAISEILTSEATGGEYTKGFKLDTYQKDQYSATIGLGQQFTDKWSASTDISWDSGTGHPASTLGPMKGSWSLGLGAQFNPAPNYFIAGGVKYFWLGDVTSEDGTYYLPIEGIKTVAEQAEFRNNHALAYVLKFGYRF

SEQ ID NO: 20380 - protein, 764 aa, Nitrosomonas europaea
MIIIINLFSFAVDKTTANRTPLMPRSIPSRPAPLALSLSLFASFSAPTLAADPVEQQMVVIGSRAPTSISELPGTVWVIEREQLDQQTQAGVPLKEALGQLIPGLDIGSQGRTNNGQNLRGRSVLVMIDGVSLNSSRGISRQFDSIDPFNIERIEVMSGASAVYGGGATGGIINIVTRKGVGGDTRFNTELGARSGFQSHEDHDLRAAQSISGGNDLFNGRLAIAYQKNGAAYDGNGDQVLTDITQTDLQYNRSVDLMGSLGFTFANGHSLDLGLQYYDSGYDGDRGLDLGRNFDALRGRAPYSIKGGVDLDREPESKRHQFNATYHAPEVLGHDLYLQAYYRNEKMAFNPFPTIRYNNSGAINYGTSYYSASQQDTDYYGMKLALVKTWERVSLTYGVDLDREKFTSDQMLFNLPLAAASGGLVASEQAKLGRYPDIDTDSRAFFLQGSWKATDDLTLSAGVRRQSMSTDVSDFVAANQQILIANGLGKTADAVPGGSKDYDVNLVNVGAIYKLNQQQQVWANYSEGFELPDPAKYYGFGRYGAADGNGHYPLLQGVSVNDSPLDGIKTKQVELGWRHTDGALDTQVAAFYSWSDKSIKYDSKTLAVLQQDTKKRNYGFEGQATYWLDDHWQVGVNGLAIRSQEKVDGRWLKQDVTSASPSKAGAFVGWKDDQRSLRLQGVRTFNLNDEAGNKIDGYALFDLLGTQALPVGSLTAGIQNLLDKDYTTVWGQRAQVYYGGLAPAGLFDYKGRGRTYSLTYSVEF

SEQ ID NO: 20381 - protein, 164 aa, Nitrosomonas europaea
MLSFIRISCMVGMSALSYTLLNSLEEIMKETDIAGILTSTHTIALVGASDKPDRPSYRVMKYLLDQGYHVIPVSPKVAGKTLLGQKGYGTLADVPEKVDMVDVFRNSEAAWGVAQEAIAIGAKTLWMQLGVINEQAAVLARDAGLNVVMDRCPAIEIPRLGLAK

SEQ ID NO: 20382 - protein, 789 aa, Nitrosomonas europaea
MNPGKQRKHNRRHLPRAARLATLIAAMTLACGVMAQSAAVDVNISAQPLDQALRTLSRQSGAQIVFATDQLARRAAPSVSGKLTIAQALEQLLAGSGLRAKSTGPQAFVITASPEDAPPVPEVKLAPTEVTGSRPSLFASAGASLGALGEKPLEQVPFSVQAYNSELMNTQDARTLMDVVKNDPSIQDATQAGAYETVRIRGFFVDWTNTIRRDGMSVAPYYEIPLEHIEQIDVLKGPSGFLYGINSPGGTINYVIKRPTRDAFASVKTAVRDHSGYYASADLGGPLADGRFGYRLNVAGEKLGDFTHNGDLSRKFIAGAFDWAITPAALLRLNFDYQERKIAAQPAIGPYPDGTLPPPVDPRVLLGQPWLQYETKTYNVGADFSYRFNDAWKLTSRVAQSYNARVAAFPDIYNISTNGNILSGDIYLNPDQNFRVLSTDTYVSGNFATGPIKHQLVTGVSTRNFSAVESGFTVLGTTVGNIYQPVYSPAPGGLTFPAKNASKNYQPSVFVSDVMSFGPKWDLLLGLRHISYRNDSMPASGKNTEQRASVNAPSFALTFKPLPGLSTYVSYAEGYEQPGPAGYDTNNAGENLPPLKTRQYEFGVKSRVTDGLLLTGAVFRLEKTLQYVNAAHFTVQGGMQRHTGLELTANGRITGALSMVSGIGLLRTEADNPADPTVAGKRIADVPNLQASTFLDYRIAAVPGLSINGGVYYVGRRALDAQNTRWMAGYTRFDAGARYTTRVAGYRTTFGLTVQNLTDKRYWAAGDPSINGAWAGKPRTVWLSAQFDL

SEQ ID NO: 20383 - protein, 754 aa, Nitrosomonas europaea
MPVPGQTALAAPLTTTRSFQTTSTLPGIAAACPRPAWRGLAPSLAMAGLLALTTLDPARAQDGATATGNVSAQTLPEVRVTADASPEDLPAPYAGGQVARGARLGVLGNTSIMKAPFNVSSYTAQMIQDQQSPTLADAVNKDPSVRFTGLPGGNIDNFYIRGFPVGEGNSGEIAFDGLYGVAPNYRVFTDYVERLEVIKGPAAMLYGMSPNSGVGGVINIVPKRAHEDLASVTASYASDTQFGGHVDLSQRFGESREWGVRFNGSYYQGDTPMDNQSRKAGIGALSLDYQGKQLRASLDVIGQQEKIDAPGRAFIMGPGLQAIPGAPDGRRNVTQPWEWTRGTDESLLFRTEYDINDHLTVFADAGGGWTQLSRLFGTTPQIVNAQGDTLSTPTYYKFKVDRATYDAGLRSRFDTGPLRHAVTFQASAYADSLDRANTTGTPVASNIYNPVVRPAQGLPAPDSVPKVSDNDQTGFSLADTMSALDDRVLLTLGVRQQRIRSRNFGATGAVTSSYEESATTPMAGLVVQPWKRVSLYANYVQGLSKGDVAPPTASNSGEVFAPYKTTQYEVGTKVDFGRFSATLAAFQISKPSGQLGGNVFSVNGEQRNRGLELNLFGQVAPGVRLLGGVALIDGEITRSGTAAAVGKDPIGVPRVQANLGAEWDLPWVAGLTVSGTMIYTGRQYVNQLNTASLPSWARFDLGARYRTRITGKTTTFRANVLNVFDRNYWSGVTSWGGFSQAAPRTVMLSATVEF

SEQ ID NO: 20384 - protein, 611 aa, Nitrosomonas europaea
MKKTAASLLTLMAAAPLQAQDIALDEILVSPSLVATETSRTGATVDVVTAEDMQATGEISVSDLLARLPGVSYTRNGGLGATTTLRIRGLGSAYQAVRIDGIDVADPSGTQSDFDFGSLTAGGIDRIEVLRGSQSAIYGSEAVAGVIDIATYRPRDPGVSGQLSLEGGSNRTFTGGLSTGLLTERGELAFSVARTVSDGISQAASGTERDGFDTTFYALSGAYDLTEDLRIGAAFIARDSDLDIDGRGAGGIVDTDDRALSRLRGGRIFADFTLGQVQSVLAYAATDTRREYPGGYTEVFEGERRALSYLGTVDVGLASLSFGAERTKESFSRDRDEGDLTTDSVLGEARLALSPDLDLSMAARRDDPSDFDGKTTGRVALAWRLADDLILRGVAGTGFRAPSLYERFGPEGSDRLGPESSRSYELGLEKRFGGGAIVQATLFKTDVTDRIVYLGGADFCASDFGCYDQLDGETHSQGIELSARAPLGSEWELFGSYTYTDASDEANGTETRAVRVPRHDLVLGLEGQIADRTRGILTVQHIADVMDTTGYLQPDAPLDDWTVVNATVSYDLNDRAEAYVRVENLFDEEYQTVRGYAQPGRSIFAGLRARF

SEQ ID NO: 20385 - protein, 665 aa, Nitrosomonas europaea
MAKVNQRFRKTHSAALVIAAVISSQGYAAEKTNTATPTDTMVVTASGFQQRIQDSAASISVVTREQIENKAYRDVTDALKDVPGVVITGGGSTSDISIRGMAAKYTLILVNGKRVDTRSTRPNSDGSGIEQGWLPPLAAIDRIEVVRGPMSSLYGSDAMGGVINIITRKVGKEWHGTVRADATLQEDSKSGDIFQTNAYASGPLIDGLLGLKVSGLLSHRSEDKIIDGYNQQRMRNGTATFTLTPDDNNEFDFDIGHYVQDRNSTPGRTLALNGTNSDTQYDRNNYAVTHNGYYDFGNSTSYIQRDETRNPSRQMKSVDNIFNTQTSFLLDNHTLILGGQYRYEELYDKGNQLPSASDLKKLTRWSWALFAEDEWQMTNDFALTGGIRMDQDQNYGTHWTPRLYGVWHLADQWTLKGGVSGGYRSPDLRQATDDWGQLSGGGKGGLPALILGNSNLKPERSISQEIGILWDDQEGMNASVTLFYTDFKDKITEVRNCDITTNTTGQCVFNGINYKFISDRINVDKAMTRGAEATFAWDINQAWSLATNYTFTQSEQKSGAFAGQPLNQMPKHMLNGTLNWKTTEDFATWIRANYRGKASEYLNRTSMGSRTPSYTFVDLGANYQLTKEVRLMGGVYNLLDKRVDIDVNDKVLDGRRYMVGASYDF

SEQ ID NO: 20386 - protein, 883 aa, Nitrosomonas europaea
MKFSSLSLRALLIASTAVLSPTLASAQTETTSDTSAEAAAPEAEDLKLNEVVVLGRYIPEVLRSTSEVAAFLAPEDLARQGDSDAAAALARVTGINIAEGRFVYVRGLGERYSAARLNGSPLPSPEPLQRVVPLDLFPTNILENVLVQKTYSVEYPGEFGGGIIDLRTLNIPQESFLDLSVSGSYNTETTGKNGLTYYGSDTDVLGFDDGTRKLPGAVRQAMSTGLLVSSPNFTDSEIQAMGQAFTNAPINLIQKNDSIPLNGSYEASGGTSFDLGSAELGVIGVLGYSNDWRTRNAVQETGRLSNQELIRASDYEYVSTEQNIGWDALFGMGVDFGDDKIDWTNLYIRRTTKQAYSREGYNFLSDRDVRNDRTAWYERELYSTQLNGEHFRGPWTLNWRTALSQTKRDAPYEREINYIFSDIANSYIYDPSGSGSSNTIGFSYLDDKVISGGADVKYVQTLSSARDIEYSAGVEAYQNERTSQTRLFSFDIDNPPLDFLIQQQRPDFLFANYNINPDVFVLRETTSSEGAAAYDADLEVLAAYAKVDAEIFPLIRTAVGVRFEDATQSTTPLSLQTSATPPSVPPELENQYLLPAGTLTWNFAEDQQLRLGASKSIGRPQFRELAPQQYYDPESSRIFIGNPYLVDTEILNLDARYEKYFDRGQALTAGVFFKQLDRPVESIVIEQSASIFQTYLNAPEAVLYGAEIDIKRVFDSPIRGAFFDTKEFLVQVNYTYSTSEVKAGPGDVVFPLQAGGQPRPATEYIIDGTRLQGQSEHIGNLQIGWDDEAARSQLTLLLNYASERITARAPSGQPDFMQDPGINLDLVYKKGFDLRGQAFTFDVKARNLLGEDFEEYQSGNGGYIRVNQYDLGTTFSLGLSAEF

SEQ ID NO: 20387 - protein, 443 aa, Nitrosomonas europaea
MSELTDLLLQGPRSAPELRQRLAISQATFSRLVAREDRVIRFGKARATRYALLRPYRGIERIPVWRVDDTGKAHKFADIRLCWPQGSCLVTGADGDEQWFDGLPWYLTDLRPQGFLGRAWGRKLAAQLNLTDDIRLWQEEDVLYALTVFNGEYTGGWLVGEGNYQRWITAQHPAEIPLDQKLTHYEQLASDALAGEIVGSSAGGEQPKFTYYAQTPSGNKHVLVKFTVPQQTAVSQRWGDLLIAESIAAQILRDGGIHAIESTVLVTSNRQVFLEAERFDCKGNDGRLPIVSLEAVQSEFISSPGSWPQAMRRLCEQQLVTHQSVAQTEVIWAFGRLIANSDMHAGNLSFYLSEPPFALTPVYDMLPMVYAPNSAGMLRDAAIEVKFDLNVSKSAWLTAIPLAQQFWQTVARDPRISEAFRHIAQEMPEKIRQIEEKVARMGG

SEQ ID NO: 20388 - protein, 926 aa, Nitrosomonas europaea
MKVVLNTAATELDEVMVVAYGTAKKSSFTGSAKAVNAEDIVAGSKESLDKALSGKMSGVRVTSNTGDPGAPGDINIRGVGSISAAKSPLYVVDGVPVKSDSDMAYYGKQSSLLSSLNPDDIESMTVLKDAAAASLYGSRAANGVIIITTKAGKRGKTKVSYNGEVGWSNMAVKQYETMNASELLLYGKEAISNYYILNGLAGNRDQAYALIDKEGDMEAFFNDPSGNTDTNWRDEVYRTALTHNHQLSVNGGNDRTQFYVGLGYNNAEGIVIGSDFERFSGRINLDHQVNNWLTIGVKQMIAFTTQNGFRDQQNQDQGIGTASPLSLVYSSDPTAPVKNPDGTYNADSNWGAASNPHLMLGKEQWIKSRVMRSMSNIDLGVKFSKQLSFKTIFGYDYIDTKHFEYWSPNSVDGKAVGGLGSRYTYENRNLTSSSTLRYANTWNDVHNFDILGGFEVTEDELTAIYTTAKQYSTDKLPELGNGQPDGASSEVFGSGIVSYLATGNYNYDNKYYLSASFRRDGSSRLGTDNRWANFWSVSGAWRISGENFLKDNELFSDLKVRFSYGTNGNLPGSYYANQALYAFSGGYGPSSAIYWNQAGNEELGWEKSKNMNVGFDWNLFNRVNLTVEYYNKTTTDLLFEIPTSIVTGFEKNWQNLGKLRNSGIEIEVNSQNIKNQHFSWDTNFNLTFQKATIKELPNHNDIEYGDGDMYLHREGESMYTFYLPEWKGVNPDTGLGEFWKDPNDHSKGVVNKYDEAEKGIVGKAIPDVTGGLTNTFRLYDFDLSFLITYQFGGDIFDYPNYFFHHDGFRLGSFNLEKSVAGNYWMNPGDNALYPKPIYQNPYRSDRFSSRTIVSSDNIRMREITLGYNVPVLKNIFSNLRVYFRANNPFMIWAKTKGIDPDVPLNGYRQVDTPVSKSFVFGVNITL

SEQ ID NO: 20389 - protein, 752 aa, Nitrosomonas europaea
MKYRHTTLSLAMASSLLLIPNLSTAEGLTVLEEIVVTARKQNESLVDTPIAVSVIGAEFFEQTGFNSMSDIVKFVPGFDYSPTNTTRANGTRIRGISTFSFSDGFESSVATVIDGVVMGREAQGFFDLYDIESVEVIKGPQGTLFGKNASAGVVNVRTKKPEFEFSGGSDVMFGSDNELRVRGTVTGPLIEDTLAYRLTGSSHVTDGKLNNAFPGQDDVNDKDTWSLRGKLLFQPSDNLSALLTVDTVKEDNACCLPTYLTSNDDIFIIASAYTENAVQLQAALDEFGIKPGEGNRDVAIFDDRINQESEAGGVALELNYGFEGGTQLTSITSWRDWEIDEFNEADQLSNTDINNRNGTEAESTQVSQEFRLFGDMGDSVSYVAGLFYFNEDVDADGSIFVELGSFGLFNTQLQAVRSVETTSAALFGEFTWDVTDRFSLIVGGRYTDEEKKGSYTRTYTPINPNFPQSEFLGAAFTGETIIDDQDFSGRVIGRYNISENVNTYLTLSRGYKGAGIDVAESANLNFVNEEGGLPVLDPEIPTLVELGFKGWFLDKTLSINTALFTQSVEDLQSINRDAAGLTRNISITEILSNGLEADVTYLPPVDGLTLSASLTWLDVKYEKFDDQPALEGADYQGVPEWAVSFIGDYAFKIGDGGWDSFVRAEYYWQDEKNSSAGGEEAFAIDSYGLLNLRAGVTSPSGIYSVVLGVENATGEDYPYFVGGSTFAVLGGSATSQFLGPDRTYRLTVGAKF

SEQ ID NO: 20390 - protein, 815 aa, Nitrosomonas europaea
MPHHTPLASAIALAIAGLAMPAFAAEPNDRLDTVVVVGTHRSDVTALQSAAPVDVLSGEKLQETGASDLSAALTALSPSFSFPQSPQGAFAGSIAQGASLRGLASDQVLVLVNGKRRHTSANVTRQGLVNARGAAAVDLSLIPLSAIERVEILRDGAAAQYGSDAIAGVINIVLKERDEGGNAGYRFGGYKKGDGLQRKLSGWKGFALPNDGFLTLAFDAGSQDPASDTRDDNRLFYPGSTSIDTPREQNNRYRNWRWGSGNVSDQYNFTANAEMGLSEGLSAYGFATYAHKNTDAENFFDPPTTLRNNYGSVALARYPDGRLPVTRYGLEDFAVTGGLRFENETLGNFDLALNYGDNRVDSTDHDAINPSWGTASPSTIYTGRREADQTNLTLDWTRDFANAWLFKPLTVSAGLAWRQENYDLSEGDAAGWSNGPLFNTIDPVTGRRIPGYYSGITQVDAVSLDRRVIGAYFDVEAQVTEKFQAGVAVRSEHYSDFGDTTNGKLSLRYDFTPQIAARASASTGYRAPSLVQSGLSSFSVQVVEQPPGSGNWVEVQQRTLRADSPEAALLGGKALKPEESTNFSVGLVWRPLPNASVTLDAYRIDIDNRITLSDQLPASVVGPIFAGTPYANIQSAAFYSNIADTRTDGFELAGHYQLDLTGWGRLDLNGGYARNNTRITGLDDVGGIPGNQIIGRNTQGLIEDGTPKDKLTLSANWLYDGWSVTVAQRRYGEWKNRNAANPTLDQTFSPQWVTDLDVSYRFDLGLTLSAGAINLFDSHPDKLKGAQLYGVPKYSITSPEGAQGAFYYTSVSYDF

SEQ ID NO: 20391 - protein, 370 aa, Nitrosomonas europaea
MQKNLIALAVAGLAALPAFAQSNVTIYGLVDMGYKWSGDNMDDRVSSRSALDSGMSAGSRLGFKGTEDLGNGMKAGFVLEQGLNLDTGTLGQGGRAFGRQSFVSLGGGFGTVALGRQYPAGYLLTATVDPFGSGTAGQYNSVYLTEYRWDNAVTYVSPTLGGFSISAAFTMNVNGEESPDNRGEGDVGDIHAWSVVPQYVNGPLFAGIHLQEMRAKSTGLYDGETVRVYDVAGTYDFGVAKLAASYGLRRASAADFSPDSAAVNGKDSRQWFVGVTVPVGAAGTVRASYVARETEVVSGGPDAKVSQWALGYEHALSKRTALYAVYADIDNNEAAKDSGLYASIGDAMAGGVAGGDGYQRGVNLGLRHSF

SEQ ID NO: 20392 - protein, 775 aa, Nitrosomonas europaea
MLRSGGVSRKRRQQGFPVKKNRIALAVSAVLMGPAVAAAQVVDAPEPLQEVVVSAKSERAETPAIPPNTPSPAYGISRRRMADFNVVNTEDALKYAPNLAVRKRFIGDMNSIISVRSTSSRQSARGLVYADGLLLSNLLGSDFSFPPRWSLVNSAEIERMDVLYGPYSALYPGNSLGATVLITTRTPEKFEGDASVQLFTQRFSLYGTHDNFNGVHANAYVGDRVGPFSWLVSVDRQDSKSQPLSFYTAARSTARATSADKPVTGAHFDQDQTGRERVVMGVNSEGVTHTVQDQLKLKLGYDITNTLQAQFTAAYWQQDRSSATGSYLRDADGNVVSSGPVNIGGYRYVIPANAFAPSNGEDARWLYGLSLRTRNETGWNFSGVASLFDVSKDISRSANTVGSGPGTVTYGDGTGWRTLDLKADYRPRQLQGGHWVTFGYHYDNYRLSNTTYNTSDWQAATISAFNNAFAGKTETQALYAQDAWYFAEDWKLIPGVRYEHWRAYDGSRSQPGVDIGYPVRSESNWSPKLALEKAFGQDWLGRLSLGQAYRYPTVSELFQGRITGTALINNDPNLQPERSFSKDLTFERTLDSSYFRVSVYEDDIRDALVSQTNTTVFPTVTSFQNVDRVRTRGIELAYDARDVFVSGFDLSASGAYNHSKTLENANNPASVGKYFYRIPKWRANLMGTYRITPAWAGTLAMTYSGRQYNTLDNSDVNPDTFGGTSSFLTFDVKLTYRPAKNVRLGLGIDNLTDQRYYVYHPYPGRTFYAEAKLSF

SEQ ID NO: 20393 - protein, 813 aa, Nitrosomonas europaea
MQHTSRTCAVFLLGVFSVFAQQSGTISGVVADVTGKGIPNAVVTVRNEAGGAPKMAATDSEGKYSIKDLAEGSYQLEAAAPSFALSRRNGVRITAAGSANVNMSLNVSELAQSITVEGSVSMAAESAPMQSTLEARSAKTEISPEYIQNYASPVADFSELLNNAPGTFSVNPNGVGLGDSKTYFRGFKDGQYTMQADGIPFNDTNDPTHHSWAFFPSQFIAGVDFDRSPGSASAVGPTNYGGTVNLLSRSVALQPDFRLTASYGSFNTRMLAFDADSGQFGKNKNHSLTINIHQMLSDGYQTYNYQKRVAGFIKYQYRLNDRTTFTLFSGLVDLWTNTPNLKGPSRAQIAQYGDNYLLSGDPSQPNYYGYNVYHVQTDFNYIGVNSDLGRGWKLENKVYTYRYWNKQYYNNPSIQANGFFLPGAQSITATSAVDKLNGYRKVGDILSVSHETARGTLRTGIWYEWAYTDRYQIPSDPRSGLDTVLPNFHEHFITSTFQPFVEYEYRVTRDISITAGMKLAYYRMDLKQFADNGKTVGSLGGAPYTEHSAPYHAWNPSADLRYKIKPNWTMYAQFAEGNAIPPSSVFDTKGALVAVTPKPTAVKTYQVGSVVKFNRFTLDADAYYSHFQNPYSSFLDAAGEAFFYQTGPSNTKGVEVEGNVTLVRGLSLYLNATAGSAKYQGGAKYANGGLWIQNTPNNTEGAGLTYATRGWSVGMFNKRVGRMYNDNGSVNQAFTIDPFNVTNLFINYTVRGDSYLRGTKIRFGINNLLDQHNIVSINGFSSKSNAPSPGDVLTLLPARSISLTMTFGYAPGR

SEQ ID NO: 20394 - protein, 850 aa, Nitrosomonas europaea
MDNRSTFFIDRTQGVFMIIKTVSLRHGFLLGSVLATGLFVSASAVAQSAVTQQTIAIDLAAQPLEQAITQLATQAGLLIGVDASLVAGKQAPALNGRFTPLQAIGQLLKGSGLIVIENAPGRYTLEAAPAGHTNSNTEAVTLPEMKITSVIDPDAPDNRSYRRSSAFSATKTDTPIMETPMSIQVIPRVVMNDQKTTTIKDALENVSSVRPQSSLGRSNAFIIRGFRNGRVYRNGLVALGLSIGEESMFDSANLESIEVLKGPASILYGRIEPGGLINLTTKKPRGESYYSIEQRFGSYNSYRTEWDGMGPVTKDKSLNYRFSGSYQNNRSFRDFNFNDRVLVNPALTWRPDDATELSLEVEALHEDYQVDRGLFAIGDRPAPIPVTRSFIDPDDPVDTHSRVNLGFNLTHAFNTDWTLRNRFLASFVDDDNTSVKPANAFTVAQFLDPSKGNRTYLRNIFSQISSSQTYTTNFDLTGNLEFLGTRHQTLVGFDYLRSTGTYLTRGNYLSPVSGLEIDIYNPVYGIDPSFYAQALATPFPAGENHSFSKDEWYGVYFQDHITLWDKLHILGGGRYEWATTGRGRGDSFRAAEANLPTRKDNGFSPRVGILYQPWSWASIYGNWTTSFGANNGVTNTGATIDPERGEQFEAGLKAEWFDQRLTMTFAYYHLTKENILTRDFNSPDPFAVAAIGKARSQGIEFDLSGQITDELSVIGNYAFTDARITRDYSGLQGNRLSNVPEHSGSLWLKYDIRHYQPLNGWQFGMGIFAAGLRQGDNENTFALPGYVRLDAFVAYRMKLGPTRLIAQVNIRNLLDKRYYESTDPFVNAPPRAGIYPGAPLTILGSLRLEY

SEQ ID NO: 20395 - protein, 2003 aa, Nitrosomonas europaea
MYKTTVHKMRSLLQNTTALVGIRYWSVAAAIVMCPALSVQTARAEFVWTGTTGGWNSPAFWSSGSIPDSAGAEVTFNGMSDGITYYVGLDGGPYTVGTLNINNSVLGGYAFQNGTLTLNSGTTDDARIIVTRRNHTPIFQSTAVLNLASDVTVDTVGANAEMSVAGKIFGTHKLTKTGAGTVTLYGASAGSMFSDIDVTGGTLALLGAGDVGSTTLSVRNGTLQTDGAALASGATVNVGANGAFDVLIGNETIRELQQTGGTVSGRTGTTVNISGHYNQTDGTTGRNITLNAGTFTQKRGVIAKDTTVNVAGKTILSGGEINGVLNLSGDASVLQDSKTTVRGELSASAPATLTVKDTLAFDRATSRNVSYNLEGGVISAIADMLLSTGTISLLSGQSGTLAAAAGATLNIMTGFKAEDGSVLTLGSAADTGTVFLSFRNASRSGAAGQETHVAGGTVKIGSLLAGKTALGIDTNSTLPVRVAIAKDAVVDVNGFGTNLTALSGSGTVTNSAPNSAVITANGNVNSVFAGVIENGSGGLSLIKDGTGTLALTGDNTYTGGTDIKTGTLQIGDGGTTGSLAGDIHNSAALAFNRSGILTLAGAISGNGSLLQSGTGITILTGNSSAFTGETSVSKGTLQIAGKLGSSAGHIDAGTTSGATANLRVTGTDARWLIDGNLSIGGAGNGGLVIDQGGIVTNSFGDVKGVSGEPATAVVNGRGSRWDNRAALLAGVDGHGEVYVLNGATLTSTDGHIGRSLNGAAGEGLVVVSGTGSNWSNAGTLRVGDMGGKGTLRITNGGIVTNGDSFIGSMTNSTGSVIVEGSGSRWINTGDLNIGFGTPFNYGSGSVSITMGAVVEAGADGKGTVYLAKDGLFPGFGSTGTLSIGADSNDAAKAAVAGRLKAGLLEFGKGTATLRFNHTDSNYVFDTRMKSGNTGSINQIAGTTVLTADNTDFRGMTTVSGGKLIVQGTLGGSAAVTGGTLQFGGGAQSTINSLSGDLNVSGAGSKLAIAGSSSLWVSNTIDLQDQTQLAINAGAGQPSLESDRMRIGNGVAFNLSGIQNESQLEKVLISTRNGISGDFSAVTIGGFNGTVDYMTVHTRKSDDETKYLASYGLSWTAGNNLAHGTFTLANATDHFTVGTALADQVMNVVSGWDGTSLTKAGDGTLLLTGTNTYSGGTTIQGGVLQLGNGGITGSVLGDITNNAALAFNRSDSFAFSNVISGTGRVEQRGSGTLILSGINTYTGGTSIAGGILQVSADNNLGAGLGGLTFSGGTLATTAGFDSARAIGLTGNGTFDIAAGTEFGLTGVITGTGDLIKSGAGTLRLENGGNAYGNTLVQSGILTGDAGSLSGHIGNAATMIFDQNVAGTFAGNIAGLDGVEGRMEKRGAGTLTLAGTSVLDWTIAGGELITAADRFGGNAEIASGTSLHFDGSHAGHYAGVLSGSGRFALDGTGTVLLTGDSSGFTGTTTLNAGTLLVGNANGTGHLGGSLDVLAGARLGGSGTIGSGTGSLVRVASGATIAPGNSIDTLTIDGNLTFEAGSTLEAEINPALESDLITVTGQANINGGTVYALKAGGVYLPESRWTIVTVVGGVTGVFNNLDQNMPFVDLALSYDRNHVYIDAKRNAVAFCDVAVTSNQCATGNGIESIGVGNTVYDLVASLTDETSARQAFDALSGEIHASAKTALIEDSRFIRNAANDRLRAAFGDAGASTAPVLAYVSQSDPVAVAATHSGPVFWTQAFGSWGSADSDGNARGMGRNTGGLLIGADTMLDYWRAGMLSGYSHSRIKGDTGSGSASSDNYHLGLYAGTNWSNVNFRSGIAYTYHNVDAGRFVAIPGLNEQLKADYSAGTFQTFSELGYDIRLKNGMRLEPFANLAHVSLHTNGLSETGGAAALNSPSSNTNMTFTTLGLRGEQIVTLGEMKATLRGMAGWRHAINGTVPEVVFAFSDGDNFTIAGVPLAKDSASIEAGLDIDVTSSVTLGLSYTGQYSASSRDHVFNANFEMKF

SEQ ID NO: 20396 - protein, 776 aa, Coxiella burnetii
MKIVKRKHALLQSVAILVAVGVPSVASAQVEEIVVTAQKREQSIRDVPISLAVISGDDLKKRQVSGIQDLANSVPNVFVSKGTVSDNIYIRGVGSGSNAGFEQAVATFVDGIYHGRSRYTQSALVDLERVEVLRGPQTIYFGNNAIGGAFSVTTKKPSLKDWGGYALASYEFEGNEPAVEAAVGGPIVEDKLAVRIAGRYSHLGGYIKNDSTGKDNPKIKDRFIRGSALWQMAPGWTTLVKAEYGKQDSIAPFAAQLTDCPPAAPFSTAATFSCAYALATNQESKFDYHRQSEPGEFGNIKASEYMVKIERENIDGPGLVAQASYSKMDFQIVADTDGVPASFFNYNSSEYLKQSTVELRIVSPAQSKIEYVAGVYYLHSKAGIGTTLNFPFANVLLAGPLAPLAPFAPLAGDIDLREKENAFSAFGSVTYPLTDKFSITGALRYTHSKKTGTQSATNAQALDTYGLSVVPLPAGLQPVAAFLTGFVDHTTQARVSDGVFLPSVSAQYKANRDVSFYAKYSKGFKAGGFDAVELTGIPDRLSYAPEKVNAFEAGLKSVLFDRSVSFNLSVFRSMYKDLQQSVTQFTATSAFITVTNVGGLRTQGVEAELVWRPNDRFEFGSDFALLDASYRNYANAGCTALQALQAKAAGKIGCSQDLSGRSPPFAPKYTGNVRAAFNQPLNDALKFSANAMLSFAGSYDVSPDKDPVTRQKSWRKIDLRLGIGDIDDKWTLAFVGTNLANVKVSGSATGVVASAGSFTRTILRGRTLAAQAQVKF

SEQ ID NO: 20397 - protein, 282 aa, Shigella flexneri
MTLRCLLNPWRFSERILTDRENGEKGDNSQDTSYARVGVKGETQINPEMTGYGQFELDLEASNRHNPDQTRLAYAGLSYKDFGSFDYSRNVGVAYDAEAFTDMFVEWGGDSWAGTDLFMTNRTNGVATYRNTDFFGMVEGLNFALQYQGKNEGTGNYKANGDGHGLSATYTIDGFSFAGAYANSDRTDWQSGDGKGERAEVWALSTKYDANNVYAAVMYGESHNMNSDDGDVVNKTQNFEAVLQYQFDFGLRPSIGYSYSKALDVAGQFLDLPLYFQTSVIT

SEQ ID NO: 20398 - protein, 1285 aa, Shigella flexneri
MNKIYSLKYSHITGGLVAVSELTRKVSVGTSRKKVILGIILSSIYGSYGETAFAAMLDINNIWTRDYLDLAQNRGEFRPGATNVQLMMKDGKIFHFPELPVPDFSAVSNKGATTSIGGAYSVTATHNGTQHHAITTQSWDQTAYKASNRVSSGDFSVHRLNKFVVETTGVTESADFSLSPEDAMKRYGVNYNGKEQIIGFRAGAGTTSTILNGKQYLFGQNYNPDLLSASLFNLDWKNKSYIYTNRTPFKNSPIFGDSGSGSYLYDKEQQKWVFHGVTSTVGFISSTNIAWTNYSLFNNILVNNLKKNFTNTMQLDGKKQELSSIIKDKDLSVSGGGELTLKQDTDLGIGGLIFDKNQTYKVYGKDKSYKGAGIDIDNNTTVEWNVKGVAGDNLHKIGSGTLDVKIAQGNNLKIGNGTVILSAEKAFNKIYMAGGKGTVKINAKDALSESGNGEIYFTRNGGTLDLNGYDQSFQKIAATDAGTTVTNSNVKQSTLSLTNTDAYMYHGNVSGNISINHIINTTQQHNNNANLIFDGSVDIKNDISVRNAQLTLQGHATEHAIFKEGNNNCPIPFLCQKDYSAAIKDQESTVNKRYNTEYKSNNQIASFSQPDWESRKFNFRKLNLENATLSIGRDANVKGHIEAKNSQIVLGNKTAYIDMFSGRNITGEGFGFRQQLRSGDSAGESSFNGSLSAQNSKITVGDKSTVTMTGALSLINTDLIINKGATVTAQGKMYVDKAIELAGTLTLTGTPTENNKYSPAIYMSDGYNMTEDGATLKAQNYAWVNGNIKSDKKASILFGVDQYKEDNLDKTTHTPLATGLLGGFDTSYTGGIDAPAASASMYNTLWRVNGQSALQSLKTRDSLLLFSNIENSGFHTVTVNTLDATNTAVIMRADLSQSVNQSDKLIVKNQLTGSNNSLSVDIQKVGNNNSGLNVDLITAPKGSNKEIFKASTQAIGFSNISPVISTKEDQEHTTWTLTGYKVAENTASSSAAKSYMSGNYKAFLTEVNNLNKRMGDLRDTNGEVGAWARIMSGAGSASGGYSDNYTHVQIGVDKKHELDGLDLFTGLTMTYTDSHASSNAFSGKTKSVGAGLYASAIFDSGAYIDLISKYVHHDNEYSATFAGLGTKDYSSHSLYVGAEAGYRYHVTEDSWIEPQAELVYGAVSGKRFDWQDRGMSVTMKDKDFNPLIGRTGVDVGKSFSGKDWKVTARAGLGYQFDLFANGETVLRDASGEKRIKGEKDGRILMNVGLNAEIRDNLRFGLEFEKSAFGKYNVDNAINANFRYSF

SEQ ID NO: 20399 - protein, 605 aa, Shigella flexneri
MASTLRPIRSLMAVAIALAASPAMADSAFDQTVFFGDSLTDSGYYNPLLPAASRAVTGKFTTNPGWVWAEYVGDHFGTNAAPNGNGQTGDNYAAGGARIQASSVSELGAAPSVTSQVNTYLAANGGQANPNALYTVWGGANDLLAAATAPAQAQAIIGSAVTAQVGAVGALQAAGARYVMVPTIPDVGITPRFRAGGAAAMAQGTAAATAYNTALFNGLQSAGLRVIPVDTFHILQEVVADPGTYGFSNVTGTACNPALALPACNPTSLVAANAPNTYVFADGIHPTTSTHQILGQYAISLLEAPRLQQVLTRSAQAGGRARADQVAWHLDGKPEADGLRWWGSVRGDIQRYDDADLYDGMAPAGLFGVDWTAGDLVFGGFAGFGRMDADFGNRNGSFKQDDTTLGGFVGWYTGPVWVNAQVSYSWLSYDVDREVQLGPATRVHSGSPDGSNLTAAVNAGYSLGEGNVKYGPVVGLTWQKLKLDGYTESNASSTALGYADQDIDSLVGRIGFQVRLDGAPVKPYLQATYDHEFKDGTEASAWLQSMPEVGMYTVPGQNFDRNYATVVLGARTGIWGLQSNIGLSTTTAQRSARDATVFVNFSGNF

SEQ ID NO: 20400 - protein, 295 aa, Shigella flexneri
MTLRCLLNPWRFSERILTDRENGEKGDNSQDTSYARVGVKGETQINPEMTGYGQFELDLEASNRHNPDQTRLAYAGLSYKDFGSFDYSRNVGVAYDAEAFTDMFVEWGGDSWAGTDLFMTNRTNGVATYRNTDFFGMVEGLNFALQYQGKNEGTGNYKANGDGHGLSATYTIDGFSFAGAYANSDRTDWQSGDGKGERAEVWALSTKYDANNVYAAVMYGESHNMNSDDGDVVNKTQNFEAVLQYQFDFGLRPSIGYSYSEALDVAGWICPYISRHLLSLNPLQARCRRYSRGER

SEQ ID NO: 20401 - protein, 365 aa, Shigella flexneri
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 20402 - protein, 366 aa, Shigella flexneri
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGLATYRNYDFFGLIEGLNFAAQYQGKNKRTDNSHLYGADDTRANGDGFGISSTYVYDGFGIGAVYTKSDRTNAQERAAANPLNASGKNAELWATGIKYDANNIYFAANYDETLNMTTYGDGYISNKAQSFEVVAQYQFDFGLRPSLAYLKSKGRDLGRYADQDMIEYIDVGATYFFNKNMSTYVDYKINLIDESDFTRAVDIRTDNIVATGITYQF

SEQ ID NO: 20403 - protein, 786 aa, Shigella flexneri
MKRVLIPGVILCGADVAQAVDDKNMYMYFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRLDWLTSHIDENNKSAFNQGSSGSTYFSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLACAKLRTTVGWDHISDYTRHDHDIWYTELSCTYGDITGRCTRGGLGHISQAVDNYTFKTRLDWQKFAVGDVSHQPYFGAEYIYSDAWTERHNQSESYVINAAGKKTNHTIYHKGKGSLGIDNYTLYMADHISWRNVSLMPGVRYDYDNYLSNHNISPRFMTEWDIFADQTSMITAGYNRYYGGNILDMGLRDIRNSWTESVSGNKTLTRYQNLKTPYNDELAMGLQQKIDKNVIARASEAHDQISKSSRTDSATKTTITEYNNDGKTKTHSFNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 20404 - protein, 773 aa, Shigella flexneri
MQGKNTIVITGDYSIGLLSQTSGNLNTDTIIRVNSDGSVTPSFSDGDDTFIVTAGNHAVGVLACASPGSARACVSSLDEESTTDTGSNENNAIAKLDMAKGEITTHGTESYAAYANGTVVKAGDTLDYTNASVTLTDVDITTHGDNAHAIAARQGTVSFNQGEIYTTGPDAATAKIYNGGTVTLKNTSAVAHQGSGIVLESSINGQEATVDILSGSSLRSANEILYHKNETSNVTITDSEVSSAADVFINNIKGHLTVDATNSKITGSANISTDVNTHTYLSLSDNSTWDIKADSTVSNLTVDNSTVYISRADGRDVEPTRLTITENYVGNNGVLHLRTELGDDNSATDKVVIDGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRLEAGSYVANLAAANTLFVMRLNDRAGEMRYIDPVTEQERSSRLWLRQIGGHNAWRDSNGQLRTTSHRYVSQLGAELLTGGFTDSDSWRLGVMAGYARDYNSTHSSVSDYRSKGSVRGYCAGLYATWFADDISKKGAYIDAWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGASNLGEIKLGVNGNLNPAASVWGNVGVQLGDNGYNDTAVMVGLKYKF

SEQ ID NO: 20405 - protein, 186 aa, Shigella flexneri
MNVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPATFQMTYIPGTYNNGNVYFAWMRFQF

SEQ ID NO: 20406 - protein, 468 aa, Shigella flexneri
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSIGAKYDFKNNFVLEAAFGQAEGYIDQYFAKASYKFDIAGSPLTTSYQFYGTRDKIDDRSVNDLYDGTAWLQALTFGYRAADVVDLRLEGTWIKADSQQGYFLQRMTPTYASSNGRLDIWWDTRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 20407 - protein, 752 aa, Shigella flexneri
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEIQFKAGTDSLFQTGFDFSDALDDDGVYSYRLTGIARSANAQQKGAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAQNKVSQKSVYGYGMCSDPLYTKDDDALKASPCLSIPQSEWNHTLTRQYVIDNEKLENFSVDTQLQSKFATGSVEHTLLTGVDFMRMRNDIDSWFGYAGSVAPSDIYNLDRSDFDFGAHPDPSGPYRVLLKQKQTGLYVQDQAQWDKVLVTLGGRYDWAEQSSFNRDYGNKSDRDDKQFTWRGGVNYLFDNGVTPYFSYSESFEPASLTDANGDLFAPSKGKQYEVGVKYVPEDRPIVLTGALYQLTKTNNLMADPNNPNFSIEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 20408 - protein, 1115 aa, Shigella flexneri
MRKKYLCILICLFANALAFASAANRTITGVVISGEDNEPLIGASVYVNADDLKKAGASQTSLGTITDMDGKFSISIPEKVTRLHCSYIGFEEQDIVLQAGKDTYRIVLQASSHTLGDVVVTGYQELERRKLTAAIAKVDVTDGMVGAAKSIDQALAGQIAGVAVTTTSGAPGAPARIRIRGTASLNGTQDPLWVLDGIPLEGTDIPEINKDNDNDIVNMSQSSIAGLSPNDIESITILKDAAATAIYGARAANGVIVVTTKRGKTGKPVINFNTKLTYTPNLNTSRLNLLNSEEKVDLELQLLKEARFDILWGLTDPIPVFPEKGKVAAIMKQYNLIDIYKEQGWNGLTPEAQNAINKLKTINTDWNDILFRDAFTQEYNFSISGGSEKVTYYNSLGYVKENGNVPGVSMSRFNLTSKTSYQINKILKIGMSIFANRRKNNTFMTDTYGLINPIYYSRIANPYFAPFDEQGNYLYDYDVVRSNETDEKQGFNIFEERANTNKESVTTAINSIFDVQLRFNDQWKVYSQIGVQWDQLSQEEYAGINSYNIRNIRETNKYWKNGVQTYLIPEGGMLKTTNSTTSQLTWKIQGEYKNTFGDIHDIQIMAGSEIRKNWVDNQASTGYGYDPKKLTFQNLIFKDEAQANDWNLKTKSYKENAFASFFANGSYTLMNRYTLGGSVRMDGSDLFGVDKKYRFLPIYSVSGLWRLSNESFIRQYKWIDNLALRLSYGLQGNIDKGTSPFLVGKYDNVNILPGYSEENIIINSAPNSKLRWEKTASYNLGIDFSVLNQAINLSVDYYYRKGTDLIGSKALALENGFTNMSINWASMENKGVEINLQTRNITTKNFSWYTTFNFAYNQNKVLKVLTDKSQVTPSLEGYPVGAIFALKTKGINPDTGQIYLENKEGKAVTVEELFRMTSNEDGLGTYQIGPSTEEQRDFYSYVGTSDAPYTGGFLNTFNYRNWELNLNFSYNFGAHVKTTPSYNVSDLDPGRNMNRDILDRWTPENTTGKFPALATYNYNPADYYLFSTRNDIYRSLDIWVKKLSFVRLQNIRLAYRVPSEWLHKLSIGGATVGLEARNLFVISSNYDNYMDPESMGNLYSTPVPKSITFNLSLNF

SEQ ID NO: 20409 - protein, 777 aa, Shigella flexneri
MLMKPSSVAIAITMAIASSQVHANEDESGTTEQPEIKKSKSSLIERIEVTAQKRLQSADDIGMPIAAFSSQQMKDLGINNAIDITKFTPGVVYSETSAVGVPIYTIRGVGFDDYSTAANSTVGIYVDEVSLPYPIMTRGLQFDVQRVEILKGPQGDLYGRNSTGGAFNFISNKPTQDFELGVNLEYGSYQRVKTDGFINGGLTNNLSARFSFATLNEGEGWQTHAVTGEDNGAQDQLGYRLLVNWDLSSDASLLFNVHGGRDKSENSVPQAFAYRPLVPGFGTVPTDIDKINLNDSSSASWGVSDFEGTSPIETKRDSNSFGASVTLDWALNDNLSLTSITAYEEFDRKDGNDWDGSDLRSTDVYNDSDIQAISQELRLSADNGEDFSWIVGAYASSDSVKESFFSDVVQASNSDFTWIAPDMYLQYVDTRYEINTKTAALYGHTEWDFAEDWTLILGARYTAEERELLDACTYDVEGALTPILGTGPGDCGTVNPETGMTETFSDELSVSNLSGKVGINYKLNQDVLLYGLVSNGFKSGGYQGAHASSTSQWGPYDEEILNAAELGFKSVLLNNTMKVNASVFNYWYKDKQVQDTLVDPLFGPLSVIINLEESEIRGAEIEWVLNPLDGLDLRVSGTWLDTEVIEGTGINLETLEPMDLAGQKLTNSPELQWSALISYEAEIGDDWLLRSQLDGFYSDSSFSYLTNDPELNTLESYTVANLRFALLQSDGAWEVSAFVRNLTDESYYTSSSYANDIYSRSMARPRTFGVGFSYSFY

SEQ ID NO: 20410 - protein, 378 aa, Shigella flexneri
MKRKVLAIVIPALMAAGAAHAAEIYNKDGNKLDLYGKVDGLHYFSDNTSADGDQSYVRLGFKGETQISDQLTGFGQWEYNVQANNTEGSENQSWTRLGFAGLKFGDYGSFDYGRNYGVLYDVEGWTDMLPEFGGDTYSQSDIYMTSRANGVATYRNTNFYGLVDGLSFALQYQGNNEDSGNGNEGTNNGRDVRHENGDGFGISTTYDFGMGISAGAAYASSDRTNAQQNDSSAYMADGEKADAWTAGLKYDANNIYLATMYSETRNMTSYGTFDEDHTGGVANKTQNVEVTAQYQFDFGLRPAISYLQSKGKDLTYNGANTDQDLVKYVDVGATYYFNKNMSTYVDYKINLLDSDDQFYKDAGIATDDVVALGLVYQF

SEQ ID NO: 20411 - protein, 955 aa, Shigella flexneri
MGIKQHNGNTKADRLAELKIRSPSIQLIKFGAIGLNAIIFPPLLIAADTGSQYGTNITINDGDRITGDTAAPSGNLYSVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDAIINFTGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMTMKASNGLNIHLNHYESLLGRASMILGYDITAGNSQLNVYVKTGAIREFSGDTEYLLNNSREKYSFKGNGWNNGVGVSAQYNKQHTFYLEADYTQGNLFDQKQVNGGYRFSF

SEQ ID NO: 20412 - protein, 937 aa, Chlamydia trachomatis
LMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIAAQLLASKGIWFGSGSPSSRHAMSYKISQQTQPLSWLTLHFQYHGFYSSSTFCNYLNGEIALR

SEQ ID NO: 20413 - protein, 333 aa, Chlamydia trachomatis
LMMMGFVASTATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDLTLQYQGKNEGREAKKQNGDGVGTSLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDD

SEQ ID NO: 20414 - protein, 993 aa, Chlamydia trachomatis
SPQVLTPNVTTPFKGDDVYLNGDCAFVNVYAGAENGSIISANGDNLTITGQNHTLSFTHSQGPVLQNYAFISAGETLTLKDFSSLMFSKNVSCGEKGMISGKTVSISGAGEVIFRDNSVGYSPLSTVPTSSSTPPALDPSPTASSSSSPTVSDARQGSIFSIETSLEISGIKKEVMFDNNAGNFGTVFRGNSNNNAGSGGSGSATTPSFTVKNCKGKVSFTDNVASCGGGVVYKGTVLFKDNEGGIFFRGNTAYDDLGILAATSQDQSNTETGGGGGAICSPEDTVTFEGNKGSIVFDYNFAKGRGGGILTKKFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVLGGELVVTEGATLTTGTITATSGRVTLGSGASLSAVAGTANNYTCTVSKLGVDLESFLTPNYKTAILGADTTVTVNNNPTLDLVMKNEAEVYDNPLFVGSLTIPFVTLSSVNNTNSNGVVKTAVTINDADAAHYGYQGSWSADWTKPPLAPDAKGMVPPNTSNTLYLTWRPASNYGKYRLDPQRKGELVPNSLWVAGSALRTFTNGLKEYYVSRDVGFVASLHALGDYILNYVQDDRDGFLARYGGFQATAAYHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20415 - protein, 182 aa, Wolbachia pipientis
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVVYSTFG

SEQ ID NO: 20416 - protein, 163 aa, Wolbachia pipientis
SYYVRLQYNGEFLPLFTKVDGITYKKDKSDYSPLKPSFIAGGGAFGYKMDEIRVDVEGVYSYLNKNDVKDVTFEPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 20417 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSL

SEQ ID NO: 20418 - protein, 935 aa, Chlamydia trachomatis
LMPNSVPDPTKESLSNKISLTGDTHNLTNCYLNNLRYILAILQKTPNEGAAVTITDYLSFFDTQKEGIYFAKNLTPESGGAIGYASPNSPTVEIRDTIGPVIFENNTCCRPFIWSNPYAAANKIREGGAIHAQNLYINHNHDVVGFMKNFSYVQGGAISTANTFVVSENQSCFLFMDNICIQTNTGGKGGAIYAGTSNSFESNNCDLFFINNACCAGGAIFSPICSLTGNRGNIVFYNNRCFKNVETASSEASDGGAIKVTTRLDVTGNRGRIFFSDNITKNCGGAIYAPVVTLVDNGPTYFINNIANNKGGAIYIDGTSNSKISADRHAIIFNENIVTNVTSNNGISTNPPRRNAITVTSSSGEIILGAGEGQNLIFYDPIEVNAGVSVFFNKEADQTGSVVFSGATVNSADFHQRNLQTKTPATLTLNHGFLCIEDRAQLAVNRFTQTKGVVALGNGAVLSCYKNNSTNASVTLKHIGLNLPSILKSGAEIPLLWVEPTATTSNRTTTYSADTAAGFSLRDVKLSLIDDYGDSPYESTDLTHAVSSQPILAISEASDNQLQSESMDFSGLNVPHYGWQGLWTWGWAKTQDPEPANSSAITDPQKTNRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALR

SEQ ID NO: 20419 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYVHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRTYYYFLGAYIQDLKRDVESGPVVLLKNAVSWDAPMANLDSRAYMFRLTNQRALHRLQTLLNVSCVLRGQSHSYSL

SEQ ID NO: 20420 - protein, 991 aa, Chlamydia trachomatis
SPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSIVPASTPTPPAPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMESEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20421 - protein, 932 aa, Actinobacillus suis
  misc_feature (900)..(900): Xaa can be any naturally occurring amino acid
MKNKLNLISLALLSLFAVQSYAEQAVQLNDVYVTGTKKKAHKKENEVTGLGKVVKTPDTLSKEQVLGIRDLTRYDPGISVVEQGGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWGLVRDIGYRNGSYNNPYVYELKDRAIYSKNDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTRSWHTFDLTGYITPWKHTTVRAGVYNLMNYRYTTWESVRQXSLNAIHQHTNVKDYARYAAPGRNYVVSFEMKF

SEQ ID NO: 20422 - protein, 937 aa, Chlamydia trachomatis
LMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIATQLLASKGIWFGSGSPSSRHAMSYKISQQTQPLSWLTLHFQYHGFYSSSTFCNYLNGEIALR

SEQ ID NO: 20423 - protein, 991 aa, Chlamydia trachomatis
SPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSIVPASTPTPPAPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMENEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQLARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20424 - protein, 937 aa, Chlamydia trachomatis
LMPNSVPDPTKESLSNKISLTGDTHNLTNCYLDNLRYILAILQRTPNEGAAVTITDYLSFFDTQKEGIYFAKNLTPESGGAIGYASPNSPTVEIRDTIGPVIFENNTCCRPFTWRNPLTAVNKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNEGGAIYIDGTSNSKISADRHAIIFNENIVTNVTNANGTSTSANPPRRNAITVASSSGEILLGAGSSQNLIFYDPIEVNAGVSVFFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWTWGWAKTQDPEPANSSAITDPQKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSLRHAMSYKISQQTQPLSWLTLHFQYHGFYSSSTFCNYLNGEIALR

SEQ ID NO: 20425 - protein, 725 aa, Pseudomonas fluorescens
MRIRQKNIYKSFVILNALSACIPSFVFAQSKEVDAVTELKPIIIKGKKIEDPSGSVTILTNRKTAKDIYEKQISDVHDVSRLNPSVTYNSENNSFLIRGLDANRVLTTMDGIVIPWFDDIVRGRGGNTTFDFNALSTFDVIQGSDSSLYGSGALGGVVALRTLNPEDLIPEEKNWGSLIKGGYHSVDNSWHVDQAIAVRNYQTFFLFQGSHVEGNERKNMGTVEGYEERTRKNPAQFDRNNLLFKIHQYFNNNHRLGFTAERFDYEINTHSLNASTRYSPGSVYDEDNKRRERLSLSYNYSNEDTFLDAFSGQLYWQKQISNHVMSGFRVQAPKGDYLRNNFLRDINYGLNAHAGKKVDFGTVSHALKFSTNVLSSQFHHYLLGKDNCHFKENAQGCAFLPANRSDSPDTNSYSFGFAFENEIGFADNRFRVTPGVRYDWYKHTPQKTPSYEKALISNKYPSERSGSRFSPKLRMEWDFRDQVTFYAQWAQAFRAPRVSELYLSYIKPPLYYVKGNPDLKSEGSNGYDIGIQYGNVNFGGSLSAFINQYKDFITTVDKGPSEEFRFARRYYVNLSRVRIFGVETKAHLTLNKGFHSNFALAYSQGKDLEKDEYLNSIPALKAIIGLGYAKETWGADVVLTSSAKRDKVAKESDYQKIPGYKVVDVSGWWKPFGEKGFVVRAGIYNLFNEKYWNVSDLPSGKKSTIPKDYYSQPGRNFKVSFVQKF

SEQ ID NO: 20426 - protein, 656 aa, Escherichia coli
MYMNVIRNVICTLIILPIGLQAETSHSSMAKDTITVVATGNQNTVFETPSMVSVVTNDTPWSQNAVTSAGMLKGVAGLSQTGAGRTNGQTFNLRGYDKSGVLVLVDGIRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNPTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTGNDRLQLKGGYFGTDARNYIATRVDMKRMRSYSYNVSRARIWGWDMQGNYQSDYFDWMLSYNRTESMDASSREWLGSGNPDTLISDISIPVGHGGVSAGWRAELSAAATHVKKGDPHQAGYAVHSFSLSYKPVSVKGFEASVTLDNAFNKLAMNGKGVPLSGRTVSLYTRYQW

SEQ ID NO: 20427 - protein, 1074 aa, Vibrio anguillarum
MTHPRYLRMSKLTLGLVAALAAAPVFAQSTSAGVAGLVTGSGGQPVPNAEVTITHVESGTVSRATTDASGRYNARGLRVGGPYTITITASGAGNTTREGVYLNLDKVNQVDAALGGDLATLGTVQAIAGNYGSAIFSANKMGTGTNVTREEIESLPSINRNLQDYVRLDPRVAQTDKARNEISIAGQNPRYNAIRVDGISTNDAFGLESNSLPTPRQPFSMDVIDEISVDVANYDVTISGGTGGVINAVTKSGTNEFHGSVYGTYRENDWSGKNQNNIRPQLFDNEATYGLTLGGPIVKDKLFFFANYEKYKGKGVFTGNSGYGPTGSGASNEVGITQAQVDQVIDISRNVYGFDPGTLALPALDSDSEEKGFKLDWNISDKHRGSFRYGKSEQSTANLNGFGNNQLALNSYHYVRDFELETYTGQLFSDWTDTFSTEAKVSYRDYSAVRTAASQLPAIAVRFGNNTLNLGTEANTQANELRTETWNAFFAGTLFLNDHTVKFGFDYEDNDIYNLYGPRVFGSYTFNSVANYQANLPNAYRYSYSPTGIDNIAAKWGMRNVGVFLQDSWAVNSNLTMNFGLRYDEPMVKNSPQFNQAAFNAFGLRNDETIDGNGLWQPRFGFNYTFDADRPTQLRGGVGLFQGAAASVWLSNPYSNTGLAYTDYNFNNASNSGIRFTPDINNQPRGTSGATQSVDFVDKDLGQPAVWKANLAFDTELPWYGIVASMEGVVTKVKEAIYYQQLNLGNPTAVGQDGRDIYWNANGRNPANWNSLGNACLRETGVAAGSSCVNSGTDIRAGRNTSFNDAIIARSTDQGGSQSFTVGLNKPFNDSDWSWSLAYTYSNAKEVSGLTSSTSSSQLLNTATFQANEEVNATSAYEIKDSFLGTLQWKHNFFGDFATKVGLVYQGRSGRPYSYTFDNDANGDGRSNDLLYIPAARGDVLFRNAAEENAFWNYVNNDQYLSTHKGQVAGRNAVRNSWVNQFDLHIEQELPGFFDGNKAQIWVDVMNVGNLLNKKWGRVDEYAFPGFKGVAEYGGIDAATGKYVYRFNEPDAATIYDDKGISRWALQLGFRYQF

SEQ ID NO: 20428 - protein, 721 aa, Aggregatibacter actinomycetemcomitans
MKILLHYWPMLLSGTALAASDPARVDETGILPHLKARETIVVKGQRVEQKLSDISGAITVITEEDLDRQVATELTDVFKNEPGVSVTGSAGRPQNISIRGIGGNRVLIIKDGVRVSDGFGADDLNDKVGRFSFDLDDVKQIEVAKGAGSALHGSDAIGGTIVISTKQPEDYLQGQDAYLSSKVLHDGSSNKQKLSATGAARWAETEHLLRVSGWQGHETANYDESRIPADLDGLSASTSSRFTLNEHHLLRLELDYFEDNAKRDQGPREMPQPDGKWQVRQYREDSTQRSQGAKLSWEARSLDHLLADQFTLSLHGNHAKNSANKRSLLQNDLLSGYPRYRSERELATFTEDLLGGELDIRRDLTTGAIEHKLSYGIELERASHERPVDKLTLEAGIPQPGQSAPFSNARTDRAGIWLGDVASLGQWQFTPTLRMDHQWLSPQDGKGASNHSWHLSPSLATSYRFNDQWRSWLSYANGFSAPSYDKVYGNIPHYFALPPFEIIANPDLKEETSHSFEWGVSGEGDEWSIKPALFYNRYYNFVDWRQVGFRMSDGVMLRQYRNVAKSETWGAEIAASYWLTQQWELATKFGWVDGKDSQGESPRNLTPLEGNTRLSYQANDWSLGLQADYAAAMSRVPTCGNSLTQQQSECMKSAGWLSFALTADWQITDALKANLKLDNLLDTRYTRYQDVAGQEAGSDAGLYTQTGRYLSASLRYTFVGI

SEQ ID NO: 20429 - protein, 423 aa, Haemophilus somnus
MSTKMKKQLISGLALTCALGSFSTFATNGYFTHGYGMTHKGMAGAGVALSEELMSGANNPATFLPNGTQLSLGLELFSPERKYTASKVDTFYPGAFYLAAKTQKSDNTVFAIPEFAIGHQLNEKINIGLLVYGNGGMNTEYSAESAPEGTFYAGTAGVDLKQLFISPTLSYKLNEQTRLGVSPIYVVQQFEAQGLENFAPFSQSPEALTNNGTDTSTGFGVQLGISHAINSSLSLGASYRSAVSMEEFDSYKGLFAEQGGFDLPSSFQLGAAYKLTPSNQVVFDWQKINYSEVKSIANPINNLMSAPLGANAGAGFGWNDMTIYKLGYQWQRTPQQKIRFGVSYTEQPIPSSQVILNILAPGVQEWHFTTGFSHSFTNKVQLNAMAFYSPAKKVTGTNYLAPNQQVSIEMKQTGLGVSIVWEI

SEQ ID NO: 20430 - protein, 609 aa, Pasteurella multocida
MLTLTATKFFKMLNTQINLHLTKNLSLDMSKLNIKYLILTIAILASSGLIAQEDDKETIGSETVVVVKPYTPSVSDAFKVKQTPQLLDSITLQKKSITYKIFSIPVASTFTPTKGTAARVEKARPIQAFDSYATLGVGNYTSAFAEFYTNFEINRGENFGINFKHNSAQGGIDDVLLDDNYYDTNLGLDYSFRDRDLSYTIGLDALHKQYNWYGFSNNIIVTNDNLNRTDVVQNYFGAGLRANLSLNDSFLDQTRFGLSVFGDSYGSSEINATLKPEMEFEIAGEKIQTNVSVDYLNTSFDQNYEGTTDLASSYLNLGLSPSILILRDDLELNLGASVFYSLDSESSESNIFVYPNINASYRLAGEYFIAYAGLNGELKQNSYKAFVDNNPFVSPTLAITPTDQQYVGSLGAKGKLSDVISYNIKGSYANVEAQPLFKSNTNTFPLGGLLEDYEYGNSFGVVYDNIKTVSFFGELNFDITKVLRLGLNAEYFSYNTDTQEEAWNLPELKASLLADYKITDKFTAGANLFFVGERQAQASDFDMSGNLTTENITLDSYIDANVQLNYLINDQLSFFVKGNNLFADSYEKWLNFPVYGIQGMAGATYKFDW

SEQ ID NO: 20431 - protein, 170 aa, Enterobacter aerogenes
MNKIARLSALAVVLAASVGTTAFAATSTVTGGYAQSDMQGKANKAGGFNLKYRYEQDNNPLGVIGSFTYTEKDNNSNGTYNKGQYYGITAGPAYRLNDWASIYGVVGVGYGKFQNNNYPHKSDMSDYGFSYGAGLQFNPIENVALDFSYEQSRIRNVDVGTWIAGVGYRF

SEQ ID NO: 20432 - protein, 1061 aa, Acinetobacter baumannii
MVITSLDLIHIVTIIIKQKTISMLKIARPVSFLLLSAALCSSGTVFAANETATPKVGISQQQKSLKGTVNDVLGPVAGASVVVKGTTNGTVTDMDGNFVLEVNNGDVLQISFIGYVTQEIKYTGQATLTVNLMEDTQKLEEVVVVGYGTQKKVNMTGAVAQIDSKALENRPVQNVSTALQGTMPGVQVTSGGGRPGQDGGTIRVRGVGTLNTADPYILVDGIETGTMNSVDPNDIESISVLKDAASAAIYGSKASNGVILITTKRGKTGKPRISYNGYVGFQKPTEMIDRISSYDYARLYSQSMIDEGLNPRFNETDIENFRNGTSPNTDWYDEAYRTGVQHSHNVSVSGGTENAKYMGSVGYLGQTGILPNADRQQFNARTNLDLKLNSRLTVRLNLAYIKNDYSDPISSYASGISETGDPNSAASSDQIIRQLNRIAPWIVGRAEDGTYGTIGDGNPLAWLDVNQTVDRKNQNFSGTLSADYKIIDGLVATVTGSYVNNQQHYRAFQKYIQYNPNKETEPNRLEERFTGWHRANFDALLNFDRQFGEHGLKAMAGWHTEKYDYTYNQQFRKNFPTNDLTDIAAGDAATQKNNGYTRELAMISWFGRINYDYAGKYLLEGNIRSDASSRFADGNRWGYFPSFSAAWRISEEGFMENTKDWLNNLKIRGSWGLLGNQDALTDYYPWMNTYNLDASYPLGGALQSGYYQKAYKLSSISWEKSRTWGLGFDATVNNKINVTFDYYDRRTTGIIMDVPVPAEFGLDAYKDNVGEMSNRGVEVILSYNNKWGDWSFGATGNFSYNKNELLDLGLSPDAGGVTADPNNGNKVRKIGEALNTYRVYKADGFFESDEAAQAWMDKYSTQAGYPFGTKKFKGGDLIYQDANGDGKMTADDRVLAGSSDPKFTFGLNLNAAYKGFDLSMLFTGAAGVHRLINQEVTGYFGGDDSHPATVWLDAWTPENKDATMPRVAYDVTSPSLSSNVVSTFWLQNSSYLRMKNLQFGYTLPKNVIKSVGIENVRFYYSVENLFTIHNMLVNVDPEIGDERGSSFPLTQTHAFGVNVTF

SEQ ID NO: 20433 - protein, 1616 aa, Rickettsia hulinensis
MGAAIQQNRTTNGVATTVDGAGFDQTAVPANVAVALNAVITANAHKGINLNTPAGSFNGLFLDTANNLAVTVSEDTTLGFITNVVNNANFFNLTLNAGKTLTITGQGITNAQAAATKNAQNVVVQCNNGAAIGNNDLKGVGSIDFGAAASTLVFNLANPTTQKAPLILGDNALIVNGANGTLNVTNGFIQVSSKSFATVNAINIGDGQGIMFNTDANNANALNLQAGGTTINFNGTDGTGRLVLLSKNAAATDFNVTGSLGGNLKGIIEFNTVAVDGQLKANAGPANAVIGTNNGAGRAAGFVVSVDNGKVATIDGQVYAKDMVIQSANAAGQVNFRHIVDVGTDGTTAFKTAASKVAITQNSNFGNTDFGNLAAQITVPNTMTLTGNFTGDASNPGNTAGVITFDANGTLASASADANVAVTNNITAIEASGAGVVQLSGTHAAELRLGNAGSIFKLADGTVINGKVNQTALVAGVLAAGAITLDGSATITGDIGNAGGAAALQGITLANDATKTLTLGGANIIGANGGTIDFQANGGTIKLTSTQNNIVVDFDLAITTDQTGVVDASSLTNAQTLTINGKIGTIGANNKTLGQFNIGSSKTALSNGNVAINELVIGNNGAVQFAHNTYLITRTTNAAGQGKIIFNPVVNNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIAANSTLQIGGNYTADFVASADGTGIVEFVNTGPITVTLNKQAAPVNALKQITVSGPGNVVINEIGNAGNYHGAVTDTIAFENSSVGAVVFLPRGIPFNDAGNIIPLTIKSTVGNKTATGFDVPSVIVLGVDSVIADGQVIGDQNNIVGLGLGSDNDIIVNATTLYAGIGTINNNQGTVTLSGGIPNTPGTVYGLGTGISPSKFKQVTFTTDYNNLGNIIATNATINDGVTVTTGGIAGTSFNGKITLGSVNGNGNVRFADGILSNSTSMIGTTKANNGTVTYLGNALVGNIGDSDTPVASVRFTGSDGNARLQGNIYSQVIDFGTYNLDILNSNVILGGGTTAINGKINLLTNTLTFASGTSTWGNNTSIETTLTLANGNIGHIVILEGAQVNATTTGTTTIKVQDNANANFSGTQTYTLIQGGARFNGTLGGPNFAVTGNNRFVNYGLIRAANQDYVITRTNNAENVVTNDIANSPFGGAPGVGQNVTTFVNATNTAAYNNLLLAKNSANSANFVGAIVTDTSAAITNAQLEVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 20434 - protein, 1618 aa, Rickettsia heilongjiangensis
MGAAIQQNRTTNGVATTVDGVGFDQTVALANVAVAPNAVITANANNGINLNTPAGSFNGLFLSNANNLAVTVSEDTTLGFINNAANNANRFNLTLDAGKTLTITGQGITNVQSAATHNAQNIVAKFNGGAAIANNDLSGLGTIDFGAAASTLVFDLANPTTQKAPLILADNALIVNGANGTLNVTNGFIQVSDKSFATVKAINIGDGQGFMFNTNATNANALNLQAGGTTINFNGTDGTGRLVLLSKNGAATDFNVTGSLGGNLKGIIELNTVAINGQLIANAGPANAVIGTNNGAGRAAGFVVSVDNGKAATIDGQVYAKDMVIQSANANGQVNFRHIVDVGIDGTTAFKTAASIVAITQNSNFGTTDFGNLAAQVTVPDTMTLTGNFTGDANNPGNTAGVITFAANGTLASASADANVAVTNNITAIEASGVGVVQLSGTHTAELRLGNAGSVFKLADGTVINGKVNQTVLVGGVLAAGAITLDGSATITGDIGNGGGGAALQSITLANDATKTLTLGGANIISANGGTINFQANGGTIKLTSTQNNIVVDCDLAIATDQTGVVDASSLTNAQTLTISGTIGIIGANNTTLGQFNIGSSKTTLNGGNVAINELVIGNNGSVQFAHNTYLITRTTNAAGQGKIIFNPVVNNNTTLAAGTNLGSAANPLAEINFGSKGARADTVLNVGEGVNLYATNITTTDANVGSFVFNAGGKNIVSGTVGGQQGNKFNTVALDNGTTVKFLGNATFNGNTTIAANSTLQISGNYTADFIASADGTGIVEFVNTGPINVTLNKQAVPVNALKQITVSGPGNVVVNEIGNAGNYHGAMTDTIAFENSSLGAVLFLPSGIPFNDAGNTIPLTIKSTVGNETAEGFSVPSVIVSGVDSVIADGQVIGDQNNIVGLGLGSDNGIIVNATTLYAGIGTINNNQGTVTLSGGVPNTPGTVYGLGTGIGASKFKQVTFTTDYNNLGNIIATNTTINDGVTVTTGGIAAGGIAGTDFDGKITLGSVNGNANVRFADGIFSNSTSMIVTTKANNGTVTYLGNAFVGNIGDSDTPVASVRFTGSNNGAGLKGNIYSQVIDFGTYNLGIVNSNVILGGSTTAINGKIDLLTNTLTFAGGTSTWGNNTSIETTLTLANGNIGHIVIAEGAQVNATTTGTTTINVQDNANANFSGTQTYTLIQGGARFNGTLGGPNFTVTGSNRFVNYGLIRAANQDYVITRTNNAENIVTNDITNSPFGGAPGVGQNVTTFVNATNTAAYNNLLLAKNSADSANFVGTIVTDTSAAITNAQLDVAKDIQAQLGNRLGALRYLGTPEMVGSEAGAIPAAVAAGDEAVDNVAYGIWAKPFYTDAHQSKKGGLAGYKAKTTGIVIGLDTLANNNLMIGAAIGITKTDIKHQDYKKGDKTDVNGFSFSLYGAQQFVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDFAVYPEVHAFVVHKVTGRLSKTQSVLDGQVTPCISQPDRTAKTSYNLGLSASIRSDAKMEYGIGYDAQISSKYTAHQGTL

SEQ ID NO: 20435 - protein, 668 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVTNNSRLTLARQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSKFSIPTTEKKNGQDVAKPADQQAKDRKDEALVHSYRLTNPTKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20436 - protein, 670 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFEISDKKKGADGKEVDVDDAQKEKNRANEKIVHAYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAVGSILVAGQKDRNGKLENVVRKGFGVNDVFANWKPLGKDTLNVNLSVNNVFNTFYYPHS

SEQ ID NO: 20437 - protein, 663 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYSRNDEKDYEAGKGFRNNFNGGKTVPYSALDKRSYLAKIGTSFGDGDHRIVLSHMKDQHRGIRTVREEFTVGGDKERISMKRQAPSYRETTQSNTNLAYTGKDLGFVEKLDANAYVLEKKRYSADDSGSGYAGNVKGPNHTQITTRGANFNFDSRLAEQTLLKYGINYRHQEIKPQAFLNSQFKIEDKEKATDEEKNKNRENEKIAKAYRLTNPTKTDAGAYIEAIHEIDGFTLTGGLRYDRFKVKTHDGKTVSSSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAVGSILVAGQKDRSGKLENVVRQGFGVNDVFANWKPLGKDTLNVNLSVNNVFNTFYYPHS

SEQ ID NO: 20438 - protein, 662 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFKIEDKTGATPAEIQKNRADEATAHDYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKATGSILAAGQKNRDKQLENVVRKGFGVNDVFANWKPLGKDTLNVNLSVNNVFNTFYYPHS

SEQ ID NO: 20439 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNDEKDYEAGKGFRNVNGGKTVPYSALDKRSYLAKIGTTFGGDDHRIVLSHMKDQHRGIRTVREEFAVGDTKSRINITRQAPAYRETTQSNTNLAYTGKDLGFVEKLDANAYVLEKKRYSADDKDNGYAGNVKGPNHTQITTRGMNFNFDSRLAEQTLLKYGINYRHQEIKPQAFLNGEFSIPTKEKKNGKEVDKPMEQQKKDRADEATVHAYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQTGRTWTASLAYRFQNPNLEIGWRGRYVQKAVGSILVSGQKDRQGKLENVVRQGFGVNDIFANWKPLGKDTLNVNLSVNNVFNTFYYPHS

SEQ ID NO: 20440 - protein, 672 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRINIDRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNGEFEISGKKKDPKDPKKEIDKTAEEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20441 - protein, 662 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDTSSRINIKRQAPAYRETTQSNTNLAYTGKDLGFVEKLDANAYVLEKERYSADDSGTGYAGNVKGPNHTQITTRGMNFNFDSRLAEQTLLKYGINYRHQEIKPQAFLNSQFKIEDKEKATDEEKNKNRENEKIAKAYRLTNPTKTDTGAYIEAIHEIDGFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRQGNLENVVRQGFGVNDVFANWKPLGKDTLNVNLSVNNVFNTFYYPHS

SEQ ID NO: 20442 - protein, 671 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDGDHRIVLSHMKDQHRGIRTVREEFTVGSEDSRINIKRQAPAYRETTQSNTNLEYTGKNLGFVEKLDANAYVLEKKRYSADDKGSGYAGNVEGPNHTRITTRGMNFNFDSRLAEQTLLKYGINYRHQEIKPQAFLNSQFSIPKTEKKDGKDVDKSLEQQEKDKKDMALVHSYKLSNPAKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKAGVSYSKPRFYGYDTHKDKLLSANPEFGAQVGRTWTASLAYRFQNPNLEIGWRGRYVQKAVGSILVSGQKDRQGNLENVVRKGFGVNDVFANWKPLGKDTLNVNLSVNNVFNKYYYPHS

SEQ ID NO: 20443 - protein, 660 aa, Neisseria meningitidis
VLDTVTVKGDRQGSKIRTNIVTLQQKDESTATDMRELLKEEPSIDFGGGNGTSQHMTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGYKSPNGSKTVPYSALDKRSYLAKIGTSFGDGDHRIVLSHMKDQHRGIRTVREEFTIYDPDPTKDRQKPSYRETTQSNTNLAYTGKNLGFVEKLDANAYVLEKKRYSADDSGSGYAGNVVGPNHTRITTRGMNFNFDSRLAEQTLLKYGINYRHQEIKPQAFLNSQFSIKDKDGATEEDKRKNRANEDIAKAYRLTNPTKTDAGVYVEAIHDIGDFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHPKKLLSANPEFGAQVGRTWTASLAYRFQNPNLEIGWRGRYVQKAVGSILAAGQKDRQGNLENVVRKGFGVNDVFANWKPLGKDTLNVNLSVNNVFNKYYYPHS

SEQ ID NO: 20444 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRINIDRQAPAYRETTQSNTNLAYTGKNLGFVEKLDANAYVLEKERYSADDSGTGYAGNVKGPNHTQITTRGMNFNFDSRLAEQTLLKYGINYRHQEIKPQAFLNSKFSIPTTEKKNGQDVAKPADQQAKDRKDEALVHSYRLTNPTKTDTGAYIEAIHEINGFTLTGGLRYDRFKVKTHDGKTVSSSNLNPSFGVIWQPHEYWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20445 - protein, 672 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRINIDRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNGEFEISGKKKDPKDPKKEIDKTAEEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20446 - protein, 673 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNNFNGGKTVPYSALDKRSYLAKIGTTFGDGDHRIVLSHMKDQHRGIRTVREEFTVGGDKERISMKRQAPSYRETTQSNTNLAYTGKDLGFVEKLDANAYVLEKERYSADDSGTGYAGNVKGPNHTQITTRGMNFNFDSRLAEQTLLKYGINYRHQEIKPQAFLNGEFKISDKKPNPANPKEEIDKDTAEKEKDKKDMALVHSYKLSNPAKTDTGAYIEAIHDIGDFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAEGSILVSGQKDRQGKLENVVRKGFGVNDIFANWKPLGKDTLNVNLSVNNVFNTFYYPHS

SEQ ID NO: 20447 - protein, 672 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRINIDRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNGEFEISGKKKDPKDPKKEIDKTAEEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20448 - protein, 672 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFKISDKKPDPNNPGKEIAKTDEEKAKDKIDMALVHSYKLSNPAKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVSGQKDRQGKLENVVRQGFGVNDVFANWKPLGKDTLNVNLSVNNVFNTFYYPHS

SEQ ID NO: 20449 - protein, 672 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKEYEAGKGFRNFNGGKTVPYSALDKRSYLAKIGTTFGDGDHRIVLSHMKDQHRGIRTVREEFTVGDASSRTNITRQAPSYRETTQSNTNLAYTGKDLGFVEKLDANAYVLEKKRYSADDKDNGYAGNVVGPNHTRITTRGMNFNFDSRLAEQTLLKYGINYRHQEIKPQAFLNGEFEISGKKKDPKDPKKEIDKTDEEKAKDKKDMDLVHSYKLSNPTKTDTGAYIEAIHEIDGFTLTGGLRYDRFKVKTHDGKTVSSSNLNPSFGVIWQPHEHWSFSSSHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20450 - protein, 672 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKEYEAGKGFRNFNGGKTVPYSALDKRSYLAKIGTTFGDGDHRIVLSHMKDQHRGIRTVREEFTVGDASSRTNITRQAPSYRETTQSNTNLAYTGKDLGFVEKLDANAYVLEKKRYSADDKDNGYAGNVVGPNHTRITTRGMNFNFDSRLAEQTLLKYGINYRHQEIKPQAFLNGEFEISGKKKDPKDPKKEIDKTDEEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20451 - protein, 670 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFEISDKKKGADGKEVDVDDAQKEKNRANEKIVHAYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20452 - protein, 669 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDDDHRIVLSHMKDQHRGIRTVREEFTVGDKSSRINIDRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFSIPTTEEKNGQKVDKPMEQQMKDRADEDTVHAYKLSNPTKTDTGVYVEAIHDIGDFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKATGSILAAGQKDRKGNLENVVRKGFGVNDVFANWKPLGKDTLNVNLSVNNVFNKFYYPHS

SEQ ID NO: 20453 - protein, 671 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFEISDKKKGADGKEVDVDDAQKEKNRANEKIVHAYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNNGTFAANGSYFWQTIKDALANPQNRHESTTAVREAVNAGYIKNHGYELGASYRTGGLTAKVGVSHSKPRFYDTHKDKLLSANPEFGAQVGRTWTASLAYRFKNPNLEIGWRGRYVQKATGSILAAGQKDRKGNLENVVRQGFGVNDVFANWKPLGKDTLNVNLSVNNVFNTFYYPHS

SEQ ID NO: 20454 - protein, 663 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVGGDDSRINIKRQAPAYRETTQSNTNLAYTGKDLGFVEKLDANAYVLEKKRYSADDKDSGYAGNVEGPNHTRITTRGMNFNFDSRLAEQTLLKYGINYRHQEIKPQAFLNGEFAIKDEASATLAEKQKNRDNEKIVHDYKLSNPAKTDTGAYIEAIHDIGDFTLTGGLRYDRFKVKTHDGKTVSSSNLNPSFGVIWQPHEYWSFSASHNYASRSPRLYDALQTHGKRGIISIADGTKAERARNTEIGFNYNDGTFAANGSYFWQTIKDALANPQNRHESTAAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20455 - protein, 672 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRININRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNGEFEISGKKKDPKDPKKEIDKTAEEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20456 - protein, 670 aa, Neisseria meningitidis
ALDTVTVKGDRQGSKIRTNIVTLQQKDESTATDMRELLKEEPSIDFGGGNGTSQHMTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKAGNFDGLFSYSRNDEKDYEAGKGYKSPNGGKTVLYSALDKRSYLAKIGTTFGDGDHRIVLSHMKDQHRGIRTVREEFTIFGTDPIKDRQKPSYRETTQSNTNLEYTGKNLGFVEKLNANAYVLENKRYSADDSGSGYAGNVVGPNHTQITTRGMNFNFDSRLAEQTLLKYGINYRHQEIKPQAFLNGKFKISDKKPDPSNPGKEIDKDPTEKAKDQKDMDLVHSYKLSNPTKTDTGAYIEAIHEINGFTLTGGLRYDRFKVKTHDGKTVSSSSLNPSFGVIWQPHEYWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHPKKLLSANPEFGAQVGRTWTASLAYRFKNPNLEIGWRGRYVQKAVGSILAAGQKDRQGNLENVVRKGFGVNDVFANWKPLGKDTLNVNLSVNNVFNKFYYPHS

SEQ ID NO: 20457 - protein, 674 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDDDHRIVLSHMKDQHRGIRTVREEFTVGDKSSRINIDRQAPAYRETTQSNTNLEYTGKNLGFVEKLDANAYVLEKKRYSADDKGSGYAGNVEGPNHTRITTRGMNFNFDSRLAEQTLLKYGINYRHQEIKPQAFLNGDFTISSKKKDPNNPKNEIDKDPTEIAKDKEDMALVHSYKLSNPTKTDAGVYVEAIHDIGDFTLTGGLRYDRFKVKTHDGKTVSSSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSYSKPRFYGYDTHKDKLLSANPEFGAQVGRTWTASLAYRFQNPNLEIGWRGRYVQKAVGSILVSGQKDRQGNLENVVRKGFGVNDVFANWKPLGKDTLNVNLSVNNVFNKYYYPHS

SEQ ID NO: 20458 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFSIPKTEKKDGKDVAKSSEQQTKDRKDETIVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20459 - protein, 669 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGMNFNFDSRLAEQTLLKYGINYRHQEIKPQAFLNGEFSIPTKEKKNGKEVDKPMEQQKKDRADEATVHAYKLSNPTKTDTGAYIEAIHEINGFTLTGGLRYDRFKVKTHDGKTVSNSSLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQTGRTWTASLAYRFQNPNLEIGWRGRYVQKAVGSILVSGQKDRQGKLENVVRQGFGVNDIFANWKPLGKDTLNVNLSVNNVFNTFYYPHS

SEQ ID NO: 20460 - protein, 661 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVTNNSRLTLARQAPAYRETTQSNTNLAYTGKDLGFVEKLDANAYVLEKKRYSADDKDNGYAGNVKGPNHTQITTRGMNFNFDSRLAEQTLLKYGINYRHQEIKPQAFLNGEFAIKDEASATPTEKQKNRDNEKIVHAYKLTNPTKTDTGAYIEAIHEIDGFTLTGGLRYDRFKVKTHDGKTVSSSSLNPSFGVIWQPHEYWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHPKKLLSANPEFGAQTGRTWTASLAYRFQNPNLEIGWRGRYVQKAVGSILVAGQKDRQGNLENVVRKGFGVNDVFANWKPLGKDTLNVNLSVNNVFNTFYYPHS

SEQ ID NO: 20461 - protein, 671 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFEISDKKKGADGKEVDVDDAQKEKNRANEKIVHAYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNNGTFAANGSYFWQTIKDALANPQNRHESTTAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20462 - protein, 663 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGFASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFKIEDKKDATDEEKKKNRDNENIAKAYRLTNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNNGTFAANGSYFWQTIKDALANPQNRHESTTAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20463 - protein, 662 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFKIEDKTGATPAEIQKNRADEATAHDYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKATGSILAAGQKNRDKQLENVVRKGFGVNDVFANWKPLGKDTLNVNLSVNNVFNTFYYPHS

SEQ ID NO: 20464 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFSIPKTEKKDGKDVAKSSEQQTKDRKDETIVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHPKKLLSANPEFGAQVGRTWTASLAYRFQNPNLEIGWRGRYVQKATGSILAAGQKNRDKQLENVVRKGFGVNDVFANWKPLGKDTLNVNLSVNNVFNTFYYPHS

SEQ ID NO: 20465 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFSIPKTEKKDGKDVAKSSEQQTKDRKDETIVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRSGKLENVVRQGFGVNDVFANWKPLGKDTLNVNLSVNNVFNTFYYPHS

SEQ ID NO: 20466 - protein, 661 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVTNNSRLTLARQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSQFKIEDKKDATDEEKKKNRDNENIAKAYRLTNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRQGFGVNDVFANWKPLGKDTLNVNLSVNNVFNTFYYPHS

SEQ ID NO: 20467 - protein, 659 aa, Neisseria meningitidis
VLDTITVKGDRQGSKIRTNIVTLQQKDESTATDMRELLKEEPSIDFGGGNGTSQHMTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGYTNQYGANKVLKSGLDKRSYLAKIGTTFGDGDHRIVLSHMQDQHRGERFIREEFGWQTFTRPDNTLAKNTPSYRETTQSNTNLEYTGKNLGFVEKLNANAYVLEKKRYSADDKDSGYAGNVEGPNHTRITTRGMNFNFDSRLAEQTLLKYGINYRHQEIKPQAFLNGEFKSKEKEQATKEKDEKKVHSYSLTNPTKTDTGAYIEAIHEINGFTLTGGLRYDRFKVKTHDGKTVSSSNLNPSFGVIWQPHEYWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYGYDTHKDKLLSANPEFGAQVGRTWTASLAYRFKKPNLEIGWRGRYVQKATGSILAAGQKDRQGNLENVVRKGFGVNDVFANWKPLGKDTLNVNLSVNNVFNKYYYPHS

SEQ ID NO: 20468 - protein, 673 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNDEKDYEAGKGFRNNFNGGKTVPYSALDKRSYLAKIGTTFGDGDHRIVLSHMKDQHRGIRTVREEFTVGGDKERISMKRQAPSYRETTQSNTNLAYTGKDLGFVEKLDANVYVLEKKRYSADDSGTGYAGNVKGPNHTRITTRGMNFNFDSRLAEQTLLKYGINYRHQEIKPQAFLNSKFKISDKKPDPNNPGKEIAKTDEEKAKDKIDMALVHSYKLSNPAKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAVGSILVSGQKDRQGKLENVVRQGFGVNDVFANWKPLGKDTLNVNLSVNNVFNTFYYPHS

SEQ ID NO: 20469 - protein, 662 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGGDDSRINIKRQAPAYRETTQSNTNLAYTGKNLGFVEKLDANAYVLEKERYSADDSGTGYAGNVKGPNHTQITTRGMNFNFDSRLAEQTLLKYGINYRHQEIKPQAFLNSQFKIEDKEKATDEEKNKNRENEKIAKAYRLTNPTKTDTGAYIEAIHEIDGFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAEGSILVSGQKDRQGKLENVVRKGFGVNDIFANWKPLGKDTLNVNLSVNNVFNTFYYPHS

SEQ ID NO: 20470 - protein, 663 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNNEKDYEAGKGFRNNFNSGKTVPYSALDKRSYLAKIGTSFGDGDHRIVLSHMKDQHRGIRTVREEFTVGDKSSRINIGRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNSQFKIEDKEKATDEEKNKNRENEKIAKAYRLTNPTKTDAGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDIFANWKPLGKDTLNVNLSVNNVFNTFYYPHS

SEQ ID NO: 20471 - protein, 672 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNDEKDYEAGKGFRNVNGGKTVPYSALDKRSYLAKIGTTFGGDDHRIVLSHMKDQHRGIRTVREEFAVGDTKSRINITRQAPAYRETTQSNTNLAYTGKDLGFVEKLDANAYVLEKKRYSADDKDNGYAGNVKGPNHTQITTRGMNFNFDSRLAEQTLLKYGINYRHQEIKPQAFLNGKFKISDKKPDPNDPTKEIDKDAAEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQTGRTWTASLAYRFQNPNLEIGWRGRYVQKAVGSILVSGQKDRQGKLENVVRQGFGVNDIFANWKPLGKDTLNVNLSVNNVFNTFYYPHS

SEQ ID NO: 20472 - protein, 663 aa, Neisseria meningitidis
VLDTVTVKGDRQGSKIRTNIVTLQQKDESTATDMRELLKEEPSIDFGGGNGTSQHMTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNNFNGDKTVPYSALDKRSYLAKIGTTFGDGDHRIVLSHMKDQHRGIRTVREEFTVGDEDSRINIGRQAPAYRETTQSNTNLAYTGKDLGFVEKLDANVYVLEKKRYSADDSGTGYAGNVKGPNHTRITTRGANFNFDSRLAEQTLLKYGINYRHQEIKPQAFLNEKFEIKNKDNATEEEKKKNSDNEKIVHSYRLTNPTKTDAGVYVEAIHDIGDFTLTGGLRYDRFKVKTHDGKTVSSSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKATGSILAAGQKNRDKQLENVVRKGFGVNDVFANWKPLGKDTLNVNLSVNNVFNTFYYPHS

SEQ ID NO: 20473 - protein, 662 aa, Neisseria meningitidis
ALDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGGDDHRIVLSHMKDQHRGIRTVREEFTVGSEDSRINIKRQAPAYRETTQSNTNLAYTGKNLGFVEKLDANAYVLEKERYSADDSGTGYAGNVKGPNHTQITTRGMNFNFDSRLAEQTLLKYGINYRHQEIKPQAFLNSQFKIEDKKDATDEEKKKNRDNENIAKAYRLTNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20474 - protein, 662 aa, Neisseria meningitidis
ALDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGGDDSRINIKRQAPSYRETTQSNTNLAYTGKNLGFVEKLDANAYVLEKERYSADDSGTGYAGNVKGPNHTQITTRGMNFNFDSRLAEQTLLKYGINYRHQEIKPQAFLNSQFKIEDKEKATDEEKNKNRENEKIAKAYRLTNPTKTDTGAYIEAIHEIDGFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20475 - protein, 663 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGFASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFKIEDKKDATDEEKKKNRDNENIAKAYRLTNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHESTSAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20476 - protein, 668 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVTNNSRLTLARQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSKFSIPTTEKKNGQDVAKPADQQAKDRKDEALVHSYRLTNPTKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20477 - protein, 663 aa, Neisseria meningitidis
ALDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNNEKDYEAGKGFRNNFNGGKTVPYSALDKRSYLAKIGTTFGDGDHRIVLSHMKDQHRGIRTVREEFTVGGDKERISMKRQAPSYRETTQSNTNLAYTGKNLGFVEKLDANAYVLEKKRYSADDKDNGYAGNVKGPNHTRITTRGMNFNFDSRLAEQTLLKYGINYRHQEIKPQAFLNGEFEIKDKEKATKEEKQKNRDNEKIAKAYRLTNPTKTDAGVYVEAIHDIGDFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAVGSILVSGQKNRDKQLENVVRKGFGVNDVFANWKPLGKDTLNVNLSVNNVFNTFYYPHS

SEQ ID NO: 20478 - protein, 661 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVTNNSRLTLARQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSQFKIEDKKDATDEEKKKNRDNENIAKAYRLTNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20479 - protein, 668 aa, Neisseria meningitidis
ALDTVTVKGDRQGSKIRTNIVTLQQKDESTATDMRELLKEEPSIDFGGGNGTSQHMTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGGDDHRIVLSHMKDQHRGIRTVREEFTVTNNSRLTLARQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSKFSIPTTEKKNGQDVAKPADQQAKDRKDEALVHSYRLTNPTKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRQGFGVNDVFANWKPLGKDTLNVNLSVNNVFNTFYYPHS

SEQ ID NO: 20480 - protein, 663 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNNEKDYEAGKGFRNNFNGGKTVPYSALDKRSYLAKIGTTFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSQFKIEDKEKATDEEKNKNRENEKIAKAYRLTNPTKTDAGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDIFANWKPLGKDTLNVNLSVNNVFNTFYYPHS

SEQ ID NO: 20481 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGGDDHRIVLSHMKDQHRGIRTVREEFAVGDTKSRINIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSKFSIPTTEKKNGQDVAKPADQQAKDRKDEALVHSYRLTNPTKTDTGAYIEAIHEINGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQTGRTWTASLAYRFQNPNLEIGWRGRYVQKAVGSILVSGQKNREGKLENVVRQGFGVNDVFANWKPLGKDTLNVNLSVNNVFNTFYYPHS

SEQ ID NO: 20482 - protein, 672 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGDKSSRINIGRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNGKFKISDKKPDPNDPTKEIDKDAAEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRSGKLENVVRQGFGVNDVFANWKPLGKDTLNVNLSVNNVFNTFYYPHS

SEQ ID NO: 20483 - protein, 422 aa, Neisseria meningitidis
AKTIQAIRGMNDCAPTESPLWQWIEAQVRNVLNSYGYSEVRMPIVESTPLFARAIGEVTDVVSKEMYTFWDNDEQLTLRPEGTAGCVRAAIEHGWIYNNEQRLWYIGPMFRHERPQKGRYRQFHQVGVEVFGIANPEIDAELIMLTYRLWKALGIDQHVTLQLNSIGSLEARANYRSALVGFLENHQDLMSDEEKERLVRNPLRILDTKNPELQKVLDNAPKLLDYLDDESRTHFEQLCSLLDAVGIQYEINPKLVRGLDYYNKTVFEWVTSALGAQGTVCGGGRYDGLVEQLGGHATPSIGFAMGLERLVLLVQEVNPNVPAKSAVDIYVVYQGEGATLAAFELAEKVRSELPHLNTMLHCSSGNFKKQFKRADKSGATLALVIGESEVQNKQVVVKHLQGGTDQQTLDLVNIIDYLQTQF

SEQ ID NO: 20484 - protein, 673 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNNEKDYEAGKGFRNNFNSGKTVPYSALDKRSYLAKIGTSFGDGDHRIVLSHMKDQHRGIRTVREEFTVGDKSSRINIGRQAPAYRETTQSNTNLAYTGKNLGFVEKLDANAYVLEKERYSADDSRTGYAGNVKGPNHTQITTRGMNFNFDSRLAEQTLLKYGINYRHQEIKPQAFLNGKFKISDKKPDPNDPTKEIDKDAAEKAKDKKDMDLVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRSGKLENVVRQGFGVNDVFANWKPLGKDTLNVNLSVNNVFNTFYYPHS

SEQ ID NO: 20485 - protein, 663 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYSRNDEKDYEAGKGFRNNFNGGKTVPYSALDKRSYLAKIGTSFGDGDHRIVLSHMKDQHRGIRTVREEFTVGGDKERISMERQAPSYRETTQSNTNLAYTGKDLGFVEKLDANAYVLEKKRYSADDSGSGYAGNVKGPNHTQITTRGANFNFDSRLAEQTLLKYGINYRHQEIKPQAFLNSQFKIEDKEKATDEEKNKNRENEKIAKAYRLTNPTKTDAGAYIEAIHEIDGFTLTGGLRYDRFKVKTHDGKTVSSSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFKNPNLEIGWRGRYVQKAVGSILVAGQKDRSGKLENVVRQGFGVNDVFANWKPLGKDTLNVNLSVNNVFNTFYYPHS

SEQ ID NO: 20486 - protein, 672 aa, Neisseria meningitidis
VLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKEYEAGKGFRNFNGGKTVPYSALDKRSYLAKIGTTFGDGDHRIVLSHMKDQHRGIRTVREEFTVGDASSRTNITRQAPSYRETTQSNTNLAYTGKDLGFVEKLDANAYVLEKKRYSADDKDNGYAGNVVGPNHTRITTRGMNFNFDSRLAEQTLLKYGINYRHQEIKPQAFLNGEFEISGKKKDPKDPKKEIDKTDEEKAKDKKDMDLVHSYKLSNPTKTDTGAYIEAIHELDGFTLTGGLRYDRFKVKTHDGKTVSSSNLNPSFGVIWQPHEHWSFSSSHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHPKKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHS

SEQ ID NO: 20487 - protein, 671 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGMNFNFDSRLAEQTLLKYGINYRHQEIKPQAFLNGEFSIPTKEKKNGKEVDKPMEQQKKDRADEATVHAYKLSNPTKTDTGAYIEAIHEINGFTLTGGLRYDRFKVKTHDGKTVSNSSLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKAGVSYSKPRFYGYDTHKDKLLSANPEFGAQVGRTWTASLAYRFQNPNLEIGWRGRYVQKAVGSILVSGQKDRQGNLENVVRKGFGVNDVFANWKPLGKDTLNVNLSVNNVFNKYYYPHS

SEQ ID NO: 20488 - protein, 670 aa, Neisseria meningitidis
VLDTITVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTSFGDGDHRIVLSHMKDQHRGIRTVREEFTVGSEDSRINIKRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFEISDKKKGADGKEVDVDDAQKEKNRANEKIVHAYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNNGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAVGSILAAGQKDRKGNLENVVRQGFGVNDVFANWKPLGKDTLNVNLSVNNVFNTFYYPHS

SEQ ID NO: 20489 - protein, 669 aa, Neisseria meningitidis
ALDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGFASAGIGATNGAIIAKTVDAQDLLKGLDKNWGVRLNSGFASNEGVSYGASVFGKEGNFDGLFSYNRNDEKDYEAGKGFRNDNGGKTVPYSALDKRSYLAKIGTSFGDDDHRIVLSHMKDQHRGIRTVREEFAVSEKNSRITIKRQAPAYRETTQSNTNLAYTGKDLGFVEKLDANAYVLEKKRYSADDKDNGYAGNVKGPNHTRITTRGMNFNFDSRLAEQTLLKYGINYRHQEIKPQAFLNSQFSIPKTEKKDGKDVAKSSEQQTKDRKDETIVHSYKLSNPTKTDTGAYIEAIHEIDGFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHVSAAVREAVNAGYIKNHGYELGASYRTGGLTAKVGVSHSKPRFYDTHKDKLLSANPEFGAQVGRTWTASLAYRFKNPNLEIGWRGRYVQKAEGSILVSGQKDRQGKLENVVRKGFGVNDIFANWKPLGKDTLNVNLSVNNVFNTFYYPHS

SEQ ID NO: 20490 - protein, 376 aa, Neisseria meningitidis
VKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGYSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 20491 - protein, 199 aa, Wolbachia endosymbiont
GPISDEETSYYVRLQYNGEILPFYTKVDGIKNATGKEKDSPLTRSFIAGGGAFGYKMDDIRVDVEGLYSQLATDIAVVNGSETNVADSLTAFSGLVNVYYDITIEDMPITPYVGVGVGAAYIRNPSKADTVKDQKGFGFAYQAKAGVSYDVTPEIKLFAGARYFGSYGASFDKAAKGDTGIKNVVYSTVGAEAGVAFNF

SEQ ID NO: 20492 - protein, 867 aa, Campylobacter fetus
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADASRHEGDSIRFLYAKSMNTFGTNFQLMGYRYSTQGFYTLDDVAYRRMEGYEYDYDGEHRDEPIIVNYHNLRFSRKDRLQLNVSQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMLYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 20493 - protein, 169 aa, Wolbachia endosymbiont
YNGEILPLYTKVDGITNVTGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFNKETVSATKEINV

SEQ ID NO: 20494 - protein, 162 aa, Wolbachia pipientis
  misc_feature (11)..(11): Xaa can be any naturally occurring amino acid
  misc_feature (122)..(122): Xaa can be any naturally occurring amino acid
SYYVRLQYNGXVLPFKTRIDGIEYKKGAEVHDPLKASFMAGGAAFGYKMDDIRVDVEGLYSQLNKNDVSGATFTPTTVANSVAAFSGLVNVYYDIAIEDMPITPYVGVGVGAAYISNPSEAXAVKDQKGFGFAYQAKAGVSYDVTPEIKLYAGARYFGSYGA

SEQ ID NO: 20495 - protein, 186 aa, Wolbachia pipientis
SYYVRLQYNGEILPLFTKIRGVQHIKNKQKDSPLKASFMAASGAFGYKMDDIRVDIEGLYSRLNKDADVVDAAVENNLKAISGLVNVYYDMAIEDMPITPYVGVGVGAAYISNPLVKEATDDKNSGFGVAYQAKAGVSYDVTPEIKFYAGARYFGSYGANFVQKAKDDAAIDAAIKVLYSTVGAEA

SEQ ID NO: 20496 - protein, 188 aa, Wolbachia pipientis
SYYVRLQYNGEILPLFTKVDGATGAKKKNADAGTTTDLYKASFMAGGGAFGYKMDDIIVDVEGLYSKLSKDTLDVAPTPAIAESLTAISGLVNVYYDIAIEDMPVTPYVGVGVGAAYISTPLATAVNSQNGKFAFAGQARAGVSYDITPEIKLYAGARYFGSYGANFDKAAKDDAGIKVSLQHCWCRS

SEQ ID NO: 20497 - protein, 183 aa, Wolbachia pipientis
SYYVRLQYNGEVLPFKTRIDGIEYKKGTEVHDPLKASFMAGGAAFGYKMDDIRVDVEGLYSQLNKNDVSGATFTPTTVANSVAVFSGLVNVYYDIAIEDMPITPYVGVGVGAAYISNPSEASAVKDQKGFGFAYQAKAGVSYDVTPEIKLYAGARYFGSYGASFNKETVSATKEINVLYSAVG

SEQ ID NO: 20498 - protein, 181 aa, Wolbachia pipientis
SYYVRLQYNGAVLPFKTKIHGMGLSQDQNPLKASFIAGSGAFGYKMDDIRVDVEGLYSRLAKDTAVVSDANVADSVTAFSGLVNVYYDIAIEDMPITPYVGVGVGAACISNPSSAGEAKKQRGFGFAYQAKAGVGYDVTPEIKLFAGAHYFGSYGARFHKIKEPADNKEVGLLYNAVGAEA

SEQ ID NO: 20499 - protein, 185 aa, Wolbachia pipientis
SYYVRLQYNGEILPFYTKVDGIKNVTGKEKDSPLTRSFIAGGGAFGYKMDDIRVDVEGLYSQLAKDTAVVNTSETNVADSLTAFSGLVNVYYDIAIEDMPITPYIGVGVGAAYISNPSKADAVKDQKGFGFAYQAKAGVSYDVTPEIKLFAGARYFGSYGASFDKADKDDTGIKNVLYSTVGAEA

SEQ ID NO: 20500 - protein, 185 aa, Wolbachia pipientis
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVVYSTFGAEA

SEQ ID NO: 20501 - protein, 186 aa, Wolbachia pipientis
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGYTVLYSTVGAE

SEQ ID NO: 20502 - protein, 194 aa, Wolbachia pipientis
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYLSNPLKSPVGDQKHGFGFAYQAKAGVSYDVTPEIKLFAGARYFGSYGAKFDKSEEVTKTDSSGKETKVTKDEYKVLYSTIG

SEQ ID NO: 20503 - protein, 198 aa, Wolbachia pipientis
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGGGVGAAYISTPLKTAVNGQNSKFGFAGQVKAGVSYDVTPEIKLYAGARYFGSFGAHFDKSEEVDKAGGGKETKVTKDAYKVLYSTVGAEA

SEQ ID NO: 20504 - protein, 180 aa, Wolbachia pipientis
SYYVRLQYNGEILPFKTKITGITHKSGKDEDSPLKASFLAGGGAFGYKMDDIRVDVEGLYSQLSKDGDVADNPAIAESLTAFSGLVNVYYDVAIEDMPVTPYIGVGVGTAYVSNPLATKVTDDKASGFAFAYQAKAGVSYDVTPEIKLYAGARYFGSYGANFGKTAKDDAGIKVLYSTVG

SEQ ID NO: 20505 - protein, 183 aa, Wolbachia pipientis
SYYVRLQYNGEILPFKTKITGITHKSGKDEDSPLKASFLAGGGAFGYKMDDIRVDVEGLYSQLSKDGDVADNPAIAESLTAFSGLVNVYYDVAIEDMPVTPYIGVGVGTAYVSNPLATKVTDDKASGFAFAYQAKAGVSYDVTPEIKLYAGARYFGSYGANFGKTAKDDAGIKVLYSTVGAEA

SEQ ID NO: 20506 - protein, 186 aa, Wolbachia pipientis
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKEFGFAYQAKAGVSYDVTPEIKLYAGARYFGSYGASFNKEAVSATKEINVLYSAVGAEA

SEQ ID NO: 20507 - protein, 186 aa, Wolbachia pipientis
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKHFAGARYFGSYGASFNKEAVSATKEINVLYSAVGAEA

SEQ ID NO: 20508 - protein, 182 aa, Wolbachia pipientis
SYYVRLQYNGEILPFYTKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDDNDIKNVLYSTVG

SEQ ID NO: 20509 - protein, 183 aa, Wolbachia pipientis
SYYVRLQYNGEILPLYTEVNGIAKSKDKDKYSPLKRSFIAGSGAFGYKMDDIRVDVEGLYSKLTKDADVVSDSKVADNVTAFSGLVNVYYDVAIEDMPITPYVGIGVGASCLSNPSNVTEVKDQKGFGFAYQAKAGVSYDVTPEIKLFAGARYFGSYGASFHKETASDNKKIKVLYSTVGAEA

SEQ ID NO: 20510 - protein, 169 aa, Wolbachia pipientis
SYYVRLQYNGEILPLFTKVDGVTGLKKKAADTTDTTDLYTASFIAGGGAFGYKMDDIRVDVEGIYSQLNQDTTVTGTPVPAGGIAKNLTAISGLVNVYYDIAIEDMPITPYVGVGVGAAYVSNPLATKVTDDKASGFGVAYQAKAGVSYDVTPEIKLYAGARYFGSYGA

SEQ ID NO: 20511 - protein, 184 aa, Wolbachia pipientis
SYYVRLQYNGEVLPFKTKIDGVAYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKVLYSTVGAEA

SEQ ID NO: 20512 - protein, 186 aa, Wolbachia pipientis
SYYVRLQYNGEILPFYTKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEVKLYAGARYFGSYGANFDKSGGEKDKGGHTVLYSTVGAEA

SEQ ID NO: 20513 - protein, 185 aa, Wolbachia pipientis
SYYVRLQYNGEILPFYTKVDGIKNVTGKEKDGPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAHQAKAGVSYDVTPEIKLFAGARYFGSYGASFDKADKDDTGIKNVVYSTFGAEA

SEQ ID NO: 20514 - protein, 182 aa, Wolbachia pipientis
SYYVRLQYNGEILPLFTKIDGIKNTAGKEKDSPLKASFIAGGGAFGYKMDDIRVDVEGLYSQLSKDTTIIDTSEKSVADSLTAFSGLVNVYYDIAIEDMPITPYIGVGVGVAYISNPSKVDAVKDQRGFGFAYQAKAGVSYDVTPEIKLYAGARYFGSYGANFDKAAKDDAEIKGVLYSTVG

SEQ ID NO: 20515 - protein, 185 aa, Wolbachia pipientis
SYYVRLQYNGEILPFYTKVDGIKNVTGKEKDSPLTGSFIAGGGAFGYKMDDIRVDVEGLYSQLAKDTAVVNASETNVADSLTAFSGLVNVYYDIVIEDMPITPYVGVGAGAAYISNPSKADSVKDQKGFGFAYQAKGCVSYDVTPEIKLFAGARYFGSYGASFDKADKDDTGIKNVVYSTFGAEA

SEQ ID NO: 20516 - protein, 163 aa, Wolbachia pipientis
SYYVRLQYNGEILPLYTKVDGIKYEKESKPQNPLKASFIAGGGAFGYKMDDIRVDIEGLYSQLNKNDVTSAEFTPDTVADNVTAFSGLVNVYYDIAIEDMPITPYIGVGVGAAYLSNPSKADGVKDQRGLGFAGQVKAGVSYDVTPEIKLYAGARYFGSYGAS

SEQ ID NO: 20517 - protein, 183 aa, Wolbachia pipientis
SYYVRLQYNGEILPLYTKVNGITNTTGKEKDSPLTRSFIAGGGAFGYKMDDIRVDVEGLYSQLTKDATVVSDNKAADSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAVGAEA

SEQ ID NO: 20518 - protein, 185 aa, Wolbachia pipientis
SYYIRLQYNGEILPLFTKVDGITYTKDNSDYSPLKASFLAGGGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVG

SEQ ID NO: 20519 - protein, 186 aa, Wolbachia pipientis
SYYVRLQYNGEILPLFTKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYGAHFDKDAAAGKDKDKGELKVLYSTVGAEA

SEQ ID NO: 20520 - protein, 318 aa, Haemophilus influenzae
EVSRVKNQGVKTKTATQIADFGSKIGFKGQEDLGNGMKTIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDGTANQGKKHEQTQVAATAAYRFGNVTPRVSYAHGFKAKVNGVKNASYQYDQVIVGADYDFSKRTSALVSAGWLQEGKGKGKNKTEKTASM

SEQ ID NO: 20521 - protein, 185 aa, Wolbachia endosymbiont
SYYVRLQYNGEILPFYTKVDGIKNVTGKEKDSPLTRSFIAGGGAFGYNMDDIRVDVEGLYSQLAKGTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVVYSTFGAEA

SEQ ID NO: 20522 - protein, 898 aa, Haemophilus parasuis
MKNKLNLISLAILSLFAVQSYAEQAVQLNDVYVTGTKKKAHKKENEVTGLGKVVKTPDSLSKEQVLGMRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSKSIQRVDLADNNPQGSNWFKVKNDCPSLNCEPRQQVGVSYDGQKYITEQLSAKEYTGEERALPDPVKYKSDSWLVKLGYSLSPKHYVAGVYEHSKQRYDTRDMTYPAYWQLSDLKNGDKWYPMNNAKGLYRDNALDGVAIDYFTEDGVKSSKGLRWAKARFIDEWHTRDRLGALYRYTDQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHEFRSTHRWANQGDYKNSAWNIGIVAKPTSFLSLSYRASSGFRVPSFQELFGLRYDGAMKGSSDAYQKTEKLSPEKSLNQEVATTFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 20523 - protein, 812 aa, Ralstonia sp. SBUG 290
MKPFNQSILAVACAAAFSSVHADPTLQQTSTEQNELEQITVYGRQNNVVKDSGLATKSNMSLMETPAAVVVVDKALISTQGVDNLQDLVRNISGVTQAGNNYGIGDNLVVRGLGANYTYDGMYGGAGLDNTFNPTRSLTNVDSVEVLKGPATGLYGMGSAGGVINLIEKKPQFTEFHQLEAEIGQWNTYSVAFDSTAGITDKLAYRVMAKSARSDGYRDLSDDRDEAYLSLKYVFDQSHDLMLSAAYIKDALAVDSIGHPIRIFNAQSVDGKTAGQVTWQDLINDPKGKGVQLTDLQRQQLADSLANQDGLTPYTFGHNGIISPMAKDNQGEEVRFKLTHNADLTDNLFLNQQLQYRNYESGFARQTGAYNYVYWNRNGTINADPRAPLVINDVLYPYAARRQEYRQVQADERSWQYFLDLRYDFSFAGIDHELLVNANYEDRNIAFEQYSIYDADYVIKNKAGQQIYQGTLPYILDIRNPNWAQGSFADHDPLKTSNYNKKVKAWGTGLQHVAYFNNGFTTRVGIAFNEIEQAYQHLGVDPRYSASAASPTPEQNTSDNGMTYNLGATYMPTDDISLFVNHAKGRTAYSILGTITGTETDRDDSQSLSNDIGMRFKAFNDQLLGSIVVFQSARTNLQYGNPEFEAGVSAANVAQYFYDGKEETTGVEFDLNAEINKQWRLNVNAVYQDARDKKDPNASSFDTRQKGVPYVTSSAWLTYGASWFELENPIEFSLGVKYVDDRSTNSTSFGIPDGYVPSYTVYDSAVSYRAARWKLQLNINNLFDEVYYSKAMFLGGMPGEERNAKLTVSYQL

SEQ ID NO: 20524 - protein, 800 aa, Enterobacter cloacae
MPHLPFKALSLAIAMAALAPAAIAADATTRDYHLAAGPLADVLARFAANAGVPLSFDPALLQGRQSQGLQGSFSVPEGFARLLAGSGYSLISTGSGGYTLAPTVDLGSALELGATTINSNLAASGDTWQGGQVARSARLGVLGEQPTSDVPFSVTSYTAKTIADQQARTLGDVLLNDAAVRQSAGFGNFSQVFTIRGLPLSTDDISYNGLYGVLPRQIITTEALERVEVFKGPNAFLNGVAPQGSGIGGAVNLVPKRAADTPTRHVSLDYATGANVGGHLDLGQRFGEDNRFGARINLAQHDGGTGVHDEAQHATLVAVALDYRGERLRLSTDLGYQKERINQGRAVIYPTGSKVPHAPSARDNYAQPWTWSQLEDTYGMLNAEYDLNDNWVLYAGAGAKHTRENGEYSSLYVSDANGTARGGYLYSPHDEDNKSAMAGINGQFATGAVSHRLNVGLSGMWGEQRSAYAAVAAANRYATDLYHPVKVPRPTNTYTGSDLHDPRIVGKNRVKSVAMSDTLGFVDDRVLLTLGVRRQSIGVDGWSTASGERNANYDESVTTPVYGLVLKPWEHVSFYANRIEGLAQGPTAPSSVTNANEVFPPRRSKQVEAGVKLDWDSFGATLGLYRIEQPNSTTFRSAGAERDTFSMDGEQVNKGVELNVFGEPVHGLRLLTGAVFMHTELKNTANGANDGNRAPGVPRFQYNLGADWDVPGIAGAALNARVLRTGGQYVNASNSLNIPAWTRVDLGARYRFKVDEQWVTLRANLENVANKAYWASASTTNNYLTQGTPRVLRLSASVDF

SEQ ID NO: 20525 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFAHNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKKQNNIPLLTLPKEQSHVHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSL

SEQ ID NO: 20526 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLFLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRNYYYFLGAYIQDLKRDVKSGPVTLLKNAVSWDALMANLDSRAYMFRLTNQRALHRLQTLLNVSYVLRGQSHSYSL

SEQ ID NO: 20527 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSL

SEQ ID NO: 20528 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSL

SEQ ID NO: 20529 - protein, 308 aa, Chlamydia trachomatis
QDGTSLDMGGRAEARLSMKDGKVADNSRIRLNFLGKVEIQDGLYGVGFYEGEFTTADYNQNGENVSGSNTIDNRYTYAGLGGKFGEVTYGKNDGALGVITDFTDIMAYHGNSAADKIAVADRTDNMLSYKGQFDALSVKASYRFADRSEGTGADAGKYVDNGQDGYSLSAIYAIGQTGLTLGGGYADQDEQNEYMLAASYTMGDLYFAGIYTDGEKAKKEGDYTGYELAAKYTMGQTVFTTTYNNAETNSQTSADNFAVDATYYFKPNFRGYVSYNFNLIDSGDKIGTAGGAGYATATKINAEDLLAL

SEQ ID NO: 20530 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCASIPIVSNGSGLFSSFSIFSKLQGFSGTQDGFEESSGEIRSFSASSFRNISLPIGITFEKKSQKTRNYYYFLGAYIQDLKRDVKSGPVTLLKNAVSWDALMANLDSRAYMFRLTNQRALHRLQTLLNVSYVLRGQSHSYSL

SEQ ID NO: 20531 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFAHNRADLNGGAICCSNLICSRNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKKQNNIPLLTLPKEQSHVHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSL

SEQ ID NO: 20532 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKDSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSFGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSL

SEQ ID NO: 20533 - protein, 846 aa, Chlamydia trachomatis
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWGAPMANLDSRAYMFRLTNQRALHRLQTLLNVSYVLRGQSHSYSL

SEQ ID NO: 20534 - protein, 981 aa, Chlamydia trachomatis
SPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPPAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILAATNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQNNSAAAASTPSPSSSSTPAAVTINQSGNGSVIFTAESLTPSEKLQVLNSTSNFPGTLTVSGGELVVTEGATLTTGTITATSGRVTLGSGASLSAVAGAANNNYTCTVSKLGIDLESFLTPNYKTAILGAYGTVTVKRGSTLDLVMENEAEVYDNPLFVGSLTIPFVTLSSSSTSNGVTMKRVTINDADAAHYGYQGSWSADWTKPPLAPDAKGMVPPNTSNTLYLTWRPASNYGEYRLDPQRKGELVPNSLWVAGSALRTFTNGLKEHYVSRDVGFVASLHALGDYILNYTQDDRDGFLARYGGFQATAACHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFARGAGHNMSLPIGIVAHAVSHVRRSPLSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20535 - protein, 984 aa, Chlamydia trachomatis
SPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPLAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILATTNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQNNSAAAASTPSPSSSSTPAAVTINQSGNGSVIFTAESLTPSEKLQVLNSTSNFPGTLTVSGGELVVTEGATLTTGTITATSGRVTLGSGASLSAVAGAANNNYTCTVSKLGIDLESFLTPNYKTAILGAYGTVTVKKGSTLDLVMENEAEVYDNPLFVGSLTIPFVTLSSSSSSSASNGVTMKRVTINDADAAHYGYQGSWSADWTKPPLAPDAKGMVPPNTSNTLYLTWRPASNYGEYRLDPQRKGELVPNSLWVAGSALRTFTNGLKEHYVSRDVGFVASLHALGDYILNYTQDDRDGFLARYGGFQATAACHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFARGAGHNMSLPIGIVAHVVSHVRRSPLSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20536 - protein, 980 aa, Chlamydia trachomatis
SPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPPAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILATNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQNNSAAAASTPSPSSSSTPAAVTINQSGNGSVIFTAESLTPSEKLQVLNSTSNFPGTLTVSGGELVVTEGATLTTGTITATSGRVTLGSGASLSAVAGAANNNYTCTVSKLGIDLESFLTPNYKTAILGAYGTVTVKKGSTLDLVMENEAEVYDNPLFVGSLTIPFVTLSSSSTSNGVTMKRVTINDADAAHYGYQGSWSADWTKPPLAPDAKGMVPPNTSNTLYLTWRPASNYGEYRLDPQRKGELVPNSLWVAGSALRTFTNGLKEHYVSRDVGFVASLHALGDYILNYTQDDRDGFLARYGGFQATAACHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFAQGAGHNMSLPIGIVAHAVSHVRRSPLSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20537 - protein, 989 aa, Chlamydia trachomatis
SPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSTVPASTPTPPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMESEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQFARDYELTGFMHFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20538 - protein, 980 aa, Chlamydia trachomatis
SPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPPAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILATNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQNNSAAAASTPSPSSSSTPAAVTINQSGNGSVIFTAESLTPSEKLQVLNSTSNFPGTLTVSGGELVVTEGATLTTGTITATSGRVTLGSGASLSAVAGAANNNYTCTVSKLGIDLESFLTPNYKTAILGAYGTVTVKKGSTLDLVMENEAEVYDNPLFVGSLTIPFVTLSSSSTSNGVTMKRVTINDADAAHYGYQGSWSADWTKPPLAPDAKGMVPPNTSNTLYLTWRPASNYGEYRLDPQRKGELVPNSLWVAGSALRTFTNGLKEHYVSRDVGFVASLHALGDYILNYTQDDRDGFLARYGGFQATAACHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFARGAGHNMSLPIGIVAHAVSHVRRSPLSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20539 - protein, 991 aa, Chlamydia trachomatis
SPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSIVPASTPTPPAPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLITGTITATSGRVTLGSGASLSAVAGAANNNYTCTVSKLGIDLESFLTPNYKTAILGADGTVTVNSGSTLDLVMENEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQLARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20540 - protein, 989 aa, Chlamydia trachomatis
SPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSTVPASTPTPPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMESEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 20541 - protein, 938 aa, Chlamydia trachomatis
LMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRPFTSSNPNAAVNKIREGGAIHAQNLYINHNHDVVGFMKNFSYVRGGAISTANTFVVSENQSCFLFMDNICIQTNTAGKGGAIYAGTSNSFESNNCDLFFINNACCAGGAIFSPICSLTGNRGNIVFYNNRCFKNVETASSESSDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGAGNSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWSWGWAKTQDPEPASSATITDPKKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELEIATQLLASKGIWFGSGSPSSRHAMSYKISQQTQPLSWLTLHFQYHGFYSSSTFCNYLNGEIALR

SEQ ID NO: 20542 - protein, 938 aa, Chlamydia trachomatis
LMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRPFTSSNPNAAVNKIREGGAIHAQNLYINHNHDVVGFMKNFSYVRGGAISTANTFVVSENQSCFLFMDNICIQTNTAGKGGAIYAGTSNSFESNNCDLFFINNACCAGGAIFSPICSLTGNRGNIVFYNNRCFKNVETASSESSDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGAGNSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWTWGWAKTQDPEPASSATITDPQKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALR

SEQ ID NO: 20543 - protein, 935 aa, Chlamydia trachomatis
LMPNSVPDPTKESLSNKISLTGDTHNLTNCYLNNLRYILAILQKTPNEGAAVTITDYLSFFDTQKEGIYFAKNLTPESGGAIGYASPNSPTVEIRDTIGPVIFENNTCCRPFIWRNPYAAANKIREGGAIHAQNLYINHNHDVVGFMKNFSYVQGGAISTANTFVVSENQSCFLFMDNICIQTNTGGKGGAIYAGTSNSFESNNCDLFFINNACCAGGAIFSPICSLTGNRGNIVFYNNRCFKNVETASSEAPDGGAIKVTTRLDVTGNRGRIFFSDNITKNCGGAIYAPVVTLVDNGPTYFINNIANNKGGAIYIDGTSNSKISADRHAIIFNENIVTNVTSNNGISTNPPRRNAITVTSSSGEIILGAGKGQNLIFYDPIEVNAGVSVFFNKEADQTGSVVFSGATVNSADFHQRNLQTKTPATLTLNHGFLCIEDRAQLAVNRFTQTKGVVALGNGAVLSCYKNNSTNASVTLKHIGLNLPSILKSGAEIPLLWVEPTATTSNRTTTYSADTAAGFSLRDVKLSLIDDYGDSPYESTDLTHAVSSQPILAISEASDSQLQSESMDFSGLNVPHYGWQGLWTWGWAKTQDPEPANSSAITDPQKTNRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALR

SEQ ID NO: 20544 - protein, 937 aa, Chlamydia trachomatis
LMPNSVPDPTKESLSNKISLTGDTHNLTNCYLDNLRYILAILQRTPNEGAAVTITDYLSFFDTQKEGIYFAKNLTPESGGAIGYASPNSPTVEIRDTIGPVIFENNTCCRPFTWRNPLTAVNKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNEGGAIYIDGTSNSKISADRHAIIFNENIVTNVTNANGTSTSANPPRRNAITVASSSGEILLGAGSSQNLIFYDPIEVNAGVSVFFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWTWGWAKTQDPEPANSSAITDPQKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALR

SEQ ID NO: 20545 - protein, 182 aa, Wolbachia endosymbiont
YNSEFSPLNTKVDGITGAQKDSKDTNDLYKPSFMAGGSAFGYRMDDIRVDIEGLYSQLSKGALSRVPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAYK

SEQ ID NO: 20546 - protein, 183 aa, Wolbachia endosymbiont
EILPLFTKVDGITYKKDNSDYSPLKASFLAGGGAFGYKIDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGPYGANFDKSGGEKDKGGHTVLYSTVGAEAGVAFNF

SEQ ID NO: 20547 - protein, 265 aa, Wolbachia endosymbiont
TSVIALISASAAQAADVIVPHEVAPTVISAPAFSWTGFYIGGQVGNFSSKVEITDPNKKDKLFSKDDTPKPSGFMGGIYAGSNMSLGNNMILGVETDAVWADREDAKTSSAKVIREDELANFKDSLKNANAVFAKDKTMDDVKQDEKHTDSLALKEKWSGATRVRIGFTAADRIMPYVAGGVSYAQVQAVSSTKVTQAADDAEIASAQLFDKTKTLVGFTLGGGVDFAMTDNVLLRAEYRYSDFGKEKFEKDGSELSYKTNDFRV

SEQ ID NO: 20548 - protein, 183 aa, Wolbachia endosymbiont
EILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGTNFDKSGGEKDKGGHTVPYSTVGAEAGVAFNF

SEQ ID NO: 20549 - protein, 430 aa, Pseudomonas fluorescens
MNVNKILLAVGLSTLSLNTMAAAFQLSEHSASGLGRAFAGDAAIAENASVVARNPALMSQFSENQLSVVGTYIVPDVSLTGESAPAYSSADALNDDSIAPEAFVPATYYVMPLDDKFALGFGLFSNFGLATDFAEDYAAGQLAGKTEILTVNFNTSLSYKINEQLTVAGGLNVVYADATITRHLGDLSNALSAQGLVIPSSTTGLDLEGDDYGFGYNLGVAYDFDENSRFGFHYRSKVDITFDGTYSNDLPLIPGVFDNGQSGAVQPGSVDLELPAIAEFSGSHQLDDKWGVHYSVLWTNWSSFERLEAYVPSQDEPVFEKEENFSNSFRYAIGADYQLNAKVMLRAGIAYDETPTDSQLLSISIPDTNRLWISAGANYLLDDNSSIDLGVSIIRGQDRTFTEEDDAGGEWEFNSEGHAFIVSAQYNYAF

SEQ ID NO: 20550 - protein, 280 aa, Ehrlichia canis
MNYKKILVRSALISLMSILPYQSFADPVGSRTNDNKEGFYISAKYNPSISHFRKFSAEETPINGTNSLTKKVFGLKKDGDITKKDDFTRVAPGIDFQNNLISGFSGSIGYSMDGPRIELEAAYQQFNPKNTDNNDTDNGEYYKHFALSRKDAMEDQQYVVLKNDGITFMSLMVNTCYDITAEGVSFVPYACAGIGADLITIFKDLNLKFAYQGKIGISYPITPEVSAFIGGYYHGVIGNKFEKIPVITPVVLNDAPQTTSASVTLDVGYFGGEIGMRFTF

SEQ ID NO: 20551 - protein, 392 aa, Helicobacter bilis
MSGKFEPTQGTDGGKAKLALLALCLAGAVSQAHAQSSVTLYGVVDEGIDYVNNSGGSSLVRLRDGTWDGIFGSRFGLKGSEDLGGGLKAIFKLESGFDATNGKNLQGGRMFGRSAYVGLSNDRVGTVTFGRQYDLVTDYLQPVTSNGQFTGPFVHAGDIDNTANTYRVDNAVKYASPSFGGLTFGGMYSFSGGNGLGTTGMWSVAAAYEHAGLNLAAVYDHFNNPGLLINDGNFIGNTTGAAIGASGAFSYVGSPRNQQILGLGGSYEIGKATAGFTWTNTKFDDANGTTSSVVFNNYDAWLKYNLTSSTTVGGAYIYSAGRVNYNGERPKYHTAGLFASYSLSKTTMLYAMGAFQQAAGDAKLADIYDYAIADASSTNRQLMFRIGMNHRF

SEQ ID NO: 20552 - protein, 193 aa, Wolbachia sp. pJM36
YVRLQYNGEFLPLFTKVDGITYKKDKSDYSPLKPSFIAGGGAFGYKMDDIRVDVEGVYSYLNKNDVKDVTFDPANIIADSVTAISGLVNVYYDIAIEDMPITPYIGVGVGAAYISTPLELAVNDQKSKFGFAGQVKAGVSYDVTPEVKLYAGARYFGSYGANFDGRKTDPRDATKQVIDAGAYKVLYSTVGAE

SEQ ID NO: 20553 - protein, 190 aa, Wolbachia sp. pJM32
  misc_feature (106)..(106): Xaa can be any naturally occurring amino acid
  misc_feature (110)..(110): Xaa can be any naturally occurring amino acid
  misc_feature (113)..(133): Xaa can be any naturally occurring amino acid
YVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIXVGVXAAXXXXXXXXXXXXXXXXXXXXXQVKAGVSYDVTPEVKLYAGARYFGSYGANFDGKKTDPKNSTGQAADAGAYKVLYSTV

SEQ ID NO: 20554 - protein, 179 aa, Wolbachia sp. pJM27
YVRLQYNGEILPFYTKVDGITNATGKEKDSPLTRSFIAGGGAFGYKMDDIRVDVEGLYSKLAKDTDVVNTSETNVADSLTAFSGLVNVYYDIAIEDMPITPYVGVGIGAAYISNPSKADVVKDQKGFGFAYQAKAGVSYDVTPEIKLFARARYFGSYGASFDKAAKDDTGIKNVVYSTV

SEQ ID NO: 20555 - protein, 726 aa, Bacteroides fragilis
MKQHFTLTPLSFAIALALSTNIAHAEEMGTLVVEGDTEQSSTSNNFNYVSKVAQTATKTDEQITKIPRAVSVVTREQMDDRAPISISDALQYTPSIQTNFYGEDNKQDWFVIRGFKQANNGLYQDGTRLYSSSFYSWQIDPFMLERIEVLRGPASTLNGQTPPGGVINVISKRAQLEEDFGSVTGTIGSNDRKEINLDVNKVINDKLAFRMVAITRENGTKVDEVEANRTLLAPSLAWKISDDTKLTVLASYQKDDSDPYLQFLPMEGTLTSNASGKINYDTALGNSDWETFQREQTSVGYELEHIFNDNLSFQQSARFSHMDINLRQLYYAAYAADYGFSSTRDTILRGVTYEDGDSDAFNIDNRFIYKFDAGNTKHTLLTGIDYQSIDINSKSYAGTILAADDGNFLFNPYSPSYGSSISLYSYNGTLTSVTDADLQTTKTKNRQLGFYLQDKANITDKFTVIAGVRYDDTSNETNNTSTNKKTDIDLHQWTGNLGASYQLDNGLVPYANYAQSFTPIIALDADNNPAKPEKADSYEVGVKFKPQSFDGQFGIAAYQVTKENLSSGSSGTANFRQLGEVRNRGIEFEAVVNLNRAVTLVGTLSYVDSEITKDTNSSNVGKTPAQIANKLASVWGNYRFIDGILDGLKVGAGVRYIGETYADNTETNKVPSYALVDAMASYQVDNYKFQLVAKNLFDKEYVATCGDGFCYYGDSRNIMASVTYDW

SEQ ID NO: 20556 - protein, 390 aa, Sphingomonas sp. KA1
MCKLALPLGVQNRRPLLAGRGKPFLSSSNASAVALGAPPTATGETSAITYNVPAGGAGTYIFERPTGAVFTCSSGPSETTEDTQEGFSSSQITAQLSSLSKTVSNNVKGVLNGGGNRPTVTQNGFFLQTLGLAARRGRGVDPEWNLWIKGDYNKFSGNSLNGSQANLVFGLDFKPDPDTVVGGLLSYDTTDFTTLSAGTAGALDAEGYTLGVYGGRRMDNGLMIDGMLAYSALDYSVVNGAVSGAFDANRISMSVGISNRMEIGGMTVEPNANLIYARETQAAYTDSGATAHAEKKVTAGRLSLGPTIYFDPKDNGLAPWISVNAEYDFSDNGSTSAGSSAFADNLSLRAGFGFSLPTENGNLSFAVNAGGLGSGNYTSVGATLTYRMAF

SEQ ID NO: 20557 - protein, 697 aa, Vibrio parahaemolyticus
MFTKSHLALVIGAVLAAPAVANVQTDEHLVVEGREFGYKADTNSTAMRMEMTQLETPGQVAVIDETVIDEQRASTLGEVLRNDASVSAGGTSRNRERFSLRGFELSSSDGFLRDGRQHWSHYRQPIELLERVEVLKGPSGLLYGKSEPGGLVNMVSKKPTTQTQVSLSQDIGSNEHSRTVLDVSGSLNDAETLRARAIFAKENYSSWRTYGDGTKPQTDRVVGGLVVEYDITENIMVSAHYDRTKDEGSVDSGAYIVDGKPVRGDKYIWDAQWSKIDNDVENYGIDINAQVTDNVNVKAGYNRQDFKRFDVESYPKFDNYDKDGVIRHKGNERTDNWVFDTAYLDVTTNFSLLGTENTFLVGANYLDYKYDRFMASHAGEDVAAGTTVTRPGTVRSKKYPRREHDTWGIYAQNMMTINDYWQVLAGARYDEKREDSLTENQVSPKLGVIFHPTSNGSIYVQYSESFMPQGEVSNGSRIYINDGEKLDAERGISYEIGTKWELFDQRLFVSGAVFDITLENISLDVESGKDASNQLLHKKTQGGEQVHKGAELMAQGFVTPELSLTASAMYLDAELKKAERFEGNRPADVPEFSASLWSSYRVQDNTNLNLGLIYEGDRYGDAANTFKKDGYARIDMGVSYKHKYDENLDIIARFNVENLFDTDYLAGGGSTNGNQEGASGVVVGEGRNYMATIQFKY

SEQ ID NO: 20558 - protein, 248 aa, Xylella fastidiosa
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 20559 - protein, 997 aa, Xylella fastidiosa
MSLTKHALLMLTALTLAQTALAEEVKSTEAVEELDTIVVSGASAGEINIQEKKVGETQITTQTLTKQQVSDSRDLVRYETGITVVETGRMGASGYAVRGVDENRVGIMIDGLRQSETLSSQGFKELFEGYGNFNNTRNGVEIENVKVATITKGADSIKSGSGALGGSVMFETKDARDYLIDKDYHIGVKRGYQSMDNQDLTSVTLAGRYKWFDALFIHTRREGREIENYFYDIYKNKEQDYAAIGKTREKADPYHITRESNLLKLAFQPHEEHRFSVALDDSKLHSNGEDLSYTLRSSTRVDHEIYGQRKTNDKSHRKNTQFTYENFTQTPFWDHVKISYSTQKITNNARTDEYCSGPKCQAVLNEQGLKLDNSSGVNKIVDQHGGDIRAEKEKRGWRTIIKYHNSKGEEMPGTHYREHTPQSTLIDCSKIDCKKPFKVYVKKNENWQDVYEFQNRPITIKTTPSGKTYGEIALKSKPGLFGGNQYEEVSFLLPFSAGYSRNDYNDRDLNTNTKQLDLDFGKEFSLWGIEHKLKYGGLYSKTEKSMVNKDGYQGGNVQWWADAFFCNKPIDGTFPREYEPRPDYWPLVGCSGALRENVNGRYSYLIPVKTKNSALYIGDKITLTNWLNIDLNYRYDKVTHMPRYDNSVPVPKGMIAGIFIPIPGNSYGINATCGYNTKCLNDNVAQNLAIMLQNKTYKHHSYNLGVNLDPLAFMRLQLKYSNGFRAPTSDEMFMTFKHPSFSIAPNVQLKSELAKTKEAALTFYRHNSFITLSAFQTDYKDFIDLVFVGERAVDVGSVLTYPFYQNQNRDKAKVTGFEVNSRLELSELHDRLKGFRVGLKLTQQKGKIDGKIPMNAIQPRTIVYNLGYSTEEDKYGIDFYITDVAAKKRHETYNMYWEGQAKNGTLVQGKAVKDSTLAWRNNHYTTLDAIAYARPLKNLLLTAGVYNITDKKYITWDSARSIRAIGTLNLIDQNTGAGIKRFYAPGRNFRLNAEFTF

SEQ ID NO: 20560 - protein, 190 aa, Xylella fastidiosa
METLTLLCLRTLLQCWWWLHREHSSIQKSKSTIRLPASATTSFTHAIDDRWSIMAEVTRTAWSKFDKITIHFASSQPNNVLNFSYRDTTFVALGTEYRFNDMLTLRGGLAYDQTPTTAEYRSARVPDNSRTWISLGMTWKPSKQTDYNIGYAHLFIDHPTITQISATGSTLAGAYNINADLLATSINYKF

SEQ ID NO: 20561 - protein, 406 aa, Xylella fastidiosa
MSACAARQLPGNRRLARLAGAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGPFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHMVAQADYAFSIRTDAYLAAVYQRVSGGNGIPAFNATIWTLTPSANGNQVVVALGLRHRF

SEQ ID NO: 20562 - protein, 721 aa, Vibrio parahaemolyticus
MKKHILSLTLGSLLVSTLSAEDDGFYTSVGYQIGEAAQMVTNTKGIQELSDNYEKLNNLLTRYSTLNTLIKLSADPSAINAARENLGASAKNLIGDKANSPAYQAVLLAINAAVGFWNVVGYVSQCGGNANGKKSTSSTTIFNNEPGYRSTSITCSLNGYTPGVEGPISIENMKKINEAYQILQTALKQGLPALKENNGTVKVEYTYTCSGRGNDNCPKEATGVNNQQNGTKTETKITGDKTVTTISLKVPDSAQALLAQASTLINTINSACPWFIATSSNSSNAPQWKWSAHSGGLCGAFKDEISAIQKMITDAQELVNQTSVINSHEQSTPIGGNNGKPFNPFMDASFAQGMLANASAQAKMLNLAHQVGQTINPDNLTGNFQYFVKEYLATCNNKSTAGTGGTQGSPPGEVTTQTFASGCAYVEQTITNLENSIAHFGTQEQQIQQAENIADTLVNFKSRYSELGNTYNSITTVLSSIPNAQSLQNVVGKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARPKKKGSDHAAQHGIELGLKIPTINTNYYSFMGAELKYRRLYSVYLNYVFAY

SEQ ID NO: 20563 - protein, 678 aa, Vibrio parahaemolyticus
MNKLLTLTPLAVAIGSSLVAPSAVASEETNSTSSATETIQVFGHQYEGYAEHMPQSGTKTDVEWLDVPQAVSVVTKTEMQDRGAVRLVDALDGVAGVNNTLGEGSRDQFMIRGFDSLNDMYRDGLRDDGTLQSYRSLANVERVEIVKGPAGALYGRGSAGGIINLVTKRANGENFTHVNGSVGSNNQYVGQVDSSMAFTDKVNGRINLEYRQADSYVDHVDSNDFFIAPTIRVLPAEGHTIDIDVEYAHQELVPYRGVPSKNGKPVDLPVSTYFGGTNDYQESDSLRIAVDYEWRLNDQWVWNNRAAFNHIELEQKGTRQGKVTGNEVSQTVNNFGYDPRTTTTLQSELVWETRDNQLMVGADFNQIDIDLTLASDKTLPLQNIYDPVVGPTPDPGFKPFRDNTTTTTGLYVQDVYTWGDLSLIGNVRYDSMELEQQKAGSDKEKLDDDKVSYRAGLVYRINSDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKKPNDVSDHLFSLWSTYQLNDNWRLGGGVKYVGDRYAGNDEAVALGDYTTVDLMAAYTTGRHKIQANAYNILDEKYILGATNGTSGLNQIGYGAPAEFMLSYGYQF

SEQ ID NO: 20564 - protein, 712 aa, Vibrio parahaemolyticus
MKLTPVSAAVLSVLAASQVHAKSDVFSMEEVVVTANRIEQPMSELAGSVAVVTSEEIEQKGETELYDALRHEPGVSVSGGAGRPQNITIRGMTGNRIMIIRDGIRSADGFGANDSNDKVGRDTFDLSNLESLEVVKGASSSVLGSGAIGGAVILKSKQPGEFLKDRDFYVDATGTYTGISNKYKGASNLAFRSGDTESLVNAAYWQGEETRNFSQDLYNRDLDGYSASYAINHFLNDEVMVKARAELYRQDQQRLEGSPSIQKDGKWHIEDFAEDESTKEYSAYIGAEVTPINPTWFEELDTKVYWRHTEVVEDTNRLMRQVDHNGLTVRRRELEHKTFIDETIGFRGDFTNTIYAANAEHQLAYGIELSTDYYERTDSDSKIDWNGVTPSTKQPFAPARAYNIGLYVRDMVELDKWTITGGLRFDAHRLTPDGEGEVGGFPLKDMDSSEVSPSLSISREVFANNIAYVSYNHGYRAPEYDKAYGFVNHDFVPLTPFVIAPNMDLEAETSDSFEIGNKFDNGRAQLYVSAFYNKFQNFIDVVTTGQDNFGNYIKQYQNLHGVETYGAELSAAYAFTSSWKLSTKLGYVDGKDAEGEYVRSITPFEGNVGLNYQQQDFNAFATWNWAGSMDRVPSCQTSLGQKTECAQTDSWNTFDLGASYQITKDFRLSATIINLFDKEYIRYQDIAGIADESKRYSTEPGRYFTVNAKYVF

SEQ ID NO: 20565 - protein, 696 aa, Vibrio parahaemolyticus
MTKNNLLTVAIRKAMVCAIAPTVAVVALSANAQDDVTAMETITVTAQALKVETPAAETPRSVSIISEDELRVRAPKKLDEALRYTSGVTAQPYGADNDTDWFKVRGFDAATYLNGNRLFRDGYYTWLVEPYGLESVEVVKGPSAILFGESAPGGIVNAVQKKPTFTPQGEVKVEVGNNQHQSVGFDIADEANDDGTIRYRLVGLMTSQDGELDGTNNERFYLAPSVEFDISDRTMLTVLATYLRDDGVPTNPFFPAAGTLIGSNFGKIDPSTNLGQPNYDKYERTQFSLGYLLEHDINDTWSFSQNLNYGSNELYLRSSYAFSNNDPAKEELTQGIVFRDGKNQSITFDNNAVGNWMTDNAEHTVLVGMDLQFHKTDGDEQDNYAFGTINPWNPVYGNFNPLDPSKNVKREIEKSQASVYSQYQLKLHEQWIGNVGARYDWVKTENSGKGAGVDQNESRDDGQLSLSAGVMFLANNGLSPYANYSQSFEVISTIDAATNELYKPLEGEQVEVGVKYEPSFMDGFINLAWFDITQKNALVTNPSTWIATQTGEVTSQGIELESTAQLTDDLKLMASYTYTKAKTDESFGQGKKQAALIPEHQASAWVDYSAYSLIPGLNIGTGVRYVGESKDNPKSSNLTVPSVTLWDASVTYDITSQWQAQLNVNNILDKEFVSGCDYWCYYGQSRSVMLNANYRW

SEQ ID NO: 20566 - protein, 725 aa, Vibrio parahaemolyticus
MTNRKFSLNLIVLAMSSGYAAHALAAEQAQQLASQNAADEQLVVVGSVMPKSISDIPGTVWFVGQEEIAQQYRAGKTLGDILSATIPSLDVGTGGRTNYGQNLRGRAMLVMIDGVSLQSSRPISRQLDAIDPFNIERIEVLSGATSIYGAGATGGVINIITKKAYSDELAFESFVGGTSGFNSSDDFDYKVAQSVAGGNDIVKARGSVVYSETQGAFDGNGDIVTPDISQGSLQYNSTLDVMGSAEIQISDASKLNLVAQYYDSQQDSPYGLYIVNRKFVDVRKGFDSDREHGTERVLLSANYAHDNVFGHQLIGELSYRSEDQTFTPYYQSSSQQETEVFAGRLALAKSWGAFSAVYGMDAYLDRFDSNQALFDKTIADNSGNLINRTYAEVGRYPGVDVTSYAMFVQGDYQISQDWSIQAGYRYQYMDNKIDDFVAYSVQKNIASGKGVSADAVPGGSTDYSVSLFNVGTIYQLNDESQLWANFSQGFELADPAKYYGQGSYEAVDAKGHYALKDSINVADSKMSGIKTDSYEIGYRLDTDTVALQAAGYYSVSDNSIKYDKKTLLITNVDDEQRVYGAEANINYWVSSDILLGASGHYVVSELKTNGKWEDLSAGKASTSKANAWAAYYQDDYSVRLQSQTMFDYEDDANNKLDGYTTFDLLGNVNLPVGQLGFGIQNLLDEDYTTAWGQRAQILYAAHYDAAAYDYKGRGRTFTLNYSLEY

SEQ ID NO: 20567 - protein, 1151 aa, Vibrio parahaemolyticus
MYNKLFKRPVYAINFALSKRHTNHEVFAANALPIFTKLMKFSLIQILGIVVAVQLSWSAPVNAQLMEKRVSIEFTNQKLEEALTDLASSAKFRLVYNNQIKEDNTKFSGKYNGIKVKELLVYLLKNSNLTYEVINDQFVVIRSKGQKEESPVITAPVEEPKISSSQQGFVISGIVLDENDEPMPGVSLKAKTGGQATTTNAKGRFALGISAPGTVVEFSFIGYRLYQTTVNAEIDLQVKMKPDPAKLDEVVVIGYGTTTRRTSTGSQVGITAKDIEKQPVTNALQTLQGRMPGVQVTQTNGLPGAGINVQIRGANSIGKSNRPLYIIDGVPFLSEPINTASSSTSVLPSAEGNTSPLNTINPSDIESLEVLKDADATAIYGSRGANGVVLITTKKGAAGKTKFNVNASSGASVVGHFIDLMNTEQYLALRRKGFANGTTNPTAPSATNAPDLVSWDQNTSTDWQRELLGGTARTNDVTANVSGGDANTNFYMSGTYHQEGNVYPGDQGYKRGGVNVSLNHSSIDRKFNVGFSAIYSTDKNNISSTELANYAYSLAPNFPIYKADGSLNWVGGNNPYGFLYQTNDNRSSNLLGSLNLKYTILEGLDIKSTFGYSKTDMNQVVLRPLMSLSTAYTVPVSGTASYAYTYANNYIVEPQITYNRKIWKGSLSALLGGTYQSKQSRQPYYTSAQGFSSDDFLRNVSSATTVSTSSSSRDYKYASVFGRINYNVADKYILNLNFRRDGSSRFGPDKKFGNFGSVGAAWVFSEENFLKDKFSWFSFGKLRGSYGVVGSDEIGDYQYLESFTASTASYNGVSSLNPSRIANAAFQWETTKKLEVGLELGFFDDRLSLTGNYYRNRSGNQLISYPLSAQTGFTSYQSNLPATVQNSGVELAISSTNIRTKEFTWTSGFNISKNANKLLSFPNIEKTSYYTTYLVGRPISSFYAYQFTGIDPATNLPAFTDFNGVGGTASPTTGLSEIGRGDRYFVGSAYPSFFGGLTNTLTYKGLTLDFTFQFVKQRGRSLAAASFYPPGYMYNMATSVVDEYLALGSQDYLVTAGTAGTNGRPAYFGYSSWTGSDANIVDASFIRMKNVNLSYVLPTKWVSKLHAQQIRVFTQAQNLFTITNYKGYDPESQGIVTPPLRTVVAGLQFTF

SEQ ID NO: 20568 - protein, 374 aa, Vibrio parahaemolyticus
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHRLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTTRADNYEANVKYNLTPALGLGVAYTYTNAKANGESTHWNQVGVQADYALSKRTDVYAQAVYQRSSKNANASIYNGDLSTPFSTSINQTAATVGLRHRF

SEQ ID NO: 20569 - protein, 668 aa, Vibrio parahaemolyticus
MESPACSSIKLSSLCLAVGMALANPVLAQESDSHFEEVVVWGTKVSSNTESMFADDMSLKQADHMSDLLRDIPGVDVGGTHSVNQRITIRGLGETDLDIRLDGASQHASMFHHIGNLTLNPDILKSADIQVGNNSVTQNGLGGSVYFETKDARDLLRYDETFGARVYGGFASNDNQQGSLTLYGLLSENIDAMVYGHYVTRDDFKDGNGDKTFGSAGDVYNILAKLGYEFNDIHRFELSYDMYRDSGDYSPRPDMAGSANNGLSSKLLIPTDYARDTVTLSYELRGEQHQGNVTLYNTETEIKRDETVMAPRWPSNRLSKNTAKNQNLGLNAKFQSDFALAQFDNRVTYGFDYMDKTSSSYYGSSKFMDESAVSTALFVEDQFFFSDAFFITAGLRFDDYKRKAETGTSNFDDVTWALAAEWAVTQDWTLFASSRSLFKGPELMETFIAYQDVAYLDEGMKAETGQNTQGGLRFNKTLDKHFFGANVTVFQTNIDDYIADKYQDATQTYLIYNIGDVEIKGFEASASYGYDKFNSKLSYSQSDTKNKNTGGPVAGGNGRSIDMGDSIALTLDYQSDSLETIFGWTSMFVLEEDNVFDGQPAKDSYDVHNLYAQWVPSNVDGLSVTFGIDNIFDEVYTSHASRSGTVRGFTLDDYEPGRNFKLSAAYQF

SEQ ID NO: 20570 - protein, 323 aa, Vibrio parahaemolyticus
MKKAALTTAILTALVSAPSFAATVYKNDGTELKVGGRVEFRGDFIGSDGAEVEGSMEDQSRARLNLKGKTDIGNGMSAFGVYEAEQKTGKSEFKNRYMYAGVNTDVGAFSVGRQDMAAVIISDMTDITEFSGVQQVIDSSSDKQDSVFAYRGEFDALQLQATYQANSGDSQDKYGISGMYSLPMGLDLGLAYSGGDVDKNNSEDQILGGIAYSLDNLYLAGTYSQGSLTDSEDFTAYELVASYKVASKVTLAALYTAQENDPDNGSKYDSVEGVELVGYYKLNSNFRTYLSYYINQLDEVKDATSGLVTEGEDTLRLGVRYDF

SEQ ID NO: 20571 - protein, 189 aa, Vibrio parahaemolyticus
MKKIAFILALWVGLLGAFEPKKSHIYFGAMVGLAPVKITPKPASDSSYTAFLWGAKGGYQFAFFKALALRGEFSYLMAIKPTALHTINTSLLSLNMDVLSDFYTYKKYSFGVYGGLGIGYFYQSNHLGMKNSSFMGYNGLFNVGLGSTIDRHHRVELGAKIPFSKTRNSFKNSYFLESVFIHAAYSYMF

SEQ ID NO: 20572 - protein, 615 aa, Vibrio parahaemolyticus
MSYKTALISVAVMAASASAFAQISETEENRLRSVVVEGSRLDQTATEVGSSVSIIGKEDLEKLDLDFALDAVATAPGVTINQNGAFGGSASVRIRGASSGQTLVLIDGVPVGDPSTTDGSFNFAYLDTANVERIEVLKGPQSTLWGSNAIGGVVSVTSRQPKTGFGGSAFAEYGSFNTLRGGASIDGANETGDFRLSATGISTDGISKSDKENGNTEEDAYDSTTVSAKGGLNLPNSARLQATILHNQAESEYDSFSSGAQGSVADGDEVTENETLSGNISLNLPLLDDRFENHFLIGYSDITRENFTNGAQSYFAEGDRTLYRYQGTFAINDANKVSFGAEREETSANGDEASIDGLFALYELKPVETLTLTAGLRQDDDNRFGSETTARVAAAWNVTGHVTIRSSWGQGFKAPSLFQTTYICTFCGLSEPNVDLMPETSEAFDIGLEWRSGDGRAEAGVTYFDQNTDNLIDFSYTAGYDNIARVESKGAEVFAGYVLTNWLSVDGNYTYIDAHDGDGNELTRLPKHSANFSLTVDPDGPFSGAVLVRYNDDEANTNGTTLDGWTRVDLTGRYTLNERVELYGRIENLFDEDYQQILGYGTPGLSGSVGIRLRY

SEQ ID NO: 20573 - protein, 793 aa, Vibrio parahaemolyticus
MRKNLLAAIVLLVLYIPSVWAAAGYPVRGRVIDRLSREPVAYAAVTITGQPGKGAMTDSLGRFEILQVKPGIYSLTASFIGYRTVVTPEYQVSARTPFIEIEMEEEPEHLNEVVVRPSPFRRTIESPVSMQVIGMREIEKSPGSNRDVSRIVRSYPGVSFSPIGYRNDLIVRGGGPSENRFFMDGIEIPNINHFATQGATGGPVSIVNSDLVREINFYTGSFPADRAGALSSVLDFRLRDGDLERQTFKATLGASEVSLSGSGHVGKKTTYLFSVRQSYLQFLFKLLGLPFLPNYIDGQLKVKTRFSERDELTFLGLVGIDNMKLNLDEKGEENEYLLSYLPRIQQETFTVGAVYRHYAGRHVQSVALSHNYLNNRNTKYRNNDESTPDNLTLRLRGVEQKTTLRFENRSYLGRWTLREGAELNYSTYHNKTLQRTYQQEAELLDYRTYLGIVGWGFFVGADYASADKRLTVSMGVRADGCDYSAEMERFWKQLSPRVSASYALSDSWSVSGSAGLFYQLPPYTALGYKDNTGELVNRGLEYMRVLQSAVGVNWRLRDRLVVSLEGFYKYYTNIPLSVADDVPLTCKGNDYGTSGDELLVSSAQGRAYGLELMVRWQLPDRFNLVGALTVFSSEYRSRHDAKYIPSAWDNRFVANISGTYDFSRGWSVGAKLSAIGGTPYTPYDVEKSSLVEAWNASGRPYYDYSKYNTGRLDAFAQLDVRVDKVFYFRKCMLGIYVDLQNVTFSKLRQPDVLMSTGVIENPSAPPSEQRYKMKYIRQASGTLVPTLGVTVEF

SEQ ID NO: 20574 - protein, 697 aa, Vibrio parahaemolyticus
MFTKSHLALVIGAVLAAPAVANVQTDEHLVVEGREFGYKADTNSTAMRMEMTQLETPGQVAVIDETVIDEQRASTLGEVLRNDASVSAGGTSRNRERFSLRGFELSSSDGFLRDGRQHWSHYRQPIELLERVEVLKGPSGLLYGKSEPGGLVNMVSKKPTTQTQVSLSQDIGSNEHSRTVLDVSGSLNDAETLRARAIFAKENYSSWRTYGDGTKPQTDRVVGGLVVEYDITENIMVSAHYDRTKDEGSVDSGAYIVDGKPVRGDKYIWDAQWSKIDNDVENYGIDINAQVTDNVNVKAGYNRQDFKRFDVESYPKFDNYDKDGVIRHKGNERTDNWVFDTAYLDVTTNFSLLGTENTFLVGANYLDYKYDRFMAFHAGEDVAAGTTVTRPGTVRSKKYPRGEHDTWGIYAQNMMTINDYWQVLAGARYDEKREDSLTENQVSPKLGVIFHPTSNGSIYVQYSESFMPQGEVSNGSRIYINDGEKLDAERGISYEIGTKWELFDQRLFVSGAVFDITLENISLDVESGKDASNQLLHKKTQGGEQVHKGAELMAQGFVTPELSLTASAMYLDAELKKAERFEGNRPADVPEFSASLWSSYKVHDNTNLNLGLIYEGDRYGDAKNTFKKDGYARIDMGVSYKHKYDENLDIIARFNVENLFDTDYLAGGGSTNGDQKGASGVVVGEERNYMATIQFKY

SEQ ID NO: 20575 - protein, 2083 aa, Vibrio parahaemolyticus
MKTNKSRLALGAASAAVAVGLAAQVQAATTTSGTTVTVAGTDNTADSVNTATNAVSGSTVTVSISTGATVVQPSTALSPTQQGAVAITNRGTVGTSVAPVGIVYAGTSTSSDNTFDLANLGAITGGVSVNGVGGTVNIVNSGTIDNGIGVTAAGAVTIRTGAVKSGSGIAVSAASQDNVSIAVDGTIGTAGTEMVSSALRDVQAISIGTTSTSTGPTTETVDGTTTVSGSSSSDYTGGSADVAVEAGGASGAVLAVGLASASVSVDGAVGAEDQSAQVNAIANLGEVHSASDYEYVTTATGSSYATHEEFATMGGDASVDIGEGGFVSGAVTAAGLTSAEVTVDGTVGREGFSSSVNARALGVSHSEDETGTVVNASGDYTNNFTATNARTGGTASVTVGENGIVRGAINARADGDATIDNSGQVDGALNARSNEYVSNQEVTSYNSGTFTSADGVSVDAYTSGYAFTSGNVGNAASVTNAQGASAGYANLNAIGDATLTNGGELVNGALVNSSGTTSTGSGATSETYTFTDTGEGTYRSAYSYSDETTSGSSTIGGTASVANASGGTIGNGPGSSLSVNGFAGAQVQNAGIINANVNLGSTGSDSTSASLSTYDETADTVGVTASESTYEYANASTATGGSASLTNAAGGLVGLNDESPVSVSLHANSDASVTNAGRINGPVSVVADATDTANSGGSANTFTVDRTTGVVNTSEAEHYESSSASAGGSASFANAAGGLVVGSVNVSGDAGVTVSNAGVVTGTTYASSNSSASTFAYESLETGVFTPGAEGGFVSDYTQSVSSSSNDDGGDVTGTYDGFNGAVQFTNSGASDGSVTQFANGNSTATVSGTIFGSFNETASGSASTSTYTETTHYANDADGNTFEGTYDEASSGTYDRTGGNSSLAVAGGTITGNATVNADGDASAQLGNGAEIGGNLDVHAATFGSNSTFAETSSTVGTYVDGDLTGYTLEEASESSSTNLDSAGSVSIGNAEVGGYVSVSGAKGGATLDLASAGSIGGSAYVYAGGSDSESAGTSTTVVSDGETTVDTASESSSTANGGNVSATVAGTIGGDLFVDTNAGNATVALTGQVGSDIVVDAVGFSGTSAGTTHTDADGYVTTTESTSTPVGGTASLAVNAASLDVPASYGDIDVSGLGGSTVTIGAKSAVLAGAYDTELNVGGTYAATTSSSEFTDPAIGLATYHEEGTSTAVGGPASLTNAGTIGYDNGDDSATLASVTVASVGGATAVNTGKIFGSLSANALGTDTVTTVDQINLYDVTRVDTTVVEYTAVGGNAAITNSGLVTGSVSLAGATGTVTNSGTIGGDIAVGQSVDNYTTTSVDTLTQIGEELVTAQPEAPFTQTYTVNQNGTVEGDIRIGGAFGNYALAPSDGGEVTTAAVDTTAVDADGHPLTSVINATVNLGNNSVTNGGVYAEYDLDTGERFTNTVVNVASTAKLGGGVHGVEKLNKLGTGVFTLTGPSYVAATDVDPAEWTLDLGQFEILTGEVQLATDDGGVFGIRGDVKNAGSLVLGTRQTLVPTPFGSNLTSTATQTIAGVDVYQQGDFVQTSSGSLTVAMMPSLVRVVDPSINGSASSNEPLGVQQILFSQGLFTTPDKAFGSQYAALYAPSSWTIDGDLDLAGTVNVLMPKGGLFLDGQSLDLFSVSGDVTENATVATGTANNFVAFDLVSRTSDGRTIVAVVADRKGYETAAANSNAAAAGAALSAALPGVVADLTADAAGTATFASVQEFALTQDLATVMAGLDSQLTLAQATQALTELGGGSYYGSIATIRTTAPFIDVLSNRRLPEGATGFNLWIQPTGDFVRTSGDAATGASKIRSDNYGGSAGFGVATGSGEFGIGFGYGRTNSHSDDGLAKANADTWMVGGYARQSFGALTVAADLVFGWSNWDAYRSLPTLSRKATADFDSKETRGDLRIEYALQTGGLTVSPFGQLELRHYSFDGFAEEGAGSVGLSVAEASKTVFTPTVGVKLGGEFETGLATIRPEASVSYSFQGDNEADRTVAFLGAPAQNFRLQGVDPDGFVTVQAGLFADIGTRSGVFVRGSYSTGGGNNVAAIRTGVVIGF

SEQ ID NO: 20576 - protein, 368 aa, Vibrio parahaemolyticus
MKKTLLAVALATGFAGAAQAADSVTLYGLIDAGLGYEQVKFKGQSQSRIGTVQGVSSGSRFGLRGSEDLGDGLRAVFNLEAGFGPLNGNSLQSGRLFGRQATVGLDSDAWGRLEFGRQTNLASKFFGSIDPFSVSYNSANMGTTFSAANTMRLDNMVLYQTPSLEGFKFGVGYSFSADDTLDDDSNFATAGNNRVLTTGLQYLNGPVNLALTYDRFNPNDDRAGGKSDARVQQYAIGGTYDFEVVKLAAAFGQTRDGWFVGQNMGTTPDGFNKLSSFMLADGFRANSYMIGATVPLGRSSVFGSWQRATPSNDKLTGDDATFNVYSLGYTYDFTKRTNLYAYASYGKNYAFQRDAKDTAVAMGIRHRF

SEQ ID NO: 20577 - protein, 807 aa, Vibrio parahaemolyticus
MHCSNKCFWRHAFPKKFCVALQAGSSQPDQHCEIGLAMKTSTPNLYKRSITIPRRYCLTRSAQSALAMLLSLGTAPAMAQVFIENDEVVNVPGTQASPWNVGEVLVVGSNGSGELNINAGGIVNADGLQIGGPGSTSKVTIGAGGQINLNNLTVVGFTGEGELRIEAGGILRDSMGYIGFNRTAPGRVHVTGTGSRWENDAGITLGYSGEGLLRIANGGVVSTPFLTIGEFRNANGTLVIGGMPDAAAEVAGTLDAPTVWFGFTSGQIIFNHLNDDYIFSPLVFGTGDVYQMAGTTILTGANEYFGRTTVSGGTLAAGAANRFSANSDYTVTAGGTLDTRGFQQTLLSLDNGGTINIASSGLNNVLTVSGNYNGHSGNIILNTALGGDDSATDKLNIQGDTTGTTTVNINNIGGVGALTGTGIKIIDVAGASNGTFQLKGQYRIDNLAAMVVGPYAYTLQQNGVGIPADGGWYLHSRYQAGVPTYESYPQTLLALSSLPSLQQRVGNRMWAEPDASAAATRYGSGKAGTGMWTSIEGRRDNINPARSTSAADYNTDIYRIQGGIDGLLYADESSGQLIAGLSAQYANGRSAVSSPAGNGRINTAGYGLGASLTWYGNNGFYADGQVQANFYNSDLSSPTAGISLAKGNDGRAYTASIEAGQRIQIEPGWTLTPQAQLSYSTVKFDDFTDGFGARVSLDQGSSLRARLGLSLDHEKVWRDGSGKANRQHTYAVVNLYNEFKDGTQVNVSDINFVNRNTRLWGGLGVGASYSWADGRYMIYGQGSVNTSLNNFGDSTSLGATVGLRILY

SEQ ID NO: 20578 - protein, 187 aa, Vibrio parahaemolyticus
MKSNVVTLVGLFSLATFSTLSYAADSKDHGVYVGANYGYLKVDGQDDFDDDSDAMQALVGYRFNRYLALEGGYIDFGSYGNNLANAETDGYTAALKVTAPITDRVDVYAKGGQMWYSTDYNVAGFHGNKDDEGVFAGAGVGFKVTDNFLVNAEYTWYDVELNAENVFDGANTNTDFKQASLGVEYRF

SEQ ID NO: 20579 - protein, 379 aa, Vibrio parahaemolyticus
MRHSARLLACGALCVTAAHAHAQSSVTLYGIVDTGIEFVSHASAKGGSAWRMPAVTGELPSRWGLRGVEDLGGGYRALFALESGFNLRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSGSAMLKYDAERFGVAASYEEQRGGANAAANFFDGAAPMPIASSADKDTRAHVSAYANAGPVKLGAGWIGRRVSTDAPAASDVRTDLFFVGAAYRATPFVTIDGEAYRIVDARHDARATMATLRASFSLSKRTAVYAQTAYLWNSAHARYSVSGGGGGTTPAAGVGQLGAMVGVRHMF

SEQ ID NO: 20580 - protein, 107 aa, Pseudomonas syringae
MPTVLRTVLSYQRPDGLYIAPSLDWTPVGGFADYANTVRTPGYALLGLQAGMKLPQGFSVYVDARNLTDQRYISDVAAVINASSPANQQIYYPGDGRAIFVGARLTF

SEQ ID NO: 20581 - protein, 799 aa, Pseudomonas syringae
MLTKKLKTILLSLAVFSGGVSFAQSNSAPVYNIGQINVGAQQASSKQKKIEKRYHRATLKLKDKTIFKSAQTIKVIKKDQLKVAGPTGSASQVLSYAPGVTISSFGENGSRKFSIVLNGIRQGWGGFTGATGIDNGSLGITFDGVPLVNPSTGLWQSNQIPQLDLIQGIRVIYGPGNPESRWYNDLGGQIQFIPLQPSKYMGGFFDLSYGSFNSRNLFVAFNTGDIKGWRTVVAAGWGADNSYVTSVDGFRYPGHNYAYYIKTKKVFADGDGDFSIGAYAAQSYYWRNPPIPVSPQQGLTADGTPNTPLLSQSTTGFYSAPDFSVLHKLDQNGLDLVYSKLNLNFDKNTKFHNMIWFRYGFRRHNHYTGYPLGSNPGNLYEYNNPYDKVFGDKLWFELNNIYHNNIAFGGYYLVSNYNSRNAFWNPSVELAPGIYGSPTVPNAHYRSNYWNQTDIASFAEDTIKFYKFTFTPGIRWVDFITDYNNETCTDFPLACQLNPNGNQAQYPSTHTNFTKLEPSFDANYEIIDGISVYGNYAETYKVPENGGGGGPYQAVPASELHLEKSQEYQIGFKVLKQNLKYANKIFAGVNYFHMIFSNLFYPIYDSNGNYLGDGAGTSVYKGVNLFADYYPIKHLYLWTNATFEDAKFPNYTYTNVNGNITSANDLPVSYVPDTLFNLGVSYSYLINYLHGIITKPSVWFQYVGSQSMFNNNTGLPDTQKMPSYNTLNASISFDILNTARSIPYFKDIQLTLTALNITNKKYNEFEYISSGSYYSVNGGYVQAYPGAPFTVYGSIKADF

SEQ ID NO: 20582 - protein, 453 aa, Pseudomonas syringae
MKKSTLALAVTVAALAQQAGAAGFLEDSKASVSSRTLYFDNDQREPGSANNRETATGLKFDYLSGFTQGTVGFGLDLQGLVGVHLDGGRGHHALNGGITPSDSDGSSVGEWTRLGANGKVRFSKTELKVGNALAPNLPILVSNDGRLLPQAFQGGILTSKDLDNVTFTAGQLNKSIGRASSNWTDLSVAGASETSDHFRFAGADWKVTKDLTLQYYYANLEDFYKQHFLGLVHVYQISDNQSFKTDLRYFNSSSDGKNSDAATGYRFNNNSGYAKKTGEVDNTTWSAMFTYSLGGHALMVGRQQVGDDGGMVYLGQGNVTKNGTSTSSLEGNGGSSFYLFTDSMINGFNRAGENTTFGQYSYDFAKLGVPGLKASIAYLYGDDIKGARGTTAFGNEYSEWERDMRVDYVVQSGPLKGLGTSLRRGNYRADGGLNNAADADQTRLIFNYTYNFM

SEQ ID NO: 20583 - protein, 326 aa, Pseudomonas syringae
MWTNTFQEGLKIVGENISLSLPDGRQELFRLTDGAISSDATTGTLSKDQAGWRYDYRDGTSSLFDVQGRLIQRKVRGQVITITYPNLSTTKAKDGFGNTLTVSWNATKQPYLVDYNGSLKVEYLYDGGARLVSKKTTSQGLNRTRKYLYADSGNAGLMVGIIDEQGTRYATWTYDNQGRAISSEHANGAEKVSLAYNDDGSTTVTNEYGKQATYRFQVIQGIKRIVAIEGQPSPNCPSSNSTFTYDDQGLLTSKRDNNGNLTTYQYNARGLETSRTEAAGTAQARTITTDWHPTLFLPVQVSEPGRITRYQYDAEGRKTGETVTTR

SEQ ID NO: 20584 - protein, 471 aa, Pseudomonas syringae
MKTTSTALLALSLSSFGALVQAEPASQTFIPTELSSKNAQADANGFIEDQHLTGTTRNWYANELKRRGEVFRYNDNGIAEQTSRRINWQQGTIVNYTSGYTQGVVGFATELALYNAIALDRDTDDFAGSSNRTLAHRDGDAVGQWSKMGLGNVKARVSNTVLTMGRQSVNTPVIAFIGNRALPSSFQGVAVQSDELNNLSFQAGSFDRVSPRMEQSLDKFRSEYGDRSQTADRLDMFGADYKPTDSLTTSFYASNLEDFWHQYYFGFTHELGDSKALALSTNLNYYKTKDSGQSKQGPIDNDTYSLSFTGTHNAHSISLAYQQVSGDEYFDYAHDTNAIFLANSLLSDFNGPNEKSLQIAYVLNMAEYGVPGLKFNIYQARGWDIDGTKYKGNVYGDVQTINGVRTASGVNAMDGETHYEYGIGTSYSVQSGPLKATAIRATYTTHRASENQADGNINEFRLVTTVPFNIL

SEQ ID NO: 20585 - protein, 754 aa, Pseudomonas syringae
MSRSKLAKLTCFAAASATALLCAQAAFAADATADAAVELDRVTVTATRSEKKLQDAPVTASVISDQEIEDGLVKDIKDLVRFEPGVSVRRAPSRFTAAGASTGRDGNSGFNIRGLEGNRVLILVDGVRVPDGYAFGAQNMGRGDYVDLDVLKSVEIVRGPASALYGSDGLAGSVNFFTKDPADLLTSSKAFTLRGKVGYASADESWTESLLAAGQTGDWEGLVAYTRRDGEGQKTAGTNDSANTDRTTANPEDDQSNALLARVVYAPSDHSRFRLTYDHLDRDVDWTVLSAIAKPPLASTGVLGLTAFDRMKRDRVSFDHRYTGGEGVIQSATTTLYYQNSTTRQFSAEDRNTAADRTRDATFDNEVWGAALELHSQADLGGVTHRFVWGGDAAITRQEGVRDGTVPPAGETFPTRAFPTTDYTLAGAYAQDEIAVGPVTFYPAVRFDYYKLEPKKDALFTANVPASQSDSRVSPKLGAVWKASDLVTVFANAAAGFKAPSPSQVNNGFTNPTQFYMSISNPNLKPETSETFELGFRLNRARWNASVTGFTGKYDDFIDQVQVRGSFSPTDPAVYQYVNQSKAEITGAEARFAAELGRGFTLQGAASYARGNAENAGKKTPLTSIDPVKLVAGLSYRDPAGRFGGALNAVHAAKESAGRSGVSCSMTVARPAPLPPLTQTGPDYCWMPKAFTVFDLTAYWNLTGNVTLRGGVFNITSQTYAWWSDVRGVADTSLVKDAYTQPDRNYSVSLAVKF

SEQ ID NO: 20586 - protein, 130 aa, Pseudomonas syringae
MIPIPDSALSGGNGWYNYNHPDYIKNVQDNLNAIQKEAKFKHHSYNLGVNFDPINWLRVQLKYSNGFRAPTSDEMYMTFKHPQFSLAPNTNLKAETAKTKEIAFTFYKDRSYFTTNIFQTDYRNFIDIHS

SEQ ID NO: 20587 - protein, 440 aa, Pseudomonas syringae
MRVMKWSAIALAVTAASTQLATAAPFVSDQADAKGFVEGSTLDLKLRNYYYNRDKKAGADDDRDWTQGIWANFSTGYTQGTIGVGVEAFAYAGVKLWGPDKYSGSGNLITDSAGNNEDTQAKAGGAVKFRVSKTELKVGDMQPTSPVFAVGGSRLLPQTASGISLQSSELKGLDLEAGHFYSGTSQDDTSHGGSIFANYAAVRANSADFAGGKYAITDSLGVAFYAAKLEDIWDQYYGNVNYALPLGGDQSLAFDANIYRTVDEGSAKAGSISNTAFSGSAAYSFLAAHTVTLAFQKINGDTPFDYIGIGDNNRGGDSIFLNNSIQYSDFNGPGEKSWQARYDLNMTPYGVPGLSFMTRYIKGTDIDGTKTPAGSAYAGLYGADGEHHETNLEAKYVVQTGPAKDLSFRARQAWHRANADQGEGDVNEFRLIVDYPISIL

SEQ ID NO: 20588 - protein, 808 aa, Pseudomonas syringae
MPGPAGTHVFGVVMHTHLSALATAVVAALLASPAMAQTAAPANGPANTLDTVIVTGTRVSDRTVAESQSPIDIISAESLQATGTPELATALARALPSLNFPRPALSDGTSAIRPAQLRGLSPDQVLVLVNGKRRHTSALLNLNGTIGRGSAAVDLNTIPVAAIARVEVLRDGASAQYGSDAIAGVVNIVLKGAEKGGSLQAGFGQYSAGDGNNYELSGDTGVAYGGDRGWLHVAAQLNQQDPTDRARGYAGAPSASQPAVGQKAFKIGDPEVDAQAVSANTEFAFSDSITGYAFATASNRDITSFAFFRAPGSTTQNILSVYPQGFLPEIQSDAKDRSLVAGVRGSTASGWDWDASYTYGDNRIDFHTRNTLNVSLGPTSPTSFYDGALETTQNIVNLNVKRGFDWGLAYPVTVAFGAEYRNETWNQSPGEVGSYFQSGTLAGGAQGFGGFAPSVSGQYSRDSHALYADIEADFTDKFSAGLAGRYEDYSDFGSQASGKLSARHAFTDKIALRGTVSSGFRAPSLAQQYFQSTSTTFLAGNPNPFEIRTFPANSTVARALGAEPLDAETSLSYSLGLVLQPTDALYLTVDAYQIEVNDRIVLSSNLTGAGVRNLLESQGIFGINGGRYFTNAVDTRTRGVDVVGSYRWQLAASSLDLTAGYNYSETEVRSVAANPAALSANGLSLERIDRTERGRIEEGFPRDKFLISGSWNLEHWTLALGATRYGKFSTRPADASNDQTFGAKWVVDASASYKVDRWTLTLGADNVLNEYPDENNVANSTSGQFPYSNLSPFGFNGAYVYGRINYRW

SEQ ID NO: 20589 - protein, 243 aa, Pseudomonas syringae
MNRTFQLSSSLLVLAAICGAMGSAQAADLEAAPVITKAPVIEAWNPWMIRVRALGVLPDAGGSTLNVTGVPALSSPNSSLKISNQVVPELDISYFFTRNIAAELILGVTRHSISGTGALDGLNIGKAWLLPPTLTLQYHFTDFGAFKPYVGAGVNYTVFFNQSAANQVVNGLAVTNLKISNQWGAAVQFGFDYMLDKHWGLNVDVKKLWLQPNYSATVNGVIPVTGRANIDPWLVGAGVTYKF

SEQ ID NO: 20590 - protein, 875 aa, Pseudomonas syringae
MSISSLRYLLPVLLLPVTTQITYANQAGSEHSDADTLEKIQIRGIRGSVIKSINTKRTSVSVVDAITAEDIGKFPDKNVAESLQRITGVSLTRVQGEGERVGVRGTAPSQNQTYINGQNIASADWWISSQPNRGFNYTMLPSEIVSSLEVNKAPEADHDEGSLGGSINIKTRKPLETENHMFVGTAQMQYSESSEELDPQLSLLYNWINEDDNFGALISLIRHERHLRRDGLESWGWAERNFNIDQQGRLSQTQQESADLQDIWSPGGGGSALFEQHRVRSSAMLSLQYQPDLDWNIEFETLYSQLDANNSNQNFLWQPSTVYGRGGKISDYQIQDNTLTSATYSQVPTDNPSGIPFSTAMEAIWRESKIDTSIYHLLVEHEFDYWKSQYQIGYTRASGGTSGDFTSQWSANTDFTVNTQTARDIQTQYTTSPLQGDAWAISEVRQDSHNSVDDELFAQIDFEHQLDREFIDSIKFGVKYKRHTRDFIRYRSRNGGYQGLAGDLGWTLADFPANFPDNYLEGVGSLNTLKRYAYADTGALNSAYNDLNFIRTEEKPSSFDIKENSYAGYTKVNFSGDSYRGNLGVRVVHTQQTASAYQQVPSDDADNLEYLWSTSDKSYTDILPSINIAMDWREDLVFRVAASKVMSRPEYHHLMPSTNYNVTQAQGAGGNPDLDPFRATKFDIALEWYFDEAALLSIALFHKDVKSFIDIKRYEEEYENIEMIINRPINGSGGTIRGAELSWQQEIIYGVGIIANYTYIDGERKDSETGEHIKIPGHSDHSANLTSYFENDWLSTRLSYNYRTDFATGIGEEVSDDIGQLDLNLSFMLTEQLSLVFEGINLTDEIIYTYERNQYAPVGIYRNGRRFYAGARFSF

SEQ ID NO: 20591 - protein, 799 aa, Pseudomonas syringae
MHTSNALSLAISVALTVCSFAASAQSQSAQPQKTLDTLIVTGTRVSDRTVAESESPIDMISEESLQATGATDVATALGKLLPSLNFPRPAISDGNDAARPATLRGLSPDNVLVLVDGKRYHTSALVNYNPYVGRGSAPADLNSLPMSAIARIEVLRDGASAQYGSDAIAGVVNIVLKHGAGTGTNSMSVNGGIMDKGDGAQNGIDGSIGLPFGTTSGDTAPGWVRLSWNYQNSMDTNRSENTNRATTLAGAANPSGVPYQRHGDPDARFYQGLAAFGYDVTPNLELYGHLSVSRREVTSNGYYRAYDNTDRNVQAVYPNGFLPQIYNPINDRSAVLGVKGATASDWHWDVSATYGKNDMTFNILNSINSNLYWSTGRSPTNFNSGGFETEQGTLNADFNKSFDWGLAYPVNLAFGAEHRQDRYEIVAGSPASYFFDPDTINPDTGSPYPGGAQVFSGLEPSVAGRFGRHSNAAYAALEADLTDKLSGGIAGRYENYSDAGATRSGKLSARYAFTDTFSMRATVSNGFRAPSLAQQNYASVVTLPENGQLIQVGTYRTSDPIAVQLGARPLSPEKSTNVGIGSVWQPIANFTSTLDVYQIRIWDQILYSDQIQLAQPIGQVGAVQFFVNGATSRTRGVDWVNSYLADLGAGGSLNLSASANYNKTTILELSNPNFGRASEGLLTESTPRTKYMLAADWTLGGFSLNGNATRYGAIKRISDPADGSQDQTYSARWILNLAANYTWQALTFTVGADNVTNQYPTKAQLTNGYDDRASGLQYSSLSPFGFNGRYWYGRVTYRF

SEQ ID NO: 20592 - protein, 1052 aa, Pseudomonas syringae
MRRTLNSFKSKAMFTFVGGLLVVNPAFAQDVAPPPAPAPQSSSASATTLDAVNVTAIRNSLNQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEAITGIEVFKTSRATAPSGGIGATINIQTDKPFNHDGVVANAGAKMVSDRSEPFGDALTPEVSGIFSYTNPEKTFGIGLSASYQKRHGGSVQATENAWNIQRWTGTDPALRPDAVVTNAPAIGQLYGMPNDLRYAFADFQRERMNGQAVMQFAPTDSLTLTLDYTYSANEIREERGEQGIWLQRANSFTDLTFDTGQAVATPVYLRDVPNGAKDFGMEQQRNEQKYTLGSLGFNADWQVSDRFQLSFDAHNSKTQSLPNDPTTGGSATYFSFAGTNNCTNGPYCGGQWGQELWFNNSLPIGARTWYPTAADSLANTNGVVNPAFTPAELGSQVLRIFYQKQVTETKEGRLDGKFDFDDGRFQFGVSSTNTTMQRRISDTNSPLGDWGVANAGNEPGMVALLQPVSITGMFKDFNPTGAASSAWRGDADQLALWGGRQYGATTRYNPQYTADNRVEEKTRAAYVQLEIAGAIAGMTTNTRLGLRYERTDVESTSQVATPTALLWLSNNDFELIRSTDQQPFSEGTSYNYILPNMDFSIDFTDQLKGRASFGQTIARAPYNTLIAGPTPNTPNGSILINPSNRAGGGSQTPTLNPLESDNLDLALEWYFADASYISATFWNKRVSNFIGNTVTRESLYGLTDPTSGPDAQSALAFLQSGACAAQVRAAGNDVASACSANDTSLFAAMALLRNAAATGGLNAYNGSSAQSLTLENAYDIAGNASDPLYQFDVSRPINQNKANIHGWELGGQYFFGSTGFGIYANYTIVQGDVAFDNTVIDRDQFALLGLSDTANVMLMYEKYGWSARLAWNWRDEYLIAANQDNANRNPYYVEPYQQFDLSVSYAFNKQLSVGFEAINLTGEDVRWHGRSEKQIIRLIDQQPRYTLGVRYAF

SEQ ID NO: 20593 - protein, 758 aa, Pseudomonas syringae
MTQRHRPPRTVRPARQALPSAFDGTSSHLATAVQKAQRFAFACTAWAALAAPGLAQTANQADEANQPRPPASAGADAATLPTVTVRAEATMPVYSGGQVGTRARMGFLGDKDFMETPFSTITYTEQFIADQQAQDIQSVISKTDPTVFTSGIAGEALESYSIRGFSSDVGDVTVNGLSGMAGYYRSSPEMFERVEVLKGPSALLNGMPPKGSAGGAVNLVTKRAGDEPLTRLTGTYMSDAHFGGHLDLGRRFGENKQFGIRFNGVYRDGETALNDQKKKISQAALGLDWRGARARIFADLYQSQERGNGLTRGLTLAPGLPVPKPPKPDVSWNPPWSFFDLTDKGAMLRGEFDLTDQLMAYAAAGVSKSEVDTLMGLPQVFNQAGDFRINYSGVSDRMERKSAEVGLKGKARTGSLGHQFALNATYYHEDYLLRGFRNVLPQDWLGNIYRPVWGPEAARPGTIPALTQTDTRLSSVGLADTLSFAQDRVQLTLGVRRQEVVNDSFNGTTGARIGERYKQSATTPAAALVVKASDHISVYANYTEGLSQGAMAPNTAENAGEVFAPYKTKQKEVGIKFDLGAFAHTLSVYEIKRPGSYTDPVTNVFSFGGEQRNRGVEWGLFGVPMRGVRLMGGIAYSDARVTKAAVAANEGKQATGLPKWQAKLGAQWDVPAWQGLTLSANATTASRQYLNADNSLSVPGRTVFDVGARHATKVSGRPLTLRAAITNLTNKAYWAKPHYTSLALGAPRTLYVSATMDF

SEQ ID NO: 20594 - protein, 789 aa, Pseudomonas syringae
MKKSKLSIILLILLSSPLYGKENNQDKSQEKETSNDVITVKATSIKNKETFSSLLLNNREEIKGKQLEQIKTNTIGNTVSKVAGVQAEGFGPNAARPVIRSLSGNRVGILVNNLPINDVSFISGNMPIPVDMNRINEISISKSSEALLYGGSSSGGAIHLWDDRIMTQFPEKAISGAVTFNGSTNNGNGGSVNIKFSNKENWIFNLSGATKRVSKYKIPTRSKVGACYSYQQLKDHSALRDQCQVDMKVFTSRNPEAYPYISEFWKKYQVEYELSEDDKYTFKDKDYFSGIGYVDNEPNLRYKPGSPTSIEHVTPPKHYVENNNNEIPNSFLKSQSGNASLSYIGDDGYLGFSVTDFQTSYGVPGYAYLTTKTTRERYKPVSVSNSNRRIDIQGKHDHLAPFLRDSAFYYSYSESKDEELVGQIASSVFNTKSHQLALETAHTPLFNRLNGAFGINGNYRDLKTSGYDAYLPSVLTKEYGIYWVESLNLSPFELTAGYRKGYTQHNLNIPANYNRGRGQGSNLQNRHFDTSANTLALSFTPIDEWTLKLQQNISYRAPEINELYTHGPHYAYLIEEQGNSEFNTEKSKSIELSSVIEIGNFSNKLNLYKTDYSGFKFRRLTGISRGAGPVMEWDDTDLETKGLEYEFKYLYEMPHDHNLTFTLFGDFVENKSKRKLFIAGHYLPNLPNEKHGISIYYQHDELTAFSSATYYKKQKESGGLMYGGDMAFPSYTLVDAGIGKKYHLDKVDVSVDFIINNLTDTEARPASSQLKYLVPLPGRNYGINVKIDF

SEQ ID NO: 20595 - protein, 763 aa, Pseudomonas syringae
MYRQPHIKPLVVALGAAFAALVAPAALAQGVATERELNAVVVATDGARESLDPTLPSSSHSTTRKELENQSFINTEDALTYAPNTAVRKRFIGDRNANLAGRSFGTLQPARGLAYVDGYLISNFLGRFDAPRWNIVAPEEVARTDVLYGPFSALYPGNSIGTTVAITTRMPTEPEASARVLAYRQRHKDYGLSRDYGGDEESAYAGRRWGDLSLSLSVNRLAYESQPMAYASANPVNANVAGLPAVSGAVHDRDPSGRARTILGATGIQEGVQQQAKLRLAYDITPELQADMLVAHWRNDYRVSNETLLRDAAGNPYWRPASGSSAVNIDGLRYNLPAMQPQRGEDEHLQLGARLRTLREHGWNHSVQLSSYQLQTDSLRQANVSDPYARGAVAGTDTRRDGTGWTTFEAQTTWTPESRLGHALTFGYHRNVYELENRVYALSDWHSSSSRTGETQNYLGKTEVQALYAQDAWRFHPDWVATAGLRLERFRAYDGEQFAAGTRVGHEDRKASAASPKLSLAYVVDDYWLLRASYGRGVRFPTVSELFQGTVSNNTIYNNDPDLKPEKSDAIELTAIRDTGAGSLRVSVFQDNIRDAIFQQRQDVGGVTVNTVQNVDRVRTRGIEFAWQGSDLFVDGLDVQASLAFNRALTLSNPAVPASEGKNFPRIPRIRASVFGSYTQGPWTASLGVRHSGKQYNELDNSDRNSDTFGAVSSFTVTDARFVYRFSRQARLAVGVDNLTDERYYVYHPYPGRTAYAELAISY

SEQ ID NO: 20596 - protein, 703 aa, Pseudomonas syringae
MHPSKKAFKLSLFALLLITNLNAQESNEAINLQKVVVSATGFEQDADSNLRNVISIEGKDLQNKGYVSLEQALERISGISFVNFGLGRNIDMRGQGDKSNIAVKVMIDGRAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYIDINDNSDLTLGYNYFKSKNTSSGYLTKAQAQSDPTQKGKSDNITQINRPEISLDYHYYFDDIWEFNLEAFWQNQKINYLKDVSTMSYGSMSLPVYQNGSGFEDTLTGISLKNKLNYANNSYFIFGYEFANHDAKRTSIIHYDVNTNMSHTMTTLMNMTKQSHSIFALDSHEFNDIFSISGGARYEYSLYNTNRNYTSNMIMSQRPIIKTELFSTDDTNHNFAFEITPNFKYSDTGKLYIKYERGFVSPSPAQFVNKDKNSQKYYSANLNPEIFDTFELGIDDFWWDFYGFNLTLFYTLSKDEISYLGNPHATGGGFWQYYNIDQTRRLGVELSLSQNFLDNNLIFRESLTYLDAKISKGVNDGMRIPYISKIKATAGLEYAWNKNFSNFIDLTYFSRAKDGGTIDENTGKMSKNSWIRDYFLTDIGMKYKYKKLQILTGIRNLFDKRYYTYQDGINDQYLVGNGRNYYVEFKYAF

SEQ ID NO: 20597 - protein, 138 aa, Pseudomonas syringae
MSGTLLAFDFGTKSIGVAVGQRITGTARPLPAIKAQDGTPDWNIIERLLKEWQPDEIIVGLPLNMDGTEQPLTARARKFANRIHGRFGVEVKLHDERLSTVEARSGLFEQGGYRALNKGKVDSASAVIILESYFEQGY

SEQ ID NO: 20598 - protein, 536 aa, Pseudomonas syringae
MAVSAHAQLANNLAIDVKAMSMGHAVTADPPGVMSIHFNPAGLARLDGRRVDLQFVGADFSLESEFSAPPDYNVFGFSDDPVVCDDVPDDGVDFCRNFKTATSSVEGISLYIPFINDTVDLPPGPLIAGPLPAFSIRPAGSKFTFGTATYLPMAAGFYRDEDDVGNYMGERVALERITYLSPSVAYQVNDELSIGASIGMSYQAIALEQDFRAPNELLGFARVIDESICAPFAGESNIALDLILFGICNPDEGLGPFKNLASLEVSMDQRFSPSYNLGVLWEPNDRFAWGAVWRSEAKTHMKGDYKISYSNATQETVNGIGSSATGALALAVLGIPSRIGSEEVGAVSMDLTMPATFQTGIKIKPTERLQFNVDAVWADYKEWDAFNIVFDRSSAVLSLARLFSPGSTSTQLSYPLNFQSTWNLAFGAAYDLTGRIQLRAGYEPRASAIPEDRRSPMVPINEARYYSLGMGYKWDKDTDIDLGIGMLHSKDEIPADTSCAANCTGIDNVVYNPYAGLDIKTEARIMMVGLAFRTKF

SEQ ID NO: 20599 - protein, 443 aa, Pseudomonas syringae
MERINRATPFVAGFCGLLIAQQSFGEGFLEDSKASILARNFFSNADNRSGAADPNYTQEWGQGFMLNYQSGYTPGTVGFGVDALGQLGIRLDSGKGRHYNPQSTAFNGNIFPTDSDGRAVDEFSSLGATLKARVSKTELKYGTLVPMLPVVMSTDRMLQQTFRGGQIQSGDLKEFTFTAGQLEHVMGRGSTNQMGMSIPGANNPLTGEFVNKFYYAGVDYKPTKDLTLQYYYGNLENFYKQNFLGLKYDMQLGPGTLRTDLRHFDNRSDGANGHDPAFYTVGYYGNGVTKGEVDSRLSSAQFTYLINGHTFAAGYQAVTGDSDAVWLNQGDGSTAYFVTESMIGKFQRAGERTWQVRYGYDFARLGVPGLKFLAMYESGSNIQTSDGDKKEWERNVTLSYVVQSGPAKNLSVALRHAQLRTEFASQRDADEHRIIVSYPINIF

SEQ ID NO: 20600 - protein, 745 aa, Pseudomonas syringae
MGNRTESGLIRGLKWGRNPLALAVAATMAASPVWAEEQQDADELQTIEVNAEQSDDVYGGDDFGYVGQRSLTATKTDTPVKETPRAVSIVTREQMDDRASVSIADALQYTPSIQANFYGEDNKQDWFVIRGFKQANNGLYRDGTRVYSYGFYSWQLDPFAQERVEIMRGPASVLYGQTPPGGVINVISKRPQDYSFGSVTAEYGSYDRKQLSVDVGGAPSEDVSWRVVALGRENGTQVDDLEAERTMLAPSLKLGLGDRTELTLLASYQKDDSDPYLQFLPSSGTISANPNGKIDDDVAIGNLDYEQFERTQVSFGYQLDHAFNDSTTFQQSARYQQIDVDLKQMYSLGYLPGSGDSQAVRGLSDEDGDAYGINLDNRLIHKWSINNVEHTLLAGIDYQSLHIDGKSFGDPLMGYEAAPGIFAPATLNPFDPQYRNADELTPVSCNFSTFVCTEVTSRQRTTIDAYQVGGYLQDQMKFDNNLVLTVGARFDRASSDIENKTTGVEQNIDNDKWTANAGLAWLLNDNVTAYTSYSQFFQPILQQDQNGDAAKPQEGDQIEVGMKFQPQGIDGYLNAAAFKITQENLASGAAGTPAFQQIGEVESEGVELEAVANITPSFSLLANATWMNPEIVSDSTPAEEGNRPVNIADTLYSAWAKYTFLSGPMNGFAIGSGVRYVSDTYGDNTETLKVPSYTLWDATVSYRYKDFKFQVAAKNLEDKQYVATCDYYCWYGDRRNVIGSVTYAW

SEQ ID NO: 20601 - protein, 204 aa, Pseudomonas syringae
MYSTINIAPQWELNLKAYAQVSPTKQDNVQIDGAYNSDYTSKFLGLSANAGRVFDLSDNTLFIKPFAGVNYYFSYTPSHTENGAIAKDIDSMKNNSVSVEVGAEFRKYMNENSYIFVTPKIEQFVINSGDDYTANLAVNNAFFTSVEANNKKKTYGQIIVGGNVDFTNQLSMNLGFGAKQILAGKVDNKNETYLSGQVGLKYKF

SEQ ID NO: 20602 - protein, 776 aa, Pseudomonas syringae
MRRHLLATAILFAVHSAQAADEPTLPTLQVQASQPSRIDSRVTVDNPQAQNRTLGGLLEHVSGVQNSAFGPNAGAPVIRSLSGNRVQILQDGQSILGMNAISGDINIPFDPLFVRSVTVNKSSDTVRYGGNAIGGSVEIDSGLISRRMEDKDQSMELVLRKGFNAADAQGFRMNFNNQRNFSTNLQVSRQRISHYDIPGNSKASVCNTRLFPPTGGVNSALADSCQKEARVQQIYNKASQPYIDQFMTENPDWADGDFSFYTNNPTSVWQRRTYINPVNPAYVAGTPSYVQKQINNDVTPDYHHRLGNSYARNSQVALGSTLFFDRGYVGISIDAKDSEYGVPGFSMQNLSFGSNYANGLPVGVVIKQERYALEALLRDPLPWFERAELRVSKLDNTSGERLGATRANDYDFESTQAELLLSHQRVGPLSGMLGFSHQSRDVTGSGSLRYLPDVDTRSNAVFLKETLDFGWASFDAGMRHERVDHDLQPSRFKTARNAANAKLQDRDYRLNSYSLGSYVELGPLFAAKVRYSSSQRAPEINELYASNAHYSVMTQEEGNQNLEPERAKNLELTGLFHLGGFELSATAYRMKYENYLYLGYSGMQTANRLPLKYWKQTDTTVKGFEIDASQALDLGRYGTLNVSAFADVVKNKADHPDSLRAHNDGEYLPNMPTNRYGATLQWQREGWKARLSSTYYDTQKYLGRNVSEEVPLDAFNLVDLQVSRELPVRNSYIAGMEVFVNGSNLLNQEARPHNSPLKYIAPLPGRGFQVGVTVKL

SEQ ID NO: 20603 - protein, 832 aa, Pseudomonas syringae
MALPAHAPRHALRKPLIKSIALVGLGLMNPAQAADETLDREARLEKVTVISTGVRGTQRTVTESPAPIDIVTSDQLLKTGRADLTEAIAKLLPSFNYGTNVAGYNSTIRPLSNRSLAPAYTLVLVNGKRRHNSALPANGSTDSSGANSVDIDMIPISAVERIEVLKDSAAAQYGSDAIAGVINVILKSSAEGGHLGVTYGKLYSGEGEVSKFEGDTGFELGDGGFLHLSADARKRGDASWNEKATNNAYFPGDPREATWDRVGVKNGDPQIKAFNLAYNAELPLDDQTTLYSYGTYGQRDAIINNYFRYPNSNANIPELFADGYYPLNNLDDTDYQYLIGAKGEALGWNWDLSTTYGRNNNHQYSDLTINPSLGPASPTSFDDLATYRFEQWVNNVDITRAFDGLFGVPLQVSAGLEHRWERFRTFSGDAQAYQVGGYRFPATLPNGQANPLAGQLASIAAQAAAVISPQDATSLQRNNYAAYVDFGITPIEPLFVDLALRAEHFDDDSGNTVSAKLNSRYEFTDTFAVRGTVGTGFRAPSLTQVGYSISDNRVGAAPDGTIVPAVTRIAPVNSALAQALGATTLDPEKSRNLGFGVTWQPAPRTSLTADAYWIEIDDRIARTESLYGPALAPILAAQSVDTSTWTSYYANAFDTRTRGLDIVLDHSSQYGAWGNVRWSAGFNYNKTIITDVKDAPAALQGLGSNPGGSMTWVGRAREGDLTDAQPKTKWVLGGKWTLGDLGVNLQTTRYGKVKTLQQLESGDRSFGAKWITDLDVSYTLYDNITLSVGGTNIFDVRPDKNAIPSAVGLNLYGNSPFYPGGGFWYSKIAYDF

SEQ ID NO: 20604 - protein, 356 aa, Pseudomonas syringae
MKRLSKIMCAVIAASGLASAPSIAATTYVGAKVGMGWLDSACVDGTKCDDDAIGAGIYSGYNFSDKFGIELSSDFLGDYKTSFTKNGTTSQFSDPIIAISLTPMYRLAVQQEFDVFFKAGPAYISHGGEDDVVLSAGIGLEKQLSSDWAVRVEYQYFDDFDDNYVQDLNSNLLSVGVSYNFGTGNTTASAVAATASAVAVTQAPSEPITEPAVVVEEKMAVVVTKAQTESYSQEMFATNSTELSTDGKIALMPLVEVLKAHPQSSVAVVGHTDSTGAAEYNLMISKKRAAAVAAYIEEQGIEADRITASGEGEENPIASNATAEGRAQNRRVDATIPGFEYQEEVKVEEVIVEAAE

SEQ ID NO: 20605 - protein, 772 aa, Pseudomonas syringae
MGNFKNYKNRLLAGVATGFVSLCLTGTGASNGFAQSAEPRVLPPVSVDAPRQRAQTTRTSRPRTTSQRAARAVPRRAEQPPAPTAPVSTMGSTRTIGAPAPAYAGGQVAQGGTLGLLGSTSVMNTPFSTVNYTSKLIEDQQARTAADTLINDSSVRLTTGSNGFDDTFQIRGFSVPAGDVGFNGLYGLMAPNHVPAQLVERIELLKGPGALINGMAPSGSVGGGINIVSKRALEDPFTRLTPMFLSSGNYGLHIDTSRRFGDNKEWGVRFNGVGRNGEASIDGGNWRSGLGALSLDYRGERLRWTLDAISQNDDTKNFRPQMTIQGTVPFIPAPPDSRGNWYPGTRLKQSDNTIASGIEYDLTDWLTAYAGVGYRDGRGEQNLADSRAGGTTGMNQFGNFNVFNAYYDFYNKTVSGNVGLRSEFNTGFIKHKLNVVYTGFNQETGYGYVTSVQSGSGYVPSNIYDPSPLPTIAGGRPPQGKSNDVTLRSVAIVDTMSFLNDAILVTAGVRRQNVKQDPYNYLTGLPTGNGYDSSATTPLGGVVIKPWHNVSFYANYAEGLSQGTNVPMGQGFANEGTVLAPYKSKQGEAGVKIDWGRVTTTAAVFQITRPSLITTPAMVRAYDGEQRNRGLELTAYGEILPGLRGMGSVTFMRPELTNPANAAERGNDAAGVPNRTLSAGLDWDTPWVEGLALNGRVIYTSGSYLTTANLLRYPDWTRVDIGARYKTAINGRPVTFRANIENLFDKTYWLTTGTFVTVGSPRTYLVSAAFDF

SEQ ID NO: 20606 - protein, 703 aa, Pseudomonas syringae
MSSRRIASLAGLAIGVFGNTGYAEEHPQTIELESVNVTSDYQYETATSPVQGYRATRSATATKTDTAIQDIPQSISVVPASVLKDLGSNSVERALEFAGGVSKQNNFGGLTLYEYSIRGFTTSEFYKDGFSANRGYPATPDAANIERIEVLKGPAASLYGRGDPGGTVNIVTKKPQREAFTTLQTSAGSWDRYRTALDVNTPLDEEGRLLSRVNLAVEDNNSFRDHVESKRVFVAPSFSWQLNPDTSLLVETEFVRQTSTFDRGVVAPNNKWSGVSRSTFLGEPDDDIDNDNNMVQFALDHQLSDVWSLRLASHYKQGEMSGFASEARPLNADGRTVNRRYRERDNNWHDSITQLELRGHFDAVGLEHEVLIGTEYENYRKNERVTTIAGSPYAIDIYNPVYGQPKPNGARSGTDFYEHIESRALNLQDQIVFTDKLRGMIGARYEHFDQQVDDFTTNATSGQRHDAFTQRAGLLYQLTPQVGLFANASTSFKPNNGLDAVGKTFDPEEGIGYEAGIKSELFDNRLSTTLAAFHIEKENVLALDPGTDTNRAVGKARSQGFDMQFTGQITDAVRIIGAFAYIDAEVTKGDRTIPAGSRILGVAKHSGSLLSVYEFQEGVLRGSDVGAAYTYVGDRSGQSGTDFELPAYQTVDLLAHYKASENVTVGLNLNNIFDEKYYERSYSNYWVAPGEPRNFTVSLTLGL

SEQ ID NO: 20607 - protein, 846 aa, Pseudomonas syringae
MRSNTSTIFQPHSIFVSHKNLIGALALNAPVPRRPAAQSSRLMTGWLSPKPLTFLFTVPMLLGLNCVATAGDIPGFPYVRWLEGAGTNFVNGISGDGSVAVGYSISSNGPRPFRWEAATGTLRYIDGGIEANGGRPEKTNVDGSVIVGTSSSDQAFRWTARTGMRTLGTLQGIGKSSATGVSGDGSIIIGVSENADVQRAFRWSAATGVMTAIDMPADVTSSVANDVSLDGRVVVGEYFTAANVHAFRWTATDGAVDIGTLPGSYGARALATNTDGTIVAGVSRFVVQVPIEVLEDRAGKFDGTDIKDGPVNPDVKMFIDEWHAFRWNAATGSMQPLEVIPNGSGSIPYAMSADGSVIVGNWQSASGQRGFRWTEPGGMLSVEDWLRNNGVPIASDFTSTATDVSADGNIVVGRTRNNTSYIARIVLAVSATADPRTNLDNVDTVTPADPRSSGRQPRGIDPTNRAVTSTTPSASSGTTSSSPSSTSSASASPSGSSNTSTSPATTTSGAASTPTASSVSSPGSAAKTGHSILPARSGIIDLDQYAGTIAARPNAGVGLNIANIVLDGAHGMPMRSLLEPGRQSFSIVSDVGHNDGRDAAGAFGIADIGYGFGLDGGATARIAFGGLYDQRDINTGGDFIHSGFYIAPEISLPLTDGLYATIGGYYAPGRMSIERGYLNGGTMDYSRGETDLNVWAAKLRFDWLDALTIGEWNLTPYAGVTYAKAEMGAYAETGGAFPAGFDASGEQSTIIRAGLDGVTNFSDSIRFLARAEAAYRLEKKTATTTGTIDDLMGFSFAGQDIDRFWLRGGLGAEFDIAGGTASLNVNVTTEGNDPGLWVRAGWKITF

SEQ ID NO: 20608 - protein, 344 aa, Pseudomonas syringae
MKLKNTLGLAIGTIVAATSFGALAQGQGAVEIEGFAKKEMYDSARDFKNNGNLFGGSIGYFLTDDVELRLGYDEVHNVRSDDGKNIKGADTALDALYHFNNPGDMLRPYVSAGFSDQSIGQNGRNGRNGSTFANIGGGPKLYFTDNFYARAGVEAQYNIDQGDTEWAPSVGIGVNFGGGSKKVEAAPAPVAEVCSDSDNDGVCDNVDKCPDTPANVTVDADGCPAVAEVVRVELDVKFDFDKSVVKPNSYGDIKNLADFMQQYPQTTTTVEGHTDSVGPDAYNQKLSERRANAVKQVLVNQYGVGASRVNSVGYGESKPVADNATEAGRAVNRRVEAEVEAQAK

SEQ ID NO: 20609 - protein, 388 aa, Pseudomonas syringae
MMLNFMTKKKNRMQDCKMVGKNFNRKESVLIAQSLDISKKGSVILGALLSSLWLTNLLNAHEKNGTFVGISLEVGRADQKTNAYKNGELFQVPFGDVSANDDGKVPDGQTGGCQPASGTPGTPGYTKANCVVNWTSRTMLSTNKNIPGRNQPMYGLGVMTGYKHFIGKKRWFGLRYYGFFDYGHTNFSNSRAANAISPFYLSDQKADMYTYGFGTDMLFNIIDKPKATAGFFLGVNFAGNTWTNNRVGYFKDGYVYGVNTDADAYMTNADGTITCGDTTPASCNVGINPNSVYTTGKLNAKVNHTIFQFLVNVGVRTNIFEHHGIEFGIKIPTLPNYFFKGSTTIKEQSQGPLKDGKLTTITGAETNFSLTQTLRRQYSMYLRYVYTF

SEQ ID NO: 20610 - protein, 743 aa, Pseudomonas syringae
MHNPSRLTPLSKALMLSQMFRSRPSMAAMGLALCMPVASQAQETAADGSTTTGTVNLAPTAIDSQYLGTATDGTGSYTTGAVSIGKGAPQSLRETPQSVSVVTRQVMDDNNLNSLSKVLEDTPGITFQYRNFGGHVYTSRGFSLLAESFLVDGIGGQGYQITGWMQPDMAIYDRVEVLRGASGLLVGAGQPGGAVNLVRKRPTADNKFSITTRAGSWDQYRVDLDGSGKLNDSGTLRGRMVAAYDDSGSYLDGRDSRTPLLYGIVEADLSDDTTLTMSLRRQEQVINGYSIYGLPRYSNGQSLGLSRSTNLAQKWNRLESDMTEVFTEVAHRFNEDWTSRTSLTYSQGGFDQNIAYARGAVNPTTLAGSNFQGTLFRKDEVDSVGLNSQLEGNFNAFGLDHQVTLGADWSKQDANTHQATVTRRTAVNVFDVDQSAFAKPVRPAWTTDIDTTEERAGLYANTRIHLSEPLSVVLGSRLSWYDYKYDVKTGAANSYESKQTQEFTPFAGLIYDINDNWSWYASYADIFTPQANYVTAGGSPLDPAIGSNYETGFKGELFDKRMNLSMALFYIKQKDVAALDVNTTQTCPTSSDGSCYLQDGISRSKGVDVEASGEVLPGLQVFGGYTFNMLRNNGDADVAYETPKHMLRLNTSYNLPGAWNRLTLGTGVSADSGYEVPSNKQLGVSGKAIWDARASWKLDENWKVSLNAENLFDRKYYSTSIATDRSNVYGEPRSYVLTLRGDF

SEQ ID NO: 20611 - protein, 344 aa, Pseudomonas syringae
MCTDVWGRWSKGLAALSLCATVGVAHAQSSVSLYGLADAFAGVVRTPGSAGNAWEVGAGGLSTSYWGMSGAEDLGGGTKAIFTLESFYRINGGQSGAYNGQSFFGRRAFVGLSGQFGQLTLGRNDSLLFVSTLLFNPFGNSFVFSPMVVHTFVGSAMGAASVQSDTAIDNSMVYQSPEIGGLTGSVLYSNAGIAGHAGQANYSANALYFAGPFSATAAVQSLHTASLFMNGATQQTAWLAGAAYRLEAVKIYLQYERVSNNNELTDDTVQVGASAQAGTGSILFSWAGTLRRPAQGADVRWSTVVLGYDYPLSKRTDVYAAWRYDTMTSVSSGNSVGAGIRMKF

SEQ ID NO: 20612 - protein, 445 aa, Pseudomonas syringae
MVSTSRFSLRAITLAVAAASAGFSLNASASMGNIGTTYGVMPVDVATAQSLSMFNEQVSATYYNPSYLTSDERGELTGGILHAEQELRSSRSDADGDIISDSPSQHVLIGMKTNLASLTRFDHPIYLGFIAGVEKYGKEMLAFSSETSETGQYLQYGKEPLFLNIGGATPLWRGISGGFSVRVTLEAAAQLDAVSTLGGETSRERLAVNAEPSLKSILGTTIKWGDTFCPDSDCFLDGWESAVTYRTKSSASTSVDSNIIVTQTIPDPGLSLAVATIDSFQPETFAIGTQYKGDGWRIGGSIEQQNWSELEDEFAGDTIKDQENVSAANRIRFDDILVPRIGAEYQLSRHFAVRGGLAYEESPLKTTRNPELNYLDTDKIVAGLGISATYERTRVLAYPVRLDIGYQYQQLQDRDFTIVDYDGNEQQATADGDVHVISGSITLKF

SEQ ID NO: 20613 - protein, 499 aa, Pseudomonas syringae
MPAPFMKYRSAWARGAAPADECQGDIMNKRKYNGDAKSRTSFGLVVVSLLSLTALAHPALADGDCEVTPPGFWERDTALGSFGGARTELCKKGVQLGVTSVNEMLANPYGGVSHGGKGQGRMQFDLDIDLEKMAELKGTTLHAGAMWIYGGRISGKNLGNLMPVSNIEAIPSRRLFTLWGQQVLFDDMLSVRLGQLAVDDEFVVSKLSSVFVNSTFGFPFGISGNLPSGGAAFPMPTPGARVKLNLTDEVSWMTAAFAGDPAGKFDVRDPQWRNHDGTTFSFSRGTFYITEGAYAVNQEKNSKGLPGTYKLGAWYHSARFNDQHFDNLGQSLASGNTTGIGNPVRGNGGVYFVIDQMLIKGQRWSEEGLGVFLRGGVSPSDRNQVPFYLDGGISYKGLFAGREEDTLALGVGYGQLSGSLQGLDRDTRQINGQPTRPVRDYETVIEVTYQAQITPWWTIQPDVQYVIHPGGNIPNPGAGSQFTPIGDTFIFGARTAIKF

SEQ ID NO: 20614 - protein, 729 aa, Pseudomonas syringae
MKILTYLNYLANHRFAFRRLVFGAAAFGTVSVGWTQKGESEFEDDAFELDAVVVTAAGFEQGIAQAPASISVLTSTDLGMTRINSLADALATIEGIDVGASSGKTGGLNISMRGMPSDYTLVLVDGRRQNAAGNITPNGFGDTSSSFLPPAAAIDRIEVIRGPMSTLYGSDAMGGVVNIITRRGESAWSGSVTAGGTLQGDSDFGNASESNFYATGPLVADKLGLTLRGSLFNREASDLSYLDEDGEELEVSKRGPSPVAADIYTAGARLNFLGNRDHDLWFDADYYWQTYDNSQSQLGTLGVRGYAEELKFNRNQFTVAHTWRLGDVQLESSLMKNETETIGRITPAGTPGKETGSPRDLTNENIVFDVKALVNTWESHSLVIGGQWWDAEMVDGVAPEAYQQTQWALFLEDEWKLTESLRLTLGARLDDHSQFGQHASPRAYAVWNATPQWSFKGGVSKGFKVPRLDQIADGIIGFTGQGTIPNIGSPDLKPETSVTTEFVAMYDNLEGFRAGVTLFHNSFDDKIARGPGLPNATWASEPNRPGSVDYGYWPLVDEFSQSINVDKAETRGIEATTRFDFNRDWSLNANYTYTESEQKSGSSAGQPLYSTPEHMLNGRLKWVAGENYSFWLSGEYRSERYRSPDRRATSTAKETWGNYRAYSLFHLGGNWDINESLTLNATIYNLFDKNFVDYRPYVSNTSTGAISYTNLYANNQEPRRLWLTATYSF

SEQ ID NO: 20615 - protein, 763 aa, Pseudomonas syringae
MQLWGGALNSLGMLRSAVLATASAWVLVPQASLAQSSMQSGAQNLPSVTVTAPEARRRAPASAVRSAPRRSVQAANRSKPQPQRNAGFVETPRGPVRGYVAGRSASGTKTDTPIMETPQSVSVISAEQIRDQKANKLDEVLRYTAGVRAGTFGADTRNDWWLIRGFKSDDVGLFLDGMQLFYTSYASWKLQTPNMERVEVLRGPSAVLYGGSSPSGIVNVISKLPPAEPIRYVETGVNNFGNAYVGFDVGGPVATQAQNGKLFYRVVGQVQNGPTQVNFTPDNNYFIAPSVTWKPDADTTFTVLASASRQETRGINFLPYVGTVTNASFGKIPTSFFAGDPSVDKFTREQEMLGYQFERNLTDDLTFRQNARFAHVDVTYRGYVGNDYGNQATATLNRYNWYAKNTANQGDLDNQLEYRFDTGPVKHTMLFGVDLKGYQIDDYQAFGFGVSSINIFNPVYGQAETPLPTTPFRNFQITQKQAGTYIQDQMKLGNFTLVLSGRNDWVATTQDARDTGATVSSRDDSRFSGRAGLIYNFDNGIAPYVSYSTSYNPIVGLNAQNQLFLPETGKQAEIGVKIAPKGFDGYFTVSAFDLVRQNVATTLPGSVPVLQNQTGEVTSRGIELEAVANATKELKLIGAFTAYHLFNSKDLDPSLVGKTPTNTPELLVSGWADYTFRDGPLEGFGFGGGVRYIGSSWADTANTLEVPAVVLGDLALHYEWQNWRTALNVINLTDKIYVASCASATSCFYGDRRRVTASVSYKW

SEQ ID NO: 20616 - protein, 1001 aa, Pseudomonas syringae
MQKSKCVGVVRYSFKPVATGALCALSFTFGCSAYADYVEQGKPGDAASWRSAEFQSDWGLGRIQADQAYAAGITGAGVKIGALDSGFDPSHPEATPSRYHAVTATGTYVDGSPFSITGAINPNNDTHGTHVTGTMGAARDGVGMHGVAYNAQVYVGNTNQNDSFLFGPNPDPQYFKAVYGALADAGVRAINNSWGSQPADVTYATEAGVRAAYAQHYNRGTWLDEAANVSRKGVINVFSAGNTGYANASVRASLPFFEPDLEGHWLAVSGLDSSNGQRYNQCGLSKYWCITMPGRLVNSTVPGGGYGIKSGTSMSAPHATGALALVMERFPYMTNEQALQVLLTTATQLDGSITQAPTNSVGWGVANLERAMRGPGQLLGTFDASLGAGLTDVWSNNISDQALIQRQAEDSAEQATWQQTLISKGWQNGVASTASQQDQADYATGTARAAAAAQRQYQGSLIKSGAGRLILDGANTYRGDTLVNGGVLSVNGSLVSAVQVNAGGTLGGNGQIGGLTARNGGIVAPGNSIGTLQVNGDVTLEPGSTYAVELSPTASDRIVATGSATVSGANMTLALENATPVALSAAPVQSVVGRRYNVLQAANGINGQFGSVSSNYAFLGGRLDYAANAVALNVEQTAAFNSVAQTPNQAAVATAAEQLGAGNAVYENLLLTQSAASARDSFQQLSGEIYPAIGSVLINDSRQVRDAVGERLGASVFGTDGNTAAQDNVWLKALGAWGKTDSRDDTAGYTSSIGGLLAGVDGNLADDTRLGVVAGYSDSSLNMGSGTHSRASVDSYHLGAYLGHEIGALRLTIGAAHSWHRIDAQRDVQVGGAAGKEKTKHDAQSTQVFTEAAYRIHLQPATLEPFANLAYVHLNTDGFTEKGDAAALSAGSDNRDAVLSTLGLRALKTIAISDRQKVDLSGSLGWQHNLSNTDSEQHLAFASSGNSFGIESSPLVRDAALVGAHASLALSKEARISLDYSGQLSSREKSHGVGLSLNWQF

SEQ ID NO: 20617 - protein, 737 aa, Pseudomonas syringae
MSTPSFPVRRLTPIAFGIALASAVPAAAFAQAAAVSAAAPASAGSSAPAPSADGAVLPSIDVTGTVEPLPGDLAPTYAGGQVARGADFGVLGRQKASDVPFSMTTYTSKLIEDQQARTLADVLDNDPAVRSAAGYGNYAQVFVIRGFKLDGDDISLNGLYGVTPRQLVETDAIERVDVFKGANAFLNGASPNGSAVGGGVNVQLKHADDKPLTRVTVDGSVSGSIGTHVDVGRRFGSDGQFGIRVNQSISGGDTAVDDERRRNNVTAVSLDWRGDKLRVSGDFLYQRQRIDGGRPTVLVGGNQLPAVPSATHNYAQPWSFSELEDTVGIVRAEYDFLPAWTAYVAAGTRHTNEHGDYYTPTYTSTGTTGSRLSVPYKQDAQSTEAGVRGRFATGPVTHFVTAGASFIRIESQSAYTMSSAFPTTLDDPAPVAFPATAYAGGDMGDPGTVAKTWLRSIAVSDTLGLFGDRVLFTIGARRQSISVDNFDYTGTLSAAYSDAVTTPVFGLVVKPWRNVSIFANRSEALAQGETAPSTARNAGQSLAPYRSKQYEAGIRYDADKIGASLALFQIEKPMAYTDPSSKVFAANGTQRHRGIETAVYGEPWKGVRLIAGVTYLDATLQHTAGGANDGNRPIGVPSFLLNAGAEYDVPMLRGLTLNARWIHTGPQYLDVANTMSIPAWDRFDLGARYATELFGRKTTFRATVRNVANHAYWASTIGGYLTQGSPRSVWLSMTTDF

SEQ ID NO: 20618 - protein, 230 aa, Pseudomonas syringae
MKKINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFVPWFNLTVRNRYNHNNYSSTDLSGELDNNDTYEIGTYWNFKITDKFSYTFEPHYFMRVNDFNSSNGKDHHWEITNTFRYRINENWLPYFELRWLDRNVEPYHREQNQIRIGTKYFF

SEQ ID NO: 20619 - protein, 859 aa, Pseudomonas syringae
MSSTFTPAAQPRVRLTLSLLTLAVLGASLQTVNASAASESTQAARSAGTYNFSIGQQSLVSALNEFSRITGWQVGVSSDLAQNVTSQGARGNLRPAQALDTLLAGSSLSYRNLGNNNVVLERRTATAGVLALDQITVSATRQAQDVATVPSTVSVHSREELDRSNVNTIRNLVRYEPGVSVGGAGQRAGTTGYNIRGIDGNRILTQVDGVEVPDSFFTGPYAQTHRNYVDPEIVKRVEILRGPASALYGSSAIGGVVSYYTLDPDDIIKPGKDVGARLKTGYSSADESWLNSATVAGRQGEFDGLLHVSQRNGHETESYGETGGTGLSRTEANPEDARSTNVLAKLGWNYTDGSRLALAYEKYKDDRDSNLKSAVGGPFTNGSGLGMYQSREGNDTITRERFGVENSFAVDSLLVDDLKWSLNYQTAKTDQSTRERYFPFSRDVIRDRDTHYQEKQWVFDAQLDKAFSIASTDHVLTYGTTVKQQKVTGLRSGSGTCARVFGSCRVVGADSPSDRLAATSDFPDPTITSYALFAQDQISWNDWTFMPGVRYDHTTLDPKFTPEFLRSVSLADPGQGDDETRTWHRLSPKFGVTYALSDAYTWYGQYAEGFRTPSAKSLYGRFENPTAGYVVEPNPNLEPETSKSYETGLRGRFESGSFDIAVFYNKYRDFINEDAITPGYSELTFQSNNIKHATMKGAEFKGRINLDSIGAPNGLYSQASVAYVQGRNNDTGEPINSVNSLTGVIGLGYDHNDYGGLLSWTLVKRKNRVDDSNFHTPDGTSSQFKTPGYGILDLSGYYKVSNDVTVNAGLYNLTDKKYWRWDDVRGYDGVGEAGVTAPANLDRLTQPGRNFSVNVVWDI

SEQ ID NO: 20620 - protein, 398 aa, Pseudomonas syringae
MSARPRAADRRSRRNGSFQETHVMKKAVVGTLSLAFVSAVAHAQSSVTLYGMLDAGIAYTNNQSGKSAWQQGSGLLSNTVFGLSGNEDLGGGLHALFRLESGFNLNNGTQSYRNTLFGRRAYVGLQSDQYGTLTLGRQYDAVVDYLGPLAMANNGDGNNLASHPFDNDNLDDSFYIDNAVKYTSPTLAGWQFGGLYGFGNAAGGFANNRAYSAGVSYANGPVSVGAAYLQLNRGGLTTGGALSANDAPNFPAARQRVMGAGGSYAFDRLTIGALWTHAMFDETAASSLPGALNALRFDNYEVNARYALTPAVSFTGAYTFTDGRYDDATGSHRPKWHQATLMADYALSKRTDVYAETVYQHAFGVPSGATLGFANVTGLAASSTRTQVVATVGIRHRF

SEQ ID NO: 20621 - protein, 793 aa, Pseudomonas syringae
MPRNLLRSRLLLTVFCSPFALAAALPHPVEAATTGTKKTTTARHDPKHKAKAEAVAGGTEQLVITARRTRSEQGLSHVQIQRILPGVNPIKALEMLPGVVFNNADPWGNNEQNSSLYVHGFNQNQLGYTLDGIPLGDQAYGNYNGLSPQRAAISENIGSASVSSGAGALGTASTSNLGGTLQFTTQDPLKKRGAQIEQVFGSWSTFRTFARIDTDEFGNGNSAYVSFSRQDARAWDFAGHQGGYQVNAKFVHNSEHDHFSTFFDWSQKVEPNEDSITLPSGYGLYVRPFTYPNFNYAKANANAVGLNYRNYYSAAQREDFLAYSKWTHDFSENLHWDNSIYYHHDLGEGVVAGPISAAGLPTLFAAYYPGQDLNTVFGGSGYATRTTEYWDNRGGLMSTLRYHLGKHSIELGGWYERNNNTQARRWYPLDANNPTTPYERQQNALIAQYTNNFYTNTFVTHLQDNWQISKNFSLMAGFKSELVYTNGTLPVAAKPGSLSPSYAVTAPGGEIDAAKPFLPAFGAVWDITKHEQWFANIQENMRSYQDAGYGNATPWGATSQAAFEEFKKNGKPETSWTYETGLREHRQIHLGPLTAIEGQVEYYHVHFSNRLLAVATTQTLSSIIGSATTLANVGSVTTDGMDFSFTTHFGPHFSLYNALSYNKSVYNDNYSTGSSVIHTAGKNVVGMPDWSEKFVFTTNWGNAYGQFTGDVIGKRYATYTNDMWAAPYAQFNLNAGYTFHNIPHLASLKVQGNITNLTNTKGWSTINATQTSGQFSAYPIAPRMFFLSISAAL

SEQ ID NO: 20622 - protein, 422 aa, Pseudomonas syringae
MTSHTSRSRILLGVGGMTLIFPMLGMAEGFVDDTKATLTLRNAYFNRNFTNPAFPNSAASQSKAEEWTQSFILDAKSGFTQGVVGFGVDVLGLYSLKLDGGKGTGGTQLLPIHSDGRPADDFGRLGVAGKARVSKTELKVGEWMPVLPILRSDDGRSLPQTFRGGQVTSKEIDGLTLYGGQFRGNSPRNDASMEDMSMNGRGAFTSDRFNFGGGEYVFNDKRTQVGVWYSELQDIYQQQFFNLLHSQPVGDWTLGANLGYFIGNEDGNKLAGDLDNKTAYALLSARYGGSTFYVGLQKLTGDTAWMRVNGTSGGTLANDSYNSSYDNAKEKSWQLRHDYNFAVLGVPGLTLMNRYISGDNVHTGNITDAKEWGRESELAYTVQSGALKNLNVKWRNSSLRRDFSTNEFDENRVFISYPISLL

SEQ ID NO: 20623 - protein, 349 aa, Pseudomonas syringae
MKLSRIALAMLVAAPLAAANAGVTITPLLLGYTFQDTKHNNGDKHLTNGGELQDDLFVGAAIGVELTPWLGFEVEYNQVKGDVDSAAANSEYKQQQINGNFYVTSDLITKNYDSKIKPYVLLGAGHYKYSFTDATDVQLGRTGRGLKEEGTLGNAGIGAFWRLNDALSLRTEARGTYNIDEDFWNYTALAGLNVVLGGHLKPAAPVVEVAPVEPTPVAPQPQELTEDLNMELRVFFDTNKSDIKPQYKSEIAKVAEKLAEYPNATARIEGHTDNTGPRALNERLSLARANSVKSALVNEYNVDASRLSTQGFAWDQPIADNKTKEGRAMNRRVFAAISGSRTVLVQPGQ

SEQ ID NO: 20624 - protein, 231 aa, Pseudomonas syringae
MLKRSLVLAALCGMSFAATAVTIDLRHEFIDGGKSDKSNADRVSVSHRFANGLGFTVEAKWRSGGDNGSQPYSDVVGNGHEDTISWRWKATSNLFLTPGFTIESNDSRSIYKPHLHAQYSFDNGFYVAARYRYEYTRYPNNAGKDDDKVNRGDAWAGFVLGDWRTELNYVYARSSEGVSRNDNKPYSQEYNVKVAYKLDNNWSPYGEIGNVGVNDRSDRQTRFRVGVAYSF

SEQ ID NO: 20625 - protein, 236 aa, Pseudomonas syringae
MNPLFLEANEITWSQFLENFKNKDEPKKLKKPTTNEPVLDKNQQILKSALEKSLKFFFIFGYNYSQATFSTSNQSLTLVANSIGFNTATGLEHFLRNHPKIGFRVFSAYNYFHSVSLSQPQILMVQNYGGGLDFSFIFADKKPYRFRSYLGIALEQGVLLVDTIRPGAITTIIPRTKKTFFQAPFRFGFIVDFIGYLSLQLGIEMPLVRSVSYIYNNHQEKFKPRFNANLSLVVSF

SEQ ID NO: 20626 - protein, 873 aa, Pseudomonas syringae
MHSPISRSEKSTSRVRNAAPCLAGGVAALTAAGLYSPAFAEDQIVAVALPTAQVVGSTPIDSIGVPLSQFPANAQRVSAKDAREQRNSNLADLLNDNLGQVSIGNGSGNPYQNDINYRGFQVSSLLGVPIGVSVYFDGVRMNEPFGSIVNWDLIPMNAMSSVNILPGSNPMFGLNTLGGALVVNTKNGKDNAGTSIEALGGSFGRRALSFETGIVDKAHGTDYFVAGNFDRQDGFRDHSGSNVKQLYGKARWHGNDGATQLELSAALADTSLSGTQSLPMDMMANRSAAYTWPDTISNRMALLNLTGSHWLNDTNQLAGSIYYRKASLHNVNSNAQLDDGCFNDDGSLATTAAGGTTTYKCANKAPNGTAVNAVTGANALALGYGRWTNAINTSVVDSATHEDTVGTSLQWSNFSQLAGHDNTFTFGSAFDHSRITYDQTTYLARLINYQTVVSPNQTYGFTANGSAPSTSNPALFTGSNVIGAVNLSSNINNFSLYFTDTLSVTEKLSVTASGSFNYTTLNQGGANNKYLNEDGGYSWTDQVSGVSYYNPGYANAYRYSNAGSGAATAPNGVPPGAVAGPETNSLAGSHRYRRFNPALGFNYDLGAGQGIFGSYSESMRAPTSIELSCADPNSPCSLPTGFNGDPDLKAVVAKTIEFGGRGKLGKSTYWSAAVYDSRLSNDIQFIATSNTYGYFANVGKTERRGMELGASTKIDKWSLSANFGYVDAIYKSAFTTASGQHVVSGNKIPGIPAKTLKLGASYAFSPNLSMGGNVILVSKQIAHGNESNADPNGEVAGYGLVNLNLHYKPTKHLEISAYISNLFNKRYSTYGLSGMRSIYTLAKQQFMTPAPPRAIWIGLTYSFGGKAAGADAD

SEQ ID NO: 20627 - protein, 471 aa, Pseudomonas syringae
MTATTATQRVKLGLNKSVVIDLPSDAYDILVANPTVADAVTRTARRIYLFGKSVGETNIFVFGPNGEQIASLDLAVERDVAGLEDYIRRFLPTSDVKVELLNDNVVLTGTVDTPLDAKRAVDLATIFVSGGEATTGQYSQTAAGGSAQGGVDINNPDQERRVSKIVNLLQIIGDDQVTLKVTVAEVSRSVMKQLGVNMVGNGGSNGISYGALSDNFTGLGKQLSHSGFNIGNSALMAYINAMEQSGVMKTLAEPTLTAVSGEKATFKVGGEYNLLTGVSQNVSSDNQTGLTTYTINKIEYGIGLEFQPVVLSPGRISLKVRTSVSEPTTEGSVALSNGVTSPGANMLSLRKRLADTTVELPSGGSMMIAGLVRDDVRQAVNGLPGLTKIPVLGALFRSRDFVRNESELVIIITPYLAKPVARNDLAKPDDNFNPASDGAANFLGKVNRVYGTMQTDKPNGRYHGVVGYIYK

SEQ ID NO: 20628 - protein, 350 aa, Pseudomonas syringae
MNKHLIALAVTAATLSGAASAAQVYSDDTSSLAVGGRVEARALLSDQADSNGKYSDEVTDQSRARVNIDAKTQIADGVQGIGFLEEEIKSTKSADSQSNETRYVYAGVSSDQYGQIVYGKADGSLGMLTDFTDIMAYHGNLAGNKIAAADRTSNNLAYAGTFGDLTFKANYVFGGAVGVNDQKVDDVHGFSTGAVYNVGDTGLALGAGYGEQKAALGQQDTHKARSEQTFAVASYTVGDLYFGGLYKDGRRDTKNWAGDVTDTTGYEAAVAYTMGKAVFTTTYNYLEDTNAKNGEYKDLQDAVMIDGTYYFNSNFRTYASYKFNMLDDKKQNVTKAKASDEFVIGARYDF

SEQ ID NO: 20629 - protein, 1405 aa, Pseudomonas syringae
MSIRNGGTAEIHDAARAEHLILGLGTLPSEIGHLIVRSAGSLTVGNQTSIGNDRGSSAISTLTIDGGTVTGGYGNFRVWHNGAVLLRGGGTLRTGTQGLALDGGRLEIGNAPGTLDSPYVWATPDDNVTGQLIFNHSAGDYEFAPAILQNVAVVHAGVGATTLVGENTYTGGTTLDAGVLGISANANLGNPNGALVFNGGTLRTTGFITMNRATALGAGNGAFDVASGASLTQQGIVSGSGALTKTGPGSLTLSGVNTYAGGTVIEAGTLRIAQSGNLGTGPLTLNGGTLEATAPLTLYADTWIDGGGTISTTSSLTLEGSINGRAGVKISSGPTGTVILNGAHNALPTAFVTGQSTLQVNGTLEAIIDIGGASRLSGSGTVGNTSIQHGSTLSPGQSSIGTLTVNGDLTLHDGSILDYQLGGPGTSSDPASGIGSRVNVTGNLTLNGALNLRSSSDTAQDGVPGLGYYRLMTYGGTLSGTGLSIGSTPVFSDPAHFEIQAGGGNVDLFIAALGHDTLQHWQGGDGAWNSANAQWLNRNGEVAAGWAGNQAVFKNQPGGFGGGTITVAGMQQFKGLQFVDDGYRLEGSGQLVIDGSERGDGNAEIRVLANSAEIATEITGSGGITKTDAGTLVLSGNNSYQGSTHILSGAVSIASDRNLGATGAGILLSGGTLATTADMAIGRNITLAGNGGFDVAAGTTLAATGPIGGTGALVKTGAGTLRLAGANLYAGGTRVRQGVLIGDTASIRGNIANDGEVAFQQATDGVFAGDISGSGLMRKLGAGSLALAGRNTQDWAVDTGPLRSAGSRFAGDVAIGANGIFVLDDAQAAAYAGTLSGTGRFHKQGAGSLLLTGDSASFTGHATVSAGTLRVGDRHGGGVLGGSLDVQAGATLGGSGTVGSGAGSQVTVASGGTLAPGNSVGTLTVNGDLVLDKGSRFEVEVDPQGTRSDQVAVTGNTTIQGGAVAHVGATGQYQLRSTYTLLTTGGALSGRFDTVSSDFAFLTPELRYDYGAGTVGLALARNDRSFASMALTDNQYATAQGIDSIGVAAGHAVYDAVAQLPDDAPLVRASLDALSGEIHASAKTALIEDSRFVRDAAKDRVRAAFAAPGASTAAVSARAADGAPTAVAATHDGPAAWSQAFGSWGSTDSDGNAARLERNVGGVLIGADRLMGNWRVGALAGYSQTDAKARDRASSGRSDNYHLGLYGGTQSGALGVRTGLAYSWHDIRTRRSVDIPGLSDSLRADYGGGTFQAFGELGYGIELNDTTRLEPFASLAYVRLHTDGYRESGGAAALTTGSANTETTFSTLGLRAEHALGSGAAQGTVRATAGWRHAMGDTTPQARHAFSAGDAFTVAGAPIAQDSAVIELGVDLAVARNTRFGLSYAGQIAGSAQDHGVRADLSIRF

SEQ ID NO: 20630 - protein, 400 aa, Pseudomonas syringae
MTKTSKIATIPLLGLGIALMAGTAFAGPKMTFGPNDEGALQLDYKGQFQMTLRDTGSGENNSDSTMNFNFRRNRLALMGKYGDNMSLYVQTEYISDANITPFDVADTNQGSEFQLLDAVMRFKVNDAFRINVGKFKYNLSRENLEACEMPLTLDRSLFIRAPYTTTRDTGVAVWGNLFDDMFQYRVDAMEGRKAVSGETAPASNFRYSARAHVTLLDPENDYGYKGTYLGKKKVATIGAAYQFEPEVAYGDTLTRTDKKDYKAWTVDGFVEYPLEGIGTVTASAAYEKIDLEDAYLGGPGADPLTSGINGQKNGYYVKGGYMLPNLPLQLFVRYERWRFAELNGVFDQRIDWYGGGFNYYLRGQNLKLTFEANSTGFNKAGGTETTEDFMTYITQLQLIF

SEQ ID NO: 20631 - protein, 892 aa, Pseudomonas syringae
MTQLDKVTVTGSLIPRSQIETATSVFSITAQDIQRRGFKDVYDVLRSQPMATGSVQDGQFTGGFTPGAQSLSLLGLDPGFTLVLIDGRPMADYPLLYNGQSNFVDLASVPVGMVERIDVAPGNQSSIYGSSAIAGVVNIILKKRMDGMQMNYRMGTYDGGGGNNQRFQLTGGNAIGGANIVWGLQLNNQDPIYGFQRRNFDSTNDNPDPTLRYGSQVALHSIPGPPDSYIDPGADNCAALGALFNHSVTLDNRSKRGNYCGSRSALGYSSILNKERSASGYANLSYAFNDNAELYATLLLNRTKVEVNGGSRSWLTSADTGGLFYNQNTQQLETYKRIFAPEETGNLDFNNDRQTADSYNIALGMKGGLGGSNWTYDAYYARSEYRIESRQQWPLADRIEDFFRQQFLGPQLSEQYGYPIYSPNDANFYRALTPAQYRSFNDEIHTKSRTWTQNLNLQLTNTELFTLPAGAVGVAGVLQAGNQYWNNPTDPRVIAGDFYQLTGTQGSGKRDNWAVALEMHVPILSTLTANLSGRYDDYKNQGGGSDSRLTYKVGLEFRPVDALLLRGNYATAFKAPDMAYTFAGDSGFYESVNDYYRCAIEEPNKPIADCSYSDTTIAGRRGGNPELKSITAKSWGYGLVWSPSAHLSASADYYHINITNEVSDINYDQLLQIESACRLGNLDIASPTCVDALSRIDRTGPDATVPNRLNSIRVNPINISTEQVSGVLAKASYDWSTASWGTFLVDAQYNLTLKHESQQFPQDPVIDLLSNPFYSQEFHSIANASLTWKKNAWTTTLFGQRYGRTPNSAAQRSDAGYATKDAGKVAAWTTFNATLDYAISDDISLTATVNNLANTRPPRDRTDTYYPYYNIFNYTGYGRAYMLELNWRFGAH

SEQ ID NO: 20632 - protein, 752 aa, Pseudomonas syringae
MGMSDSRKSALKLFKFYSAASILALSSIVTLSPSYAAADENSSAEDSSTPSENSTSKTENAVPSNATGKDILVTAQRLNEARAQIQSHLGATVYSMDQKQIESIPGGYNQQMNNILLQMPGVTQDQFSQVHIRGDHNNLQYRINGIILPEGISVFGQTLAPRMIDKMDLITGALPAQYGLRTAGIIDITTKSGLQKNGGTASIYGGSHETIIPSVQYGGSTGSTNYYVTGEYRHTALGIDSIDGSSTPLHDHSNQGNFFGYLDHILDDSNRISLMAGYSQQNFQIPNPKNIHPGENGTTGFNLNGQTDYRSNDLDENQRERTGFAQLAFMHDSGPFSMQASIFGRYSSLDYYPSVAGELIFNGMAQRITRRNVAFGLQYDASWHVSKHHTLRGGFFFDRERGSTFSTSSVFAADDDGNQTSTTPLSIVDNSGKTQLTYSAYVQDEWKLAQNLTFNYGVRFDLYSSYRTEHQFSPRANLTWQPTKSTALHVGYSRYFSPPPFELVGYRTISRFNGTTGAATGVNKATTPYAERQNYYDAGIQQKIGKDFTFGVDGYYRRSHNLIDEGQFGEAILMTPFNYSRGKIWGIDFNSSYTHGGWRVYGNFAYQKALGKKIKSSEYNFEADDLAYIAQHYIYLDHNQSWTASGGVSYTFHDGVLKNLQLGATALYGSGLRTDLTLANGDTIPNGASVKPYATVNTTIMYRIERQGINLRFDITNIGDHVYQIRTGDGVGVGLPSYGARRGFYFGFSKDI

SEQ ID NO: 20633 - protein, 420 aa, Pseudomonas putida
MIRATHGPGRALLATLALCPALSQAEDPGWSLLSRNYFLHSDFRSPSGSGQNYRQEWAQGFIGEIRSGFTEGPVGVGIDAHGFLGLKLDGGRGHAGTGLLPRDSDGRAASDYSSAGAALKFRLGNTQLRYGELMVETPVFDTGDKRLHPEYATGWLLENTDLPDWHLQAGRFTAFNNQDNSSTHDDFSGYGATTQGRAISLAGATFAPDGPFGGALYAGQLQDTWRQAYLNLNLAEGNWRLDGNLYQTRDTGNASAGAIDTLAYSLSGKYRFGAQAVTLAYQKIEGDTPFDFVGGDSIYLANSIKYADFNGPGERSWQLRYDLNFATLSVPGLSLMARYVSGSAIDGTHAPAGGAYTGQQGQGGRHWERDIDLKYVVQSGAAKDLSLSFSHVSHRANEAQAGDDIDRIYLIIEYPLKGSF

SEQ ID NO: 20634 - protein, 688 aa, Pseudomonas putida
MSGCTPVFALSLRGTIAALCGSLLAPMALAADPGHEGHVHDAPELSPTVITAVAPSSPLTVVTNPKDPRQPVPASDGADYLKTIPGFSAIRAGGTNGDPVLRGMFGSRLNILTNGGLMLGACPNRMDAPTSYISPETYDRLTVIKGPQSVIWGPGGSAGTILFEREPEKFGTLGSRVNASLLAGSNGRFDKVLDAAAGNSQAYARFVGNQSRSDDYHDGNNDTVPSRWDKWNGDVALGWTPDQDTLLELTAGKGDGEARYAGRGMDGSQFKRESLGLRFEKSNLGEVLDKVEAQVYYNYADHVMDNYSLRTPSGSGMMGMPMVSNVDRRTMGARIKATWRWADVQLISGIDAQTNEHRKRGGMGVDAHKGQAWTKDADFHNYGAFSELTWYVSGEDRLITGARLDRASARDFRKTSATEGDTRADTLPSGFIRYEHDLAAIPATTYIGLGHAQRFPDYWELFSPKLAPAGAANAFDGIKPEKTTQLDFGIQYRTERLEAWASGYVGQIRDYILFDYRTGMMGMSTSQAQNIDARIMGGELGAAYQLTDNWKADATLAYAWGKNSSDGKALPQMPPLESRLGLTYSRDVWSVGALWRLVAAQNRIAENQGNVVGKDYDKSAGFGVFSLNGAYKVNNNLKLSAGVDNLFDKTYAEHLNLAGNAGFGYPATDPQPVNEPGRTFWTKVDFSF

SEQ ID NO: 20635 - protein, 143 aa, Pseudomonas putida
MSFTPNIGIRYGYIKDGTYQESGAGIQHLSIASKKQNIWSSIVGGNVSLAPQKIGAVSITPTIMASVENYFNNKNKKLAAKIKWKDREVTEIVALPKQPKIGYNIGANILAEKGNISVLVEYNCHLQKKYKSHQGFVKLKVKL

SEQ ID NO: 20636 - protein, 710 aa, Pseudomonas putida
MPLRLRKNRLVSGVSAYAVLMALAGSALAQSPDIPDSATEAETQTTGQDTPSTASAPTVLAPVEVTARKRVENAQEVPISITTITAGDIQDTGLENMEDVVRLTPGFNAMHGAQSWGSTFNVRGVGSLNPGGHEDGSISAYVDGIPVPMGQLDTYYLDIDQVEVLRGPQGTLYGKTSQAGAINITTVAPSDTFEGRLGVGIGTGGTRGIDGVVSGPILKDRLNGRLVFDLKSEDGLMYAQDLGRDLGDVDRAMVRGTFDATWNDRASTRLSLGYDVLDNNDQALAERKDYDKFMGVFEPYEDRTHASLGMTNTFDLTDNVTLNLVTGAHLVDLEYASVPNAMITGINKDGETHFSQEVRLDGTANRLDWTAGGFLSQYHRDIDMKTTGLLSFVDSGEQEISSQAIFGEATYAVLDDVKVTTGLRLNRDNKSMDETVVNNTYGFTHTMDEDKAFYGWNGRVALAYTPTKTDTFFASISRGYKAGGFQTNHSTAMSGLQENTPSFDSTTSISYEVGYKGFFLDERLNIEGSAYYISTSGEQVLGYDTTTYKGIYHNVDAESMGLELSSRARLTEELTLGGSLAYTHAYITQDADLGVSGFASAGSEIPNVPKVAYTVFAEYRDALPESLIDASWFVRVDFRGQTGRWFDITHDYRGDSFATTDLRLGLDTDGWSVNGYVTNVTDEKYYAYGMLNRVRPAEEREFGLKVNLFF

SEQ ID NO: 20637 - protein, 1111 aa, Pseudomonas putida
MKFTNELRGVKSRLLLFSVLLLIPVMMFAQSITVKGTVLDSAGEAVIGASVVEKGNPSNGTITDFDGKFTLAVSKGKRIVISFVGYETQEVDAVTGKELTITLQDDSQALEEVVVLGYSSRARKDLTGSVGSVSGVKIAAVPVTSAAVALQGKIAGVQVTTVDGAPGADINIRVRGGTSVTQSNDPLYIVDGFQVDNINDIPPTDIASIDVLKDASITAIYGAKGGNGVVVVTTKSAKAGKIQVSFNAHLSTSHLSKKLDLMNSAEFARYQYEWSACNGSRSSNAKFFRANFGNPQDLDMYYSLPTHDWQDEVMGENPINYSTNVTIGGGTDKMRFTASLTQSEDKGIIMGSGVRRTNLNIKTAIDITKNLTLHINPKFTFRRDQGAGGDNIGTGGIIDVLRYRPTNGLREFGYIDPSYADPDEEALFTYTNPKSDIAINQQNKYAYNYTNAISLEWKPVKGLVLRTEATLSLNWKDQYRFWGALTGEGTKNNSLPVASIQKDQSFKYIWTNTASYGFSIKDKHNFSMLLGQEIYHSQNKKNFQKNRYFPRAFEAGQAWDNMGFGTPQESTSSLSTPDRTASFFGQASYNYNHKYLLSVTMRADGSTKFAPGNQWGYFPSVSGAWVLSEEKFMEDIKWIDQLKLRAAIGLAGNNRISDDMWRYLYTVNSTGGPGFGEATQFGEQWYGNQGGTTFANKNIKWETTLTRNLAADITLFNGRLTVTPEIYWNTTKDLLYKSDIPSATGYVSQMQNIGQVTNKGVELTISGDILSGRDYVLSANLSLGMNKMKVDKLNGTDNVIWDQNNRWKSSYNDYCLKVGDQVGLIYGFVYDGLYSMDEFYFDPTNNLQAVPWGSTAAENGTSKDAPIMDADGVEHPKTIINQISGDSNSGIATLPGKVKFKDLNGDGYITEDDRTVIGNTNPKVQGGFGLSGQWKGFDFAMNFNFMLDFDVNNATAYQLSSSESNKNKFYNVLSTFADKGWRYTRDGDGECLYKCYYIDGSLDMYRELNEGRTLWNPTDVTKKITHSYFIEDGSFLRCQDLTVGYTLPGNLTSKWGISKARFYVSASNLFIITGYSGYDPEVDIQTGLTCGMDYNRYPRSRSFVLGTNITF

SEQ ID NO: 20638 - protein, 224 aa, Pseudomonas putida
MAVVRPAVVAAAASLIAAAFCPIAHAEGGDLPLVSGNWMVRLRAVNLTAANKSDAIPALAVPDDAIHINNKAFPELDISYFFTPNLAAELILTYPQQQDVTVMQSALGGPTKIGSFRHLPPILTLQYHFRPESRFKPYLGAGLNYTRISSVDLQVPGVGPLDLSRNSFGPALQAGFDYRLTDRVYLNVDIKKTWISADVKLGGQTVSKVRIDPWLVGVGLGYRF

SEQ ID NO: 20639 - protein, 970 aa, Pseudomonas putida
MRTIKLLGLLLMLLPISIFAQSTVSGTVVDNSGMPIPGVNIAVKNTNKGTTTDFDGNYSIVLENGETLSFSYVGFRTKNIVFNGKNTSIEVSMVEDAEALSEVVVVGYGNQTVKSISGSVASVTEKDFNKGNIVTSESLIQGRVPGLSVTKGGGPGSGSEIRIRGGSSFNANNSPLIVLDGLPLDNSVADGTRSILSTINPNDIESFSVLKDASAAAIYGIRASNGVIIINTKKGRGELSVSLDVQQNITTIDNTVDVLSAGQFRTLIAENFPGRLGELGSANTNWQNEIYRDAKSSDINLSARGALFGKIPSRLSLNRSDQQGLRQTSKFDRTTASLSLNPRLFDDHLKVGLNANYSNEDNRFADGVEGNAITFDPTQPVRSPGSPYGGFFEFLDNDGSAASNVPRNPVSQLLQTRNISNADRLFGNLNLDYKFHFLPELRLVTNLGYDRTDSGGSLTRPGTSALGVNAEQGEFIGNESRYEQTRTNTSADSYFIYENDFNDFGLKLTAGYSYQKFESERFTTNEILDPNAQEPRTTVADDVVLIGYFGRANFSFQDKYFVNASIRRDGVSKFSPENRFEYFPSVSGAWILTEEDFLEDSNLINSLKVRAGWGQLGQQEVPSTSDYLRRYQTGLSNQQYNFGNTIVPFQPLYTNPDIRWEILTEINLGVDFELFNNRLSGSVDVFERTADDLLSNVPVPDGANFSNQGFQNIGEFVSKGIEVNLDYNVIRRDDLNWNVNYNFTAIDREITNLAFGQDIFVGGITGGTGNTIQVQREGAWPNSFFTYAQLYDQAGQPIEGAYADLNGDGTVDDRDRYVSGNGQADVLMGFQSNFTYKNFDFNFNLRASFGNDIYNNVNSSRAQLGNLNLVSPNNLPVQVLETGFARTPDVILSDFFVEDASFLRMDNITLGYTLRGFNRESTSLRFWMGLQNAFVITDYSGVDPELNISGIDNTIYPRGRTYLLGVNYNF

SEQ ID NO: 20640 - protein, 75 aa, Pseudomonas putida
MPTQEAKAHHVGEWASLRNTSPEIAEAIFEVAGYDEKMAEKIWEEGSDEVLVKAFAKTDKDSLFWGEQTIERKNV

SEQ ID NO: 20641 - protein, 704 aa, Pseudomonas putida
MFPGTPPYPRLLLLTALLGGQAAADDLFIDTPDLPQVLTATRLKQSPAAVPGSMTVLDSELIRASGARDIPELLRLVPGMMIGYGAGNQPTVNYHGSNVNDARRMQVLIDGRSVYRAGLATVDWSDIPLAMEDIERIEVFRGPNTVSYGANALMAVVNILTRNPADSHGTRLKVTRGQDGINDFYASHGFGWDGGDMRLSLSGQQDDGFDENQFGQDYRDSRRLTRFNLSANHNLAVDQTLEWQLAAKEGSNQRPYTYQPVFQQYESGNNADVNAKDYAGSLRWTKDFSAEHSLYIQGSAQHFDRQQVWRACDALQSFSPELTQLWQMNPDFAEKVARGIATGAPLSTDDPALKGLLQKVQQQWEQGGREQVCGDVDQSTRETRYDLEIQDTLSLTDSLRLLSGMNYRYDRADSQTYFNGSIDDQTWRLFGQLEWRADEHWILQGGAMFEDSRLSGSSLTPRVAVNYLITPRHGLRAVYSEAVRSPDMFENNVNWSYTVKNLTPNSFGLQNGEYFVKTRGPGDLEQERMRSRELGYNGYFSDIDLSLDVKLFYDEITGMISEPLRNNQYIASNANKARFSGSEAQMDWRPTLRDRLRLTYAYVDAWASNPDDRRLSARNSGSAGWMREWGAGWSSALFYYGDDALNQYRYERLDLRLAKRFRVYGSNLELAALWQQRLDDEPTSALQNRYDSRHRLSVSAELEF

SEQ ID NO: 20642 - protein, 3353 aa, Pseudomonas putida
MRSDDSNLWRCVSHAGAPDLAGRYVITDVEESGKIPVFLVSDRGTGMVRPTLFSRKTRKVPGPLALSLPVLLSSVALCALTVPAAAQTSNATIGPSYVYNPSVSGTPGQGGYGCPINNLVSNVSGGGQGGTGTPVSESYVDDLTAPANGGVTYVIAGSTGGAGGVGGGSANSVICTGANSNGASGGQGGNGGMVTITTTGGSGSNTFSSTGIYVYSAGGIGGAGGSTDTDNGQGGGGGIGGAGGQAQLTNWTPFSTQGSGSVGIAVISLGGNGGVGGGGGPGGRGGNGGAGGDGGSVILTNYAAVEAQKAIVIYAQSVGGYGADGGGGGNGYWIFTGSGSGGAGGYGAGAGTVSVTNSGALTSGGLGSRGIEAQSVGGAGGDAGVSQGLNAIGANGGPAGNGSTVTIINSGTITLTNASAVGIAAQSIGGGGGSGGLAFSSGVAGVLIGGSEAGGNGGGGGYASTVSVANSGNICTGNSCNSGVAPTSSAGGAFGIQAQSIGGGGGNGGFGVATSISGTDFAVGGAGGTGGAGGNVFVTNTGSISTQEINSAAILAQSIGGGGGSAGGAVSMDLTTAASISHGGSGGSGGSANAVTVNCTSGDSGANYGAACTTNGALMLSSFNRGTITTNGTGSAGIVAQSLGGGGGHGGYSVSLSTDAYAGAAFSLAVGGSGGTGGDGGNVFAGTGGVGITTYGTDSPGVVAQSIGGGGGNAGASIASSISAAASVALALGTTGGSGGYGSTAAAVNQGSTITTSGDRSPGLLAQSIGGGGGNGGAAISASASTGVGVSLALGGTGGDGGTGGWAYAYNGTNSGPAGPTDITTYGYQSSAIAVQSIGGGGGNGGYTTSLTLSLGPGLGASIGGLGGSGNHSNTVFIENAAGTLTASGGGAAIILGQSIGGGGGNGGFAASGNASLGGAATLAVGGSGGAGSSANTVSITNYGAIVSQATAVETTFQTVPTTTYVPQTTTTYEEEWVCNEYCSWGRVPVTTTTQVPVTTYSTVPTTQTVVSGASIYGNAPGILGQSIGGGGGSGGFAVGGSVSGAGTASLEVGGSGGSGGTGAAVTIDNYNSITLIGSLSSGIVAQSLGGAGGTGGFVVAAGLSSGASATTTIGGGGGSGGTSGAVTINHGNGAITTNGDQSPAIIAQSIGGAGGSGGWDIAGSLASAGAASVGLGGSGGGGGTSGAVTVTADGALATNGLISAGVLAQSIGGSGGNGGFSAGAAGAIVFASDVILGGGGGTSGSAGNVTVTANDAITTLFSQSPGILAQSIGGSGGTGGFAIAGSGATGGGDAKVSVGGAGATGGGGGSGQAAGSVTVIAADITTNGYLSAGILAQSIGGAGGNGGSSRAFSLSGASDSTDGAAASVAIGGGGSSGGDGSSVSVTQTGTIWTGSSGVFSDQSPGILAQSIGGSGGNGGSADANAASTTASVALAIGASGANGGSGGNVSVSSNQNGGGGITTTGLHSSAIFAQSVGGGGGNGGWTQATASSNNYAAGIAIGGSGQGGGSAGTVNVTSGGALATSGALSYGIFAQSIGGGGGNGGAASSTTDAGQGQELQGGVTSVAGAGAGQTASNVSSALSGTSGTGPDNGNGNAANGIAVAVTLAGFAGQGGAGSAVNVTSSSAITTAGDQSTAIFAQSVGGGGGSGGSSSANSSGSSYAASFTLGGGAGPGGAGGDVTVGSTGFILTTGLQAAGIFAQSVGGGGGLGGSSSSTASSGGQAAVSMSLGGSGGNGGDGGIITVNSGGTSTYINTLGPNAAGIFAQSVGGGGGSGGSSSAAASAPGSSSSGGSASSATGSLSGSATGSSTASAAGENGGKPGAQSGSDGGYSLAMSLGGSGGQSGNGNTVTVTNTYGIFTGFSLASGIRSVVPADNSPAIFAQSVGGGGGNGGSSTTNSSAGEYSASLSLGGNGMAGGTGGTVTVTTIGTLQTTGANSAGVFAQSVGNGGGNGGSSTTTSSSSGAVSLALGIGGSSSGGGEGGTVNVTVNAPVTFQGRSGISTQGFNSYGVFAQSVGGGGGNGGAVATASTASSGSSGGSTSTGVQGATTSSSASNAAAVALGLGGTNGAGGAGGQVTVAVAAPVLTSGVQAIAVLGQSVGGGGGTGGASTSNAGDGTYALALGLGGAGGSGGAGGQVTVGSTSAIQTTGAHASGLVAQSIGGGGGIGGASTSGASGGGDVTASLALGGSGGSGGAGGQVTLTFEIPGTGTTLTTSGAHAYGLVAQSVGGGGGMGGSSNGSTSGSGDVNVTLAMGLTGGLGGDGSTVTVTTSNAQASTSGVGAIGLLAQSIGGGGGAGGSSEVMASAANSSGSAAYAGGISLGGSGSGGGAGGDVTVQNAMGITTLGAFAPAVLAQSLSGGGGVASGAASVTGNLASSSLTLSLGGSNGLGANAGTVTVDNYSWVSTSGVDSHGIVAQSIAGGGGLGGSLLSGDGSTAASIQHITTLGAGAESGGGGQVTLQAGSSVQTTGSRAIALIAQSIGGGGGVAGIPTESMSNVSLSGTVTLGGAGGGNGSTVSVSSTTAGSIYTNGSMAHGIVAQSIGGGGGIATMSSDTLILGGSSGGAGGTVTVTTAGQVGTSGTAAIGILAQSIGGGGGVGTSPGSVTFAGKSGDGGSVTVNVNASLTTSGTNAVGVLAQSIGGGGGVAVSDGQSTNWSGPTAASGQGGSVTVNVSAPISTTGAGAYGVIAQSVSGGGGLVMNGTTMELVNGANVLVNGSALISGKAAVYVLTGGSVTASGVGGTGISAQGNGDPIITLAPGTRVTGGPSGTAITSDGTETYITSYGTLSTLDWANGLAIRTSTGFAQIVNGGSLTGNLALTPGAANSVTNLGSGTLWAGSSLDLGGPAGVLTNAGMLRSAFSALGTTTINGALVQTSSGVLAIRADQLSGQSDRFLVTGDARLSGSVRAILDHPARAMPGHFDTPFLSVAGTLSTDSLTVLGDTAILDFSVANIASGLSLGTTINFTPSGLSAHGLTTGALIGEIQTRGSSLLFESIVPTLLQVTTVPGLERSYESVGGGAVSLVPTTTINAASAAMAGITTQMDRWRQGLRPASTALGYAAPERGDDVGGTAASGTGGHYFWGSTIASLTTGSGLSGSTIGGIAGLDGELSGLPALAGAAVSFSSTNISANAYGAVVSNSYGSFSLYGLYQAGPAYMSAVASVGYASSNFDRNLYNLGLNLATDSGLDGWILAGRFEAGYSFALGATGASLTPFIAFQPTQLWLGSGSEMFSLGAGISYQNTAIAALPLYVGFQLDGVWTAPNGQQIAPYLRAAWMHDFSPDRDVPRSFAELPTFSFSGTSIPTVSNAADLHAGLQFLASPTTTLSASFDAQISEGYSTFGATGSFRVRW

SEQ ID NO: 20643 - protein, 948 aa, Pseudomonas putida
MLVVTLPASAESLIRFDIDKQRADKAIIEFAKRSNQTIVFSFDLTKKHYANNLNGYYSVTSGLKKLLDGTGLIAVVDLSGLLSIQADEQERINTTMKKTTIAALLPLAIGTTGQVVQAQEVEQVEDEIESISVIGSRVPGRSSNELPVPVDILTAEDLANTGQTEVGRMLQAIAPSFNFSSSAISDGTDALRPATLRGLGPDQTLVLINGKRRHQASLIHINTSVGRGTAGTDMNAIPASAIKRIEVLRDGAAAQYGSDAIAGVINIVLNDAVDGGKIGVSYGEHSEGDGETTNVDISKGFALGEDGYLDATFNFRDRGSTNRAGLHGSCQFSGCTDAANGAQLAGDPRELTADRNTFRIGDATSEQIGIVLNTGYELGDGELYGFLTYSNRDNESAAFFRHNNNNGGNAPLQDGDATIPAGFLPKINSEISDLSYNFGYRTDFDNDASLDLSYTYGRNKIDYTTSDTINSSYANSLIYTSTMTADEIRSSIPREGFAYGLELSLQTLNLDYTKQYDLFALAMGAEIRTDEYRVTPGEEYSYRDYDTDAMGQSLYATDRSAGTQGFGGIGPVSEVDETRDVFSFYVELEADITDDLLVSGAARYDDYEGFGDSTNFKFAANWSVTDEISLRSAVSTGFRAPSMQQLYFNNISTQFINNPDPNAPSGDQIAVQVGTFRNDSELAKSIGIPELKEEESTNFSIGTVIDLGYDINLTVDYYSIDIDDRIVISNKLGFGLDNNLDNALTAAGAGAGQFFLNGADTETSGVDIIATWNTEVLSGDLKLVFAANFTETEVVNIFTPPNSALDGIPPEDIFSQQDISIIEDWQPEDRISLTGLYTFDDLTVNLGFNRYGEYTVTDGDSQTYGAEILTDLRIKYQVTDNLSFNIGGNNIFDVYPDENMIGNSRSGTIVDSAGNEIVNSPGVFTYSRRSAPFGFNGAYYYAGAEYSF

SEQ ID NO: 20644 - protein, 430 aa, Pseudomonas putida
MQGFTAPRFSSSARLAGGCIAAALCAEASAEEAGFIEGARATLQARNYFFSRDYADIKGASTQSRTQEWAQGFILNASSGYTQGTVGVGVDVTGLLGFKLDSSPAHAKSGLLPSLDSGKSADEYSRLGAAIKFKVSQTELKVGELMPNLPVLLFSDLRLLPPTYQGAMLESREIAGLTLNAGQFRSTSLRDSSNSQKMYALVNDPINPARLARFTSDRFNYVGADYAFNDNRTSVGVWQAQLEDIYQQRFYSFKHAEPLGDWTLGVNAGYFDAREDGRKIAGDYDNHALFSLFSAKTGGHTFYLGYQQIGGDDGFIQVGANTNPMGNTLPTYEFSAPGERSWQVRHDYNFVALGVPGLTSTLRYVKGRDVDTGLGFEGRDRERDLDLAYVVQSGPLAGLGIRVRNVMARSNYRTDIDENRLILSYTVKLF

SEQ ID NO: 20645 - protein, 433 aa, Pseudomonas putida
MFPRMFAPFPLAPGRRVAGLLLMCAGVHAQAAGFLEDSRAKVEARTVYFNRDFRDGHSTSSQGASKREEWAQGFILNVQSGYTQGPVGLGVDALGMFGVKLDSSPADSNSGLLPSSGHDPRHAADQYAKMGLAAKVKVSNTVFKYGSMMPDVPLLKYNDGRLLPTMFHGAMLTSEEVRDLKFTLARLNKYTARDSTDRQDIRVHCKNKRYACDTQADHFDLAGLDYRFNDRFSAQYQMAKLENIYRQHFLGLAASQPLAVGSLSADLRLIKSDDIGNARAGQIDHRAFSGMLGYSLGGHKVSAGWQRMYGENAMPYLDGSNPYLVNYAQVNDFAAAQERSWQLRYDYDFKALGVPGLTFFTRYINGDHIKVPGSNVQGKEWERDTELKYQVQSGTFKDVSVRLRNSTYRSNYEKWARDMDETRVIVSYTFSIF

SEQ ID NO: 20646 - protein, 252 aa, Pseudomonas putida
MSIAAISILVGGGLPTFKNGLIMKNINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFTPWFNLTVRNRFNHNNYSSTDLNGDLDNNDSYEIGNYWNFIITDKFSYTFEPHYFYNINDFNSGNGTKHHWEITNTFRYRINEHWLPYIELRWLDRNVEPYHREQNQIRIGTKYFF

SEQ ID NO: 20647 - protein, 447 aa, Pseudomonas putida
MTCRSPLKLAACLALASVGNQAMAAEESAEGFIEGSTLSVLNRNFYFNRDNRDSAAPMHNPNKQPDNGYSEAWAHAVITRFESGFTQGTVGVGLDAFAMLGLKLDTGGGRNGGRSSFDVMPVDRDGQARDEYTKVGGAAKVRLFDTVLKVGDVFPANPVVAAGDSRLLPESFRGVTLENTSIKDLTLQAGRLHAMSQPMSSDLRENFVTFYGGPVDSPWIAYGGGDYTLNDHVSVSLFSSRLKDVWNQYYAGTSLSWPLSDELALLGGFNYYKAVDEGQRRLGAFDNDIWSAKVGVRLGAHTLALTHQRNNGDDDFDYLRQSDSIFLDNSIQYSDFNSPKERSWMLRYDLNMAAYGVPGLSFMTRYGKGTDADYSNANATYMRRDGDGNPLTDQKRWERDIEVKYVVQTGAAKDLSLRVRQATTRATAFESDLDEVRLIVEYPLSIL

SEQ ID NO: 20648 - protein, 381 aa, Pseudomonas putida
MKGSIFSAVIPVLLTAGVANAAEIYNKNGNKLDFYGKVDVRHQFAKITQKSDIYPIYSEDGDASYVRLGFRGETQINNQLTGYGRWEYNIQANQVEANDSEGNQTRLGFAGLKLAKYGSLDYGRNYGVLYDVNAWTDVLPVFGADSMSQADTYMTNRATGVLTYRNTDFFGLVDGLNFALQYQGKNDEDSKNSRNSHSKYGSRSKPNGGSNGDGFGLSVTYDIGNGISVGGAYSNADRPITHERLVTSVARGERAEAWNVGAKYDANNLYLAAMYGETHNMTSFGYQDIVSAKTRNIELTAQYQLDSGLRPSLAYVQSRGTTFFTHQDWVKYISIGSYYNFNKNLSAYVDYKINLVHDTPFTKYLDVNTNNAVGIGLVYQF

SEQ ID NO: 20649 - protein, 666 aa, Pseudomonas putida
MPATYKTKIISQLYPLLRTLQTLLIPIFEILSLHIIELRLNGGTVSKIYINGRELHDRTELSSLQATDIENVEILPEADLQYNATTKGGIIYISLKKNADGGGNGSPSLLGEMRKRNSHWERLGLPLSLRLGKWNFYNNLVLSNAGDPYITENITHNSHLNTHIVNQNIDRKNIRRINETFSMLYDITTLQSIGLNCMVKQAGSTLKSSSFSEIQETEKEYTSSYHSKGKGDDKIYQASLNYNWKSKNGKHTLRTVLDYLRSDETKELNHHYLYQYPEKNEEDNKCSNTGTVSDLWKAEINYIFLLNKHSRLKWGGDYYNNHTGNQMYYAYQSEEGWQKEDKSGLFTYKGIGYAGYAEYVWQWKKFTLNGGIRVQEDEVKCISNNIAGDKRTYRNLFPSIKVGYLFSEKNQASLSYSKRMGNIPYKSMNPAIVYISEYSYAKGNPDLVPTTEHRIRLLLSLSNTWSISYAYAKCKDDLFPLIYQDKDNPIITYTMPTNIGKSYRHAFSIGFTKALFSWWTTNASLDGDYTKEVSPKQTYHIVHCLFFCDNSLRFTNTFGGSFNFMAERRARRSETIYHSVYNMNAGLYKYFLDQKFCINLSVYAILNKRRNLTTITNNNLSRIEENNKTPYQGACLNLIYKFDFGKKVKVKRAESIQTTSDSYLRK

SEQ ID NO: 20650 - protein, 1096 aa, Pseudomonas putida
MTRSRTAIGLLAALVLCAAVLVTPSFAQTSMGRISGTVTDASNASITDAKVTVTNVDTRAPRTAATDASGSYTVTNLPIGNYTVEVAKQGFKTSSHSGVGLSADARITVDFKLEVGNLSQTVEVTAVNTEQVNTVSGEVSRVIDSKQVDNLTMNGRNYVQLMTMVPGAIVTNPDQFSTTTSLASNNQTINGNRADSNNLTVDGAYNSVAGSNSSLVNNVSPDFIQEVKLQTSNFSAEYGRFSGPAFNIMTKNGTNAFHGGAFEFFRNNDLDARNFFAAQKTALRFNNFGYDVGGPIKKDKLFFFVGEEWKRLRQQQNPTRVTVPTTALLNGDFSSQAQLFFPGTKNPIPNNNIASLITTDGKAIANVYKTMSAQSGATFTNTATANNLTLYPLNPLNFREDIVRLDYRINDKHSIYFRWLQDANSLLDPFGTFSSSNLNTTPTNRNRPGESYLLAETWVISPHVINEARGNATWVSQHILPDGNTWQRSTYGFAYPQLYPGGWFPDGIPQVSVTNYANFQGPNFALMSPSTDIGVSDTLTLLLGSHTLKAGVTVVRDRVDQNGRPAYTGNISFNTSGNPNTTGNALADALLGNFRSYTEASADPIGFFRFTQPMAFVQDSWKVNRKLSFELGLRYEYVQPMYTAGNNMANFVPGLYDRSKAVTMTTSGTLVPGSGNAYNGLIRVSDVPSAQQGRVPGSTTPFFQSIPAGTQRGGYSSANTFGPRLGFAYSFDEKTVIRGGFGMFYNRPEGNVTFSQVNLPPILALTEFDNGNLSNPAGGVPANTLPVGSITAIDPALKATYVEQTSIGVQRQLPKAIFVEVTGVGGLGRHLLRQPNINFPDLKQVAANPSYSTIYFNPYPGYTSIQQYLSDATSNYYALQTFVSKRAGNVLFTGSYTWSKALADASGQGDNSENYQNRHFNYGPTSFDRRHAFVATFTWEMPKLKQANAIVRGVAGSWQISGVIRLQTGPYSSVTGATSTTTRRADYVGGDVYAQSNKNINNWLNKAAFVTASNGAWGNSGINIIEGPGLQSYDLSLAKHFNVTERIKLRLQGDFYNAPNVANFSGLNTTITSSAYGTVSSAYPPRQIQLALKLAF

SEQ ID NO: 20651 - protein, 776 aa, Pseudomonas putida
MIVHRKYRVEKIRGTVSNLTLCGTTLLLGAQSVAHAADTLKRDEKKKKTHDPAIHQQGRPLPAHEEIDVVGQWQHRSPKFTAPLLDTPKSVKIISRELLDQTASHTLVDALRNVPGITMGAGEGGNPVGDRPFLRGFDAQSSTFVDGLRDVGAQSRETFNVEAVEVIKGDSGAISGRAGAGGSIVIDSKMPRLKNSLDASLGFGNAGYKRGTLDGNWQFSRTGAFRLNLMGDDENKAGRGPTEFKRYGVAPSVSLGLGTPDRVTLMYYHMQNDDLPDVGIPYDNPTFNARTDGAPRLMTAGNGAPVKVPFDTWYGLVNRDSDQDSIDMGTLRLEHDFNSHLHIRNTTRYSETSQNDLWTMPDDSQGNIYYGYVYRRLNSRVSTFDTAINQTDFYGTVSLLGFRNQFSTGMEFTREQGKNDTDTAYVNGVNVASGTNFTHCATALAFTSHTCTTLSNPNPNDMWTGDIRRTGNPNSTRMDTKAVYLTDTVTFMPQLLGNFGVRLDNVQSTYRAQAGEYGRGDNLFTYQGGLVYKPARNGSIYASYATSAIPPGNSVGQGADDISLGADRTGNIGSVLKPERDRTIEVGTKWNVLHDRVTLTGALFQIDTTNFKIATASGGISNGGSKRTRGGEVGVSGHITRDWSMTAGYSYLDARLVQAGGSGAAAGLMNGRRAPNTPENSLALWNTYDITPGFKVGSGVYYMGKVYGADSPTAPKYVPGYWRFDIMASYRFLKHYTLQLNIQNLTNKRYFTQAYVTHYALQAAGRTAFVTLNAHF

SEQ ID NO: 20652 - protein, 708 aa, Pseudomonas putida
MPAFKTLPTALLGLALACPALAESQRLELGQVLIGAEDRSGEDASVEEAEARLAQVPGGTNVVDMRRPLQGRVASNQDVLAYQPGVYAQSAGNEGTKISIRGSGINRAPGAHASGLYTMLDGLPLTGPGGTPYELLEPLWLDHVEVLRGANGFERGSLALGGAVDYVSHTGYNAPLLNVRYVMGSHGYAQRQVSSGQVLGDFDYYLSMTDAHSDGYQDHTASKSQGVIANFGYRFNPNLETRFYIRHRETDNDLAGRVTKHSIEHDPRAANPAYVTRNDSRDQPGSTFIGNKTTYYIDDDSSIQTGLVYHDYPMDLREGPNRLKVAYTDVSGTFDYKRRDTLWGMESNSTVGLRVTKHLPNDGASERVRIPTGNTAGYAPGTHMRNFTYQGSDSVLHVGNDLEIADDLWLTTGLAAIYTRRESAVTYPEGGGKTSLGDWDYAPRLGLRYQVTPDLQLFGNLSRSVEAPHPWSLIYSSNVRFPAGSGAATGTQRDPVKLQNQTATTLELGGRGDSALGEWSLAWYYAQVRHELLSVLPDANTTTPYELNASPTVHQGIEASLLSNLWSANDGGKLSLRQAYTFSDFHYRDDDRFGDNRLPGLPMHYYQGELRYDFPQGFFAAVNTQLVSKTAVDYANSYYADPYATFGATLGYNAPKGDWQTWLDMRNLTDKHYAATVTPGYDDKGLDAARSTPGEGMAMYVGVSWSLL

SEQ ID NO: 20653 - protein, 191 aa, Pseudomonas putida
MCSNSWAANPNQQTEDEWKFTLKNAYINRDFDNDALKDTGSWSQAASLFYKSKMHETPLVIADKPITIGADASVQYAVRLSSDKHVADTVLPFNKETQSQASDYLKYGATLKLGYDKTLLSVGELWLDLPVTAVDASRQLLTSYWGTNLKSQLSDQLYAEIGRVEKCRHEMKKTLKSFLSHPMGLLKNLMV

SEQ ID NO: 20654 - protein, 765 aa, Pseudomonas putida
MNPQSITPVFTPFSQSGNCLKPLAFCVAVAISGGAVAADGKPLELDATQIEDSALLPADDAGQLGYTVESTRSSTGLALTPRQTPQSVTTITRQQMDDRDIHTIEQALETAPGVTANKSEVGGRTDYRARGYSISNWKVDGLQTQGGSDFSGSGNALNMDLYERIDIVRGANGLLGGTGDPSATVNLIRKAPTKTFGGSAYATYGSWDKRRLGADLNLPLSEDGRLRSRFVMTQQDANSFRDNQSERSRAALANFEFDLDDATTLGAGYQYEYNKVVGGGWGANIPIWYRDGSKTDLPRSTNVVPSWSFGEYTTRTAFGSLEHRFDNDWTLDLKAAQATTEALNHRGLAKVNSAGRGSYGGYWDQDGSGAVLNGLHSSSDTTQQSAQIDLSGPFQLFGRTHQAMVGYNDSRTVGWSPQYTCTMVGDGMTSAPALGCQFRANNGFPVTDWHNGVDDDYDLIASRTGLHSKTTTRLQGMYAATRLSITDPLSVIVGVRTSNYSSVTRSVAGERSSQEENGIVTPYLGAVYDLNDNYSVYASYTDIFTPQTSETSSGSKVEPIRGQSYETGIKGEWFDGRLNASAAYFRTKQENKAVLDGDLTTPTGGSAYKAGSGQETDGIDLEVAGALTPNWNVYAGYTYLHFRRVDSDGRSDPSHLFKASTTYRLSGPLDRLTLGAGVTAQTNIRAISSPAGQPTNGVSNGATDVNWSGYAIWNAMAKYQLSDNTSVSLNANNLFDKHYYSQYGFYAGAIYGDPRNLSLTVSTAF

SEQ ID NO: 20655 - protein, 1377 aa, Pseudomonas putida
MSGKPAARQGDMTQYGGSIVQGSAGVRIGAPTGVACSVCPGGVTSGHPVNPLLGAKVLPGETDIALPGPLPFILSRTYSSYRTKTPAPVGSLGPGWKMPADIRLQLRDNTLILSDNGGRSLYFEHLFPGEDGYSRSESLWLVRGGVAKLDEGHRLAALWQALPEELRLSPHRYLATNSPQGPWWLLGWCERVPEADEVLPAPLPPYRVLTGLVDRFGRTQTFHREAAGEFSGEITGVTDGAWRHFRLVLTTQAQRAEEARQQAISGGTEPSAFPDTLPGYTEYGRDNGIRLSAVWLTHDPEYPENLPAAPLVRYGWTPRGELAVVYDRSGKQVRSFTYDDKYRGRMVAHRHTGRPEIRYRYDSDGRVTEQLNPAGLSYTYQYEKDRITITDSLDRREVLHTQGEAGLKRVVKKEHADGSVTQSQFDAVGRLRAQTDAAGRTTEYSPDVVTGLITRITTPDGRASAFYYNHHNQLTSATGPDGLELRREYDELGRLIQETAPDGDITRYRYDNPHSDLPCATEDATGSRKTMTWSRYGQLLSFTDCSGYVTRYDHDRFGQMTAVHREEGLSQYRAYDSRGQLIAVKDTQGHETRYEYNIAGDLTAVIAPDGSRNGTQYDAWGKAVRTTQGGLTRSMEYDAAGRVIRLTSENGSHTTFRYDVLDRLIQETGFDGRTQRYHHDLTGKLIRSEDEGLVTHWHYDEADRLTHRTVKGETAERWQYDERGWLTDISHISEGHRVAVHYRYDEKGRLTGERQTVHHPQTEALLWQHETRHAYNAQGLANRCIPDSLPAVEWLTYGSGYLAGMKLGDTPLVEYTRDRLHRETLRSFGRYELTTAYTPAGQLQSQHLNSLLSDRDYTWNDNGELIRISSPRQTRSYSYSTTGRLTGVHTTAANLDIRIPYATDPAGNRLPDPELHPDSTLSMWPDNRIARDAHYLYRYDRHGRLTEKTDLIPEGVIRTDDERTHRYHYDSQHRLVHYTRTQYEEPLVESRYLYDPLGRRVAKRVWRRERDLTGWMSLSRKPQVTWYGWDGDRLTTIQNDRTRIQTIYQPGSFTPLIRVETATGELAKTQRRSLADALQQSGGEDGGSVVFPPVLVQMLDRLESEILADRVSEESRRWLASCGLTVEQMQNQMDPVYTPARKIHLYHCDHRGLPLALISKEGTTEWCAEYDEWGNLLNEENPHQLQQLIRLPGQQYDEESGLYYNRHRYYDPLQGRYITQDPIGLKGGWNFYQYPLNPVTNTDPLGLEVFPRPFPLPIPWPKSPAQQQADDNAAKALTKWWNDTASQRIFDSLILNNPGLALDITMIASRGNVADTGITDRVNDIINDRFWSDGKKPDRCDVLQELIDCGDISAKDAKSTQKAWNCRHSRQSNDKKR

SEQ ID NO: 20656 - protein, 155 aa, Pseudomonas putida
MKPNAGKLFAGLLDEEEEASFNPQSFSDSYSDIMASLNTRYDVNQNTIVRAPVSNTIARPKFSDSSASSQRDIIEEEISSGNPYLDPYESTNFDLSIERYNDKLGLFSANFFYKNIDSFIYDADTDVTISGVEYELTRPINGETTKIKGIELVWQ

SEQ ID NO: 20657 - protein, 416 aa, Pseudomonas putida
MNHTPCVALGLTLLSQPLLAAEGGFFEDSKATLSARNYYFSRDFSDIVGANKQSKAEEWAQGFILDFKSGYTPGPVGFGVDALGLLGIKLDSSPDRTNTGLLPVHGDGRAADEYSRLAPTFKARISKTELRAGELQPNLPVLTFSDIRLLPPTYQGVSLSSAEIDGLTMQAGHLKSTHLRNEGGDGKMNAMLGHVPMRQAESDAFNYVGGDYAFNANQSSVSLWYGQLEDIYQQGFVGLKHSKPVGDWVLSANLGYFTAREQGDALLGNIDNQAFFSLFTARHGGHSFHAGYQGIYGDSPFPRVFANISPLGNEVPTYEFAYTDERSYQVRYDYNFAAMGVPGLTATVRYITGNNVDTGLGYEGRDRERDLDIGYAVQSGALKGLGIRVRNAMARSNYRSDIDENRLTLVYTWQLF

SEQ ID NO: 20658 - protein, 708 aa, Pseudomonas putida
MRRTFVSLCVLHAVSPLAFAEPEPLSDPNPIELQALSITSTADGERADGPVDGYKATRSASATRTDTALHETPQSVSVVPKDVLVDTGATRLQDGLDYAGGVGRANNFGGQGLTTFTVRGFTTGEFYRNGFPINRGYPNAPDANTVERLEVIRGPASSLYGRGDPGGTFNVVSKQPLPESKVTLGSQFDDQGMHRATLDATGPLSQDGSLAYRLNVLGEGGDSFRDDVESERYDVAPVISWQVNDATKITFEGDFMRNNHPLDRGLTRYPTQTGSASRDTYIWEKGSDNLLHNDNNMAQVRFEHLLNDNWSLAGGFQFLDGSLKGNAVEADGAPADGRTLQRNFNYRKLEWTDRDWQLNLTGHFDTGNFSHTLLTGVEYENYDYNSIIQRSSAAYPIDIYNPVLGQPRPALNRTTTWDKENLQTWAFFIQDQVALTERLKALAGVRFERFEHDYDNKLNNAGDFSKGENGVTPRLGLIYDLTDTLAVYANTARSFKPNTGTPASGGGFDPEKGKSYELGVKWESLDRQLSVDAAIYHIVKENVLTNDPSDLTGTYKIAAGEVRSRGLDINVAGNLTPEWRMIGGYAYVDAEVTKDTTLPKGTRLANIPRSTFSLLNTYEFQDGLVKGLGLGVGVKYVDDRAGQTSAATYTMERYSVVDLLSFYKVNEHVRLNLDVKNVFNKGYDEGAFNSYVYPGAPRTVQAGVSYTF

SEQ ID NO: 20659 - protein, 140 aa, Pseudomonas putida
TGQGDMTYRIGLSFDWDKTWLESSAGHVSGYWDAAYTYWEGGDASGAHSLSFSPVFTYEFSGFTYTPYIEAGIGLAAFSKTDVGDQRLGSAVNFEDRIGFGLKLPGEQKVGIRAMHYSNAGIKQPNDGIESYSLFYSTAF

SEQ ID NO: 20660 - protein, 442 aa, Pseudomonas putida
MSADKKKSEYGVPGFSLQNQSFADSYETLPVGVKIDQNRFVLNSNFIQPISSAEEISLNFQQLSNKSGEYVGTAKANEYKIDNQLIELIMKQSSFKGLDGILGFSLKNRNIEGSGTQRYLPNVSTISKAIFLQEELNIKQFTLNTGYRFERIEHELQDNDFKLARNASNSRIENRKYNLNQYFIGGEYKVNNFINLKVDYGISERAPEVNELYSSNVHYSVMAQEEGDQNLKPEKSKSLELGMFLNWNNWVMQLVGYQMDFENYMYLSHSGVAVQNRLPLKYWKQTDTDVKGFEIDLIYDFNLAHIGNIKLGGLADFVKNKAVNPTDIRLANDGVYLPNMPTNRYGMFLEWRNDSWKGKISSIYYDEPRYLGKNVIQEVPLSGYNLLEFKIDKKLKIKNASFDIFLNGTNLLNEEARPQNSPLKYIAPLPGRAFQLGITMHI

SEQ ID NO: 20661 - protein, 684 aa, Pseudomonas putida
MEVFGTNRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTRVQANAVYDLGRSDQNGSITYSSKAISENMVINNGRANVWAGTMVNVSVRGNDGILEVMKPQINYAPAMLVGKVVVSEGASFRTHGAVDTSKADVSLENSVWTIIADITTTNQNTLLNLANLAMSDANVIMMDEPVTCSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLFFGYSHSDIGFDHGGKGNVDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTQILRAEAGTAVSYHMDLQNGTTLEPWLKAAVRQEYADSNQVKVNDDGKFNNDVAGTRGVYQAGIRSSFTPTLSGHLSVSYGNGAGVESPWKTQAGVVWTF

SEQ ID NO: 20662 - protein, 1016 aa, Pseudomonas putida
MVFFAHSSYAQIATISGTISSENGIPLPGVTILIKGTSKGVISDFDGNFSINVADGTGKTLAISYIGFRTAEVKLTGENQTVNVILEEDSNALDEVIIVGSSLTQSRKKLGNAVTTIKSTELVKGAPVNITTSLQGKVPGAQITQNSGDPAGGFSIRLRGPSTIKGSSEPLYVVDGVITSNLTTNVTNLNVTAGDAQPGQNRMVDINPNDIESINILNGAAAAAIYGSRASNGVVVITTKRGLSTKDGPELYFKSTFNVSTIRKKLDLNLRGEEFETIADSPLSGRLWPIFGFNPDTGELTPFNYLDSNKFDTTRYDYQDEIFQTGFGTDNYFSARDGNEKMNYMASIGYLTNEGIIKNTNFNRFSARFNFNHNPVDWLSYDVGLYYANSQSDEKPDGNVFWSPINSLNITNNVFDITRRDANGNLLAVENTRINPLSIIETFDITQQVNHFIPNLHMKIIPFENFIIDQIIGIDTYSQKGNIFIPVYPYEGVNPAYFDQGFVGQAEAKIFNWNYDINATFDTDINENLSSQTTVGYSFQASKLEFDAVQGRDLDSNNDPTVSLQTQPIDTKLDIFGFFLQETLSYKDKLFLTLAGRIDGATNFDVDQRSNFYPKISGSYVLSNESFWVDDSFINSARLRASYGEAGNLTAISPYERFSSYTSNDFLGNTTLQQNNRLGNENLAPERTKEFEIGTDLSFFDNRASLLFTYYRQNIEDLIVSRVLAPSIGGSSRTENVGTMRNDGIELYARITPIKREDFVWDVNFNFSSNKNEVLKTIGGDISIVTVSGAPPVVQEGQPLGVFFGTYFARDGNGELILSGSSTTGAPEGVPQPERGDLATGSPQRDANGQPIGDLLRKVIGDPNPDYILAVGTDFAYKKFTFSMLWEAVQGFDVFDADKRTRQGVGLGRLAEQELTGELPRGYIAGIYPIEEFRMEDGSFVKLREVSIGYQFPSLFIDHLKDVKIALIGRNLISFDNFFSYDPETNAGGQSNLLRSVNFGNVPIPMTFSLSLSANF

SEQ ID NO: 20663 - protein, 376 aa, Pseudomonas putida
MNTRITSLLLMIQGACLAAQAKAEGFPTLARIAPGFGYYGLDYGFDDTLKVYGTVDAFASYHDSQHHSGFRLAGGGAWTNKLGLYARKALDPDTVVELDVEEGFNLNGEALEGTWDTVGTLRLATVALRSRTLGKLEFGKTYGMATPTYADPFLATYGSPYTYLALPAAGKGAYYLDLRPKHTLAYTSPTFSGFSLGTALSFGFDDAASAGRTVRGGGARLQYRNSRVMLLASYNRYYSDPWDDGGVSRQTANDFKSLSAFYDFGPLATSLTWQRQDVDQAGTPSTTLYTFGMMAPVGELDVLRVAVMQRQVSARNKDAWGVMIGYDHFINPRWALYGRLGMIANQRASSVTYAGSPVDQAGDNPSNVSLGMYYHF

SEQ ID NO: 20664 - protein, 390 aa, Pseudomonas putida
MILGDPLMKKSLLALVALGAFAGAAHAQSSVTLYGIIDEGFLFNNNAGGKHLYGLASGVMQGSRFGLRGTEDLGGGLKAIFTLENGFDVNSGRLGQGGLMFGRQAYVGLSSQYGTVTLGRQYDSVVDFVGPLEAGDQWGGYIAAHPGDLDNFNNAYRVNNAVKFTSANYGGLTFGGLYSFGGQAGQFSKNQVWSLGAGYTNGPLVLGVGYLNARTPNQFGGMFNNGSTSSSVSSPVYGAYANNANTYQVIGAGGAYTFGAATIGATYSNTKFKGFSAGPFVNQTATFNNGEINFKYQLTPALILGAAYDYTQGSKIDGNSAAKYHQGSLGVDYFLSKRTDVYAIGVYQHASGNVLDSNGNVLKATAAINGLAGSSTSNQVAARVGIRHKF

SEQ ID NO: 20665 - protein, 733 aa, Pseudomonas putida
MKCRIRGAHLKTLLASGVALAPLMMSGIALAQEGNATQLERIVVEGGNAAGASATGPVDGYVAKATATGSKTAMPLNEIPQSVSVVGREELDDRAVVNKVDEALRYTPGVLSAPFGTDPDTDWFYIRGFDAAQTGLFLDGLPLFSFGFGNFQVDPFMLERVEVLKGPASVLYGGSNPGGIINLISKRPLDEPLYYTEVGINSNGNAFTGFDVNDKLNDDGTVRYRLTGKVAGGDNYSDYSEDLRGFILPQVTYAPDDATSLTVFGLLQSLDQVHVGNGFLPYVGTVEDAPFGKIDRDAYYSEPDIDEGSYTQQMLGYEFKHDFDNGWTFTQNARYANLHKHEKYPYTYGYVGGAPTGPDYLLNRIGFEATSKVDSFSIDNRTETDFDLGATTHTFLAGLDYKYYRLDHIQACCGATPISATNPVYGTPQGANFVYLDQIVTQQQIGLYAQDQIRFGDGWLVTLNGRYDYVDTKSDAAIGTSYESNDGAFSGRAGLAYEFDNGLTPYVSAATFFNPLVGTGTSDPSDPTNPAKMVALEPEEGYQYEAGVKYEPSFIDGLLTASVFQITKQNVSIAVPGFFVNSQLGEVRSRGVELEGKINLNTNWKIISAFSYTDLEVTEDLNASLIGNTPVLIPETQASLWLDYTVANGTFEGVSLGAGVRYQGESWADAENTKKVPAATLVDAAIRYEKNDWTASLNVANLFDKEYVAGCQGLQTCGYGESRTFTLKLSKKW

SEQ ID NO: 20666 - protein, 1061 aa, Pseudomonas putida
MVRKSIFTGLVVCLCVLVPTVYSQTQTLTQNSTQSAGTFTGHLSGAGMDGATVTFTNSTTGAAQSATTDSSGGFTFNNLAPGTYRVSVHTKSGLQLGESSIEISPSNTNQVQVNFASTPAAPAAKLELDEPTPTVQTNSAEVSRSYDSQVIRSLPVLDRQNQELISLMPGVTPPAIAGDRITDPQQTRSFNVNGLPAYANLHNQDGAYGNEPFRGLPSRILPDEAVQALEVRTSNYNAEYGLSGGSWSSTLTRPGTNAIHGSLFEFNTNSFFRNGRQLEATTQSPRFNENQFGGTAGGAVLPDRMFWFISYEGRIQRGNQEAEATVPMAGLSSGNFSSFPGTALYNPGSGSTTGTGRSIFTGNVIPQSQLNPAAQQILSLVPAANRPGFYNNLVGSVPLRDDNHRIDAKLDHRFSEKSTGFFRYGFTQDSVDQGSILGLAGSPLNAELRGINAVGSYTHVFSTNFLAEARFGYDRYRNQISPWGSFPTTGLAAFPNGLPSINIAGFSSLGFAADVPRKEISNTYDGALSMSYRSGMHALRFGIGIRELEANGFANPYFSPLGSFVFGPGATLGNTASSVNLGPALLQVNALAGFLTGSPSMAGVASYTTTPAYRQMQYSAYLTDTVNLMKRLYLELGVRYDIFDPIEPSRAGGAVVYDPTTNTVNSLGVNGSSIRSYRTDLNNVAPRVGLAFRATERFVFRAGYGIHYFALPFAMMPFNPATVGTQSGIAGGLGTTAFTIPAVTTPLGTTAPNLPFLVSGRNQNTPYVQTYSGMLQGDLGNGFLLDIGYVGNVGRQLPYFVSDTGQPGTGLAGLPIAGRTALNTTFGTGLNSNFNSLQVNLTKKFAAGLAITGAYTYGKALDYGTYLADPFSRAANYGPADWDRTHILTVSHDWRLPFGVRQKYFTSGWAARMLGDWELTGILRWSTGSPFTVTSDPLACACLGVQSVPANFTSAAAAGVNGASSFNTSLFSTPAAGTFGSLSRNAFRGPDMFVYNAALFRNFAVRENVKLEFRGEAYNITNTTNLVNPIANAGTPGFGTSVGSLNGLAGRQFQVGARVLF

SEQ ID NO: 20667 - protein, 746 aa, Pseudomonas putida
MQCRTSPNSLALAFVALASPAMMATAAETVERSPGEVLEMPVADDALVIQDTLVTAEREARQALGSSIITEEDIKRRPPANDLSDIIRREPGVNLTGNSASGARGNNRQIDLRGMGPENTLILIDGKPSSARNAVRYGWNGDRDTRGETNWVPAEAVERIEILRGPAAARYGSGAMGGVVNIITKRPTEAFKGSLNLFTQMPEDSAEGVSRRANFNLSGGLTDNLGFRLYGGLAKTDADDLDINADHANSTLVAGREGVRNKDINGLLSWRLNDEHRLEASAGYSRQGNIYAGDTMNSNGGSNVDLISSLYGHETNVMQRNTYDLTHLGDFSWGTSKTSLAYEYVRNWRLNEGLAGGPEGAINDSGAAMSRLRNTRLSSEVNLPFAMGSVEHVLTLGGEYLYESLNDQGSFRPQSFDPSGGGSDVISGFDRSNSKMTAKSYALFVEDNIVLGDTTVTPGLRFDHHETFGDNFSPSLNLSHKLTDALSIKGGIARAYKVPNLYQSNPNYLLYSRGNGCSVQQSNSGGCYLQGNADLKPEISVNKEIGLLYDRGTWRTSATYFRNDYKNKIIGDTDVLYTINSGRRVTQWENAGEARVEGIEGNLFVELTPVLDWNTNLTWMLDNDNRETGEPLSVIPEYTVNSTLDWRATDKLSFQVAGTYYGKQKSPTYNYRTEESYDAEAQQDVEAYGLVDVSTGYKFNANYDVRVGVNNVFDKQIYRGGNASSSGANTYNQPGRAVFASLNISF

SEQ ID NO: 20668 - protein, 177 aa, Pseudomonas putida
MSGSRLADNHTLSAGYAQSKVQDFKNIKGVNLQYRYEWDYPVSVVGSFSYMKGDWADSHRDEADDFYRQQADIKYYSFLAGPAYRLNDYISFYGLVGISHTKAKGDYEWRNSVGADESDGYLSESVSKKSTDFAYAAGVIINPWGNMSVNVGYEGTKADIYGKHSVNGFTVGVGYRF

SEQ ID NO: 20669 - protein, 718 aa, Pseudomonas putida
MSRFILAGVAGIVMGLIGSSKMEARAQEQLPEITVHAPKPKHAKRRARVAARPATPAPLPVPPQVPAPPEEPRAEVPLASASLLTAKQVLGRGAASLGDTLGTTPGVSATSFSPVASRPVIRGLGGFRVRTQENGISSGDMANLGEDHAVTIDPLAAQNVEVIRGPGTLRFGSQATGGVISASNNRIPTIIPRNGLAFEARGGLNSVSNGRDGAVQLEAGGNNVAIHVDTYARQAGDYRIPGGIQANSSYRSEGHAAGGSYIFDRGFVGMSFQDTAMTYFIPGIDSAKVKNHIDLRQKKWASRGEWRVGEGGIDTVRYWLGYSDYHHNEINGVGANALIGSRFKNREMESRIEVAHLPFATTLGELRGSAGMQWSRRNLSVAGATDPLLAPAQNANLAGFLFEELRITPLLRAQGALRIEQTETNGTGAQFPASYLPPPNQPTVFPVDRRFMPVSASAGLYYEMPRDIVARVTVQHVERAPDPIELFYKGPHDTPRTFEIGDPTMTLEKANTVELGFKRARGDTRFELSIYHTRYQNFIFKNFTGIRCSESFASCGAPGASYDQIIYSQRDARFTGGEIQIEHDVARVWNGIYGVEAQYDIVHAIFTDGSFVPKIPPQRLGGGVYYRDPNWTARINLLHAFAQTNLGAFETPTPGFNLFNAEISHTTTVPNGDWPVTLTVGLKGENLLDDDIRFHQSYKKDEVLQPGRNLRLFASMKF

SEQ ID NO: 20670 - protein, 729 aa, Pseudomonas putida
MPSRIPSRPALLAICCSVTLMAQAAEPIQLEATDVSADALKARPDALPDEFAGGQVARGGRMGVLGNQDYMDVPFTMTSYTAKVIEDQQAEDIGDVLANDPSVRESFGFGNQSKVFVIRGLPLAGDDISFNGLYGILPRQIMSTDGVERVEVFKGPNAFLNGVSPTGTGLGGNVNLQPKRAGDEPTRRYTQDISADGRIGEHLDIGQRFGEDNRFGARLNLSQREGETAVDDQDQRTKLFTAGLDYRGDNFRVSADIGYQKQRINHLRNSVRLGSTATKAPTAPDASHNYGQNWSYSESEDTFGMVRGDWDLSDNWTAYLAGGARHTREQGTYGTPVLVGNSGAATMTASDIVHGEDNTSFSTGLNGRLQTGPISHQIAVGANTMWTQAENAYIFYSPINTNIYDTVQQAKPGTVTSTGGDMGDPGVTGKTRARSIAISDTIGVFDDRLLLTYGLRRQQLRVESYTYDGTVSQGQPNLANDGSRKGDPYEESITTPVYGIVFKATDSISLYANRIEGLAQGPTAPANVSNASEMFPPGRTKQLEAGIKFDRQTFGANLAVFRIEKPSDGYTLNNVFVRDGEQVNKGLELSVFGEPVQGLRLMAGGTRMTSEQKNTANGSNDGNHAIGVPTFQLNASVDWDVPGVPGLALNARMLRTGGQFVDAANNVSLPTWNRFDAGARYKLKVAEKDLTLRVNVENLTDKNYWASANGGYLTQGDPRLVKFSGTIDF

SEQ ID NO: 20671 - protein, 992 aa, Pseudomonas putida
MGLNMTNFRLNVLAYSVMLGLTAGVAYAAQPTNQPTNQPTNQPTNQNGNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTSRNGHELENYDYKNANSLTQGKKREKADPYKIEQDSTLLKLSFNPTENHRFTLAADLYEHRSRGQDLSYTLKYQKTDPNLLEVDSRHTNDKTKRRNISFSYENFSQTPFWDTLKITYSDQRIKTRARTDDYCDAGVRYCEGTANPAGLKLTDGKITRRDGSELQFEKKDKNIDNNIYDFDKFIDTDDRVIEGKLGLRRSSGTWYDCSIFDCKDKTKMKIFETEHPYGYGTTGTWKKDFELEIKKLNDKNFARVKDANNKTYSILPSSPGYLERLWQERDLDTNTQQLNLDLTKDFKTWRVEHNLQYGSSYNTTMKRMVNRAGNDASDVQWWAEPTLGYSLLYDKPHTCKTAYGGWKANLCPRVDPKFSFLLPIKTKEKSVYLFDNVVITDYLSFDLGYRYDNIHYQPKYKHGVTPKLPDDIVKGLFIPLPSGKNNNDDPEVKKNVQQNIDYIAKQNKKYKAHSYSFVSTIDPTSFLRLQLKYSKGFRAPTSDEMYFTFKHPDFTILPNTNLKPEIAKTKEIAFTLHNDDWGFISTSLFKTNYKNFIDLIFKGEKDFKLVSGGSTLPFSLYQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTNTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 20672 - protein, 421 aa, Pseudomonas putida
MKKVMLKTSLGLAVAFASSHLFAAGFALNEQSISSMGTGFAGRSSSAEDASTVFGNPAGMSRLKREQFTVGGAAVIAKTDISGPGSNLGGETDGDMVPVVGVPMGYYVKPIDDHWSVGFGVYVPFGLVTDYGSDDAARYWGKKSHVEVVTFQPTVSYAFNDKVSIGFGPTINRIKGELGSSLINPFTPGSNDGEVKIKGDDTAIGYNIGILVQATDRTRVGLTYHSMVDYKLEGKTRVSTPLIGPFNGDKFDASLKIKTPESVDLSVTHELDDQWTLYAGSTWTRWSRLEDITVQNDVPAPLAGSAFETISEEQNWHDTWAHAIGASYKVNKEWVLRTGFTVDQSPTNNHDRSPRIPTGDRKVFSLGAGWSPNDDMTIDVAYSYLWEEDTKVNQVSASKGSYQAKYENSAHGVGASLTYRF

SEQ ID NO: 20673 - protein, 685 aa, Pseudomonas putida
MLYTPLRLSPLAVALWLAASPSQAVELEPQVITANPLGNRQLAAPSTVLEGDNLLQQQHGSLGETLNKQPGVASTWFGPGASRPVIRGLDGDRIRILRNGVGALDASSLSYDHAVPLDPVTVDRVEIVRGPAALLYGGNAIGGVVNTFDNRIPDSPIEGIHGAGELRYGGADTTRSSAGKLEAGDGAFALHLDANSRQFNDLRIPGYARSAKVRDTDEPGSKHRLENSDGRQDGGAIGGAYHWDHGYAGLSYSRYDSNYGSVAESGVRLDMKQDHYAFASELRDLDGPFSSVKVDAGYTDYEHSEIEEGEVHTTFKNKGYEARIEARHQPLGPVEGMIGAQVSRNEFSALGEEAFVPHTDTDSLALFMLEQWQATERLNLSLGARMEHTRVDPDAKGNENFVDADSASSFNAFSLSSGAVYQLDPIWSLAANLGYTERAPTFYELYANGAHVATGAFEVGDASLNKEKAISADLALRFDNGTHKGSVGVFYSHFRNYIGLIGTGNLREGGHDHDHDEDDHDHDHDHDHDDGFPEYQYQGVRARFYGIEAQDRWQLAENRYGSFALELSGDYTRAKNLDSGEPLPRIAPLRLNSGLVWELDRWQARVDVQHAASQHRKPANETGTDGYTTLGASVGYRFDIGQSQWLAFVRGENLTDQTVRYASSILRDIAPAPGRSVEVGLRTTF

SEQ ID NO: 20674 - protein, 444 aa, Pseudomonas putida
MFQLPKTCYIGLALGALATPASASEMFASDSPWMLGDWGGTRSQLLEQGYDFTLGYTGEMGSNLHGGYDHDRTARYSDQFTFGSHLDLEKILGWHATEFQLTVTERHGDNISNDRINDPRVGGFTSAQEVWGRGETWRLTQMWIKQKYFDGALDVKFGRFGEGEDFNSFPCDFQNLAFCGSQVGNWVGGIWYNWPVSQWALRVRYNLTPELYAQVGVFEQNPSNLESGNGFKLSGSGTQGAVMPVELVWSPRIQGLKGEYRAGYYYSNAKAQDVLKDSNGQPAALSGAAYRSSSSKHGLWLGAQQQVTSLASDQSRGLSLFANATVHDKKTNAIDNYVQTGLVYKGPFDARAKDDIGFALARVHVNPAYRKNARLANQAAGLDDYDNPGFLPVQDTEYSAELYYGIHLADWLTVRPNLQYIRHPGGVSQVDGALIGGLKIQSSF

SEQ ID NO: 20675 - protein, 429 aa, Pseudomonas putida
MLSSQPQAFAPTRSFAARPSAIASALALAGVAPMSQAAFFEDSTATFETRNMYFNRDFRDGTSAQQSKRDEWAQGFILNFESGYTDGTVGFGLDALGMLGIKLDSSPDRTDTGLLPTHDDGKAADEYSKLGLTGKVKISQTELKIGTLIPELPTLQPNDGRILPQTFEGGLLTSKEIKGLTFTGGRLDKAKDRNDTNWEDLALNNKNGRFGGTFSADNLALGGLDYQFTDRITGSYHFAQLDDIYRQHFIGMVATQPWGPGTLGADLRLAVSDDAGAAKAGNIDNTTFNGMLSYALGGHKVSAAWQQLSGDSAFPYVDGADPYLVNFVQINDFAGADERSWQARYDYNFAALGVPGLTFMTRYISGDNVSRAAGGEGKEWERNTELKYVVQSGPLKNVAVRLRNATFRSNFARDADEVRLLVSYSVALW

SEQ ID NO: 20676 - protein, 418 aa, Pseudomonas putida
MSISLPARQLLPGLLAMSCALPAFAANEGGFIEDAKATLNLRNFYINRNFVDPAHPQGKAEEWTQSFILDARSGFTQGTVGFGVDVLGLYSVKLDGGKGTTNTHLLPVHGDGRPADDFGRLGVALKAKLSETELKVGEWMPVLPILRSDDGRSLPQTFRGGQLTSKEIAGLTLYAGQFRGNSPRNDASMEDMSLNGKAAFTSDRFNFGGGEYTFNDKRTMIGLWDAQLKDIYRQQYLNLTHSQPLGDWTLGANLGYFIGKEDGAERAGKLDNRTASALLSARYQGHTFYVGLQKVSGDDAWMRVNGTSGGTLANDSYNSSFDNAKERSWQVRHDFNFATVGVPGLTLMNRYIKGDNVTVGSVDDGKEWARETELAYVVQSGSFKDLSVKWRNSTMRRDFSTNAFDENRVIVSYPLNLL

SEQ ID NO: 20677 - protein, 427 aa, Pseudomonas putida
MRVMKWSMIALAVSAGTSQLAMASAQDESKGFIEDSKLSVKTRMLYFSRDFRNNAPGSQSRVEETGLGFLGTFESGFTQGTVGFGVDAIGMLGLKLDSGKGRAGTGLFPTGADGRSQDDYSEGGGAVKMRISNTVLKFGDQFTALPVLATDDSRLLPEVAEGGLITSNEIDDLTVHAGHFTALNAQAQTYHDSLNLTEANVFGGTYAITDSLSTSVYYSRIEDHFRKWYGNINWALPISDKQGLVFDFNIYDTKSIGNNLTGAYVSKSDGTNELDNIAASLSAAYNVGAHTFTLAYQKVSGDGDYAYGVDGGGTVFLANSVARSDFNAEDEKSWQARYDLNFAEFGVPGLTFMTRYVSGTGATTRTTDSGKEWERDIDVKYVMQSGPAKDLSFRVRQATYRSGDGVYYGSPSIDELRLIVEYPLNIL

SEQ ID NO: 20678 - protein, 412 aa, Pseudomonas putida
MKICHTLPFALLGAGMIGSLPGTSVAAGFIEDSKATLGLRNFYINRNFTNPSNPQSKAEEWTQSFILDARSGFTEGPIGFGVDVLGMWSVKLDGGGGTYGTALLPRHDDGRPADDFGRLAVAGKARISKTELKVGEWMPVLPILRSDDGRSLPQTFRGGQVTSNEIAGLTLYGGQFRGNSPRNDASMDDMSYGGGLSDRFNFVGGEYKFNQDRTLVGLWNAVLKDVYEQQYLQLSHSQPVGSWTFGANLGYFHGGEDGSEKAGQLDNKTYSGMFSAKYGGNTFWVGLQKVDGDTWMRVNGTSGGTLANDSYNSSFDNANERSWQVRHDFNFVTVGVPGLTLMNRYISGQDVHTGAVTDGKEWVRETELAYVIQSGAFKDLSVKWRNSSIRRDYSNNEFDENRLIFNYPLSLL

SEQ ID NO: 20679 - protein, 447 aa, Pseudomonas putida
MEQRKRIKTLGSLALLALVGSSGTQAAEAFSSESKWMTGDWGGTRTELLDKGYDFTLDYVGEVAGNLHGGYNDDKTARYSDQFALGAHLDLQKILGWHDAEFKLAITERSGRNLSNDRISDPRAGQFSSVQEVWGRGQTWRLTQMWIKQKYFDGALDVKFGRFGEGEDFNSFPCDFQNLAFCGSQVGNWVGGIWYNWPVSQWALRVKYNITPAFFVQVGAFEQNPSNLETGNGFKLSGSGTKGAILPVEAVWSPKVNGLPGEYRLGYYYSTAKADDVYDDVNGNPQALTGEAFKSHSSKHGWWVVAQQQVTAHGGDVNRGLSLFANFTVHDKATNVVDNYQQVGLVYKGAFDARPKDDIGFGVARIHVNDDVKKRAELLNAQSGINDYDNPGFVPLQRTEYNAELYYGFHVTNWLTVRPNLQYIKSPGGVDEVDNALVAGLKIQSSF

SEQ ID NO: 20680 - protein, 426 aa, Pseudomonas putida
MRGSRTRRAGPRRRPTPQGRSAPTGSASAGAIEGSIAHDDRSGPARHATKRRRRAANRYHPLTAARSRSGSDRAAARACEAAATRARTASARRRRAAAAAIRAPRTMHRRRRSGARVVHADRMPYELHPVDPSRLPDLPAAQAPPLLEQLMGDDRNMVGLGWHFVGTTGRSTPVTTRTDALGLNSFHNAGSSLSLSNTNTLAFTFTHFVSEHWAAELGAGIPPVLTLRGHGSIALPLDRIFAGVHGRFPLIDLGNTQSNPLATTRAWLGSVVFKYYLGERDDRFRPFAGIGVSYTRFTNTNLNAVFQRKLASLGGLLAAGADIGSLQSLLLDPALFQRIWDAGGDLLLSGRTNVSAKVKSVWEPVFTVGASYQITRRFWLTGMVTYIPLRTRITLDINQPNRLLASNTFDISANPVLATVLLNFRF

SEQ ID NO: 20681 - protein, 459 aa, Pseudomonas putida
MKVFTLTALALSIGALSTVAQADPQSQDYLPLTLKSSSEQAQASGFINGQSLSGSTRNWYARERAARAPLWKYYKNDGTRHDTHSRENWVQGTILNYSSGFTQGTVGFAVEAAGYNAIALQQSREAIAGPNNRTLTHSDGDPIGQWSKLGLGNIKARVSNTTLTLGRQSVDTPMIAYIGNRALPSSFQGAFLHSAEFDNLSLDLGTFDRVSPRTEQSLSKFRSEYSATGVETDRASTAGINYQPFKSLSTSLYATKVDDFWNQYYFGANHVLGDSAVLSLSTGLNYYKTVDAGSQKMGKIDNDTYSLSLGLTHQAHTLSASWQQVNGNEYFDYLHETNGIFLANSLLSDFNGPNEKSLQISYVLNMAPYGVPGLKFNLYNARGWGIDGTHYRGTAYDVNGLDGETHYEWGIGTSYALQSGPLKDTSIRATYTTHRASKAQGDGSLDEFRVVTTIPFNIL

SEQ ID NO: 20682 - protein, 432 aa, Pseudomonas putida
MNNNKNRLSIAVALGLLGSVASSNTMAAGFQLAEYSATGLGRAYAGEAAIADGADAQWRNVAMLTYLEGTQVSVGGIYVNPNIDVEGQSSMSPTSTKSEDFAHDAFIPNLYVSHRVNQQLAIGFAVGTNYGMETDLGTDFTGTNFGNEASVITKEINVNMAYQINQQFSIGGGVRYVIAEGSFGAVAPTQTPTFHPSLPKPGTTLKYMEGTDEAWGWQVGTAWQINDTNRIGFNYKSEVKLDLTGHANGVGFDLYAKNPSDRYSGSMELALPATAELASFHQLNDKLAIHASFNWTDWSSFEKLEANIPSLKVATQEIKQENWEDNYRLAVGGTYALDQKVTLRTGIAYDTSAVSEENRTATIPETDRLWLSMGAGYAWSDNLTLDAGFTYIFAKDAKMHEKDPKSAPFGGTFEGETTGNVWLVGVQANYRF

SEQ ID NO: 20683 - protein, 757 aa, Pseudomonas putida
MLTLQFMFIYRSVRSEGKGSSTEWMCDMRNSPADRGFSSNATRRLARFLSLSAAGLALAPGLAQAQDAPVVLDTVTIEAAGGEADGMLGGAIAGAAGADYAVDGYVADTTASATKTDLPIVRVPQMVAVITEEQLDDRNVQSLTEALTYSASARAGAFGLDPRFDSFYIRGFDATYTGVFRDGLRDFSNSFLLSQVEPYGLQSLSVLKGPSSGLYGSANAGGIIDLTSKRPTTESFREIGAEYGTNNRYQATFDASGPLGGSGSTFYRMTGVARDSDTDNPFVSDDELLIAPAITYAPDADTSFTVLSELQRVHTGGTAAYVQGNRDVTDVPYADPNFNDLDQTQGRIGYEFEQRLSDVFTFRQKARYQGMDIYGEYLYPYGAAVNGILDRGSGVVAQTLHGGVADTQLEAKFDTGILRHTMTGGIDGYYTEFTNKEGYGTAPSLNLASLDYSRGIARPDYTVAEEQTQRQLGLYLQDIIEIDRLTVALGARHDWVKTETATGAPGDLGEAEDQSDDAFTGRVGVSYLFDNGIAPYASYSTSFSPNIGLNPDGSAFVPTTAEQYELGVKYQVPDVNLLVSAAIYQIEQEKGVFLQPSADFSTSVQVQLDKLRSRGFEIEAAAGLTDGLNLTLSYAYLDMEIIEGVPGTEGNTLSSRPQHTAAAWLDYTVQNGFAKGFGIGGGVRFVGESFGNDRNSFKNDARAYVDAALHYDVQAVEGLRVQVNATNIFDEDAALCTEGFCYAEQERQVVGSVRYRF

SEQ ID NO: 20684 - protein, 444 aa, Pseudomonas putida
MPSAFRFTPLFIALTATIPFAAQADEDKADGFIEGSSFNLHFRNAYFNRDNHNAGVRDTREWGQGAVARFESGYTPGVIGFGLDAHAMLGLKLDGGGGHAGTSILPEHIKDDGELGAAPHSFSTAGAAVKLKAFDTELKAGDLFLTNPVIAGGETRMLPQTFRGVSLTNTSIDGLLLEGGQVSFTHPYNQSGHRRIDTYYGSLDEHDKSKHLNWAGASWSGTENITANLYAAELKDIWNQYYADFDYTYVVNDLVSLNPGVHFYHTQDTGQALLGKIDNNTYSVHFTVNAGFHSITAAYQRVNGNTPFDYINLGDSVYLDNSRMYSDFNAPNERSWKLQYDYDFAGVGVPGLTTSLSYSRGEADLTKATQDTTHYDYYREDGKNAMHWERDLDVKYVFQAGDLKDLSVLVRYATHRGSQGYASIDSNSDNDEVRVIVDYPLNVF

SEQ ID NO: 20685 - protein, 708 aa, Pseudomonas putida
MLLQKSVAPLATLSLVLQSSFVVGQQSPVEVIVVSGSHQNTDIMALSSNVNLIDEQEIERVNAVLASDILNRASGVYVQANNGVENLPSLRSPILTGPGAGGAFLFMQDGVATRAAGFANNNGLAELNLAQADGIEVIQGPNSAVYGSNAVHGVINVLSLTPSNGADVGITFGPNDRVQFNGALGHIDDQGPANQGIGLNIQVVDDGGYQNDSGFTSSKLGLRHDYQRDQLTIQSSLSGFDLDQDTAGFIASGDNGEGCFSSNFAPDKLYKDRSAMEKNCDPDAYRQWSSIRGATHIAYQVNNDELINVTPYFRSNSMEFRQHYLPSRAIEENSHFSLGVNSDYQWQVNQSVSLVVGIDIDWTQGELTETQELADRFSFGKARQQGVHFDYEVDSSTLAPYIQVNWQYNEALVFTTNVRFDSTEYDYDNLIANGTTKADGTSCINNDGQAVSCLYQRPEDRTDRFNNTSAKIGANYRVSDNISLFANWSNGFRAPQTTDLYRLQNQQTIGTIDSEEINSIEAGIRGAYQVLTFQGVIYRMQKDNFFFRDDDGLNVTDGETNHSGVELTVSINVLDNLRFLANYAYAKHEYDFDRLSSGVVNGNEIDTAPRQQGNARLEWQPTNATSLALEWQHIGSYFLDPANEHEYAGHDLFNIRAQWQINKQIRLNAKLENVFDGEYASRADYAFGSYRYFGGQPRAIYLGANYAF

SEQ ID NO: 20686 - protein, 711 aa, Pseudomonas putida
MTGFIRKKVFVAIAALTFTSAVSAQLEEVLVSAQKRDQSLQDVPISISAVSEDMLEKTGINTITEIIPMVPGLTGADYGLATNSWAIRGIGSNDWTIGSEPSVGVFVDDSYVGRNIFASSNFFDINRIEIVKGPQGTLFGRNAAAGAISLITNKPGDENELRLGAALGDEGQQRYEVVGNWALSDSFALRVAYQHQEWEGMWTEVNSGDDMYTESDVVRISARWDVTDNLEALIKYNYGKAKTNYTSAINIPFNLAEPGVEYPDSFAINQPNFEQNEDDGLGLRLTWAINDTLTLVSITDARNGENDYFEDVDGTADDWAVDLALLGGILGGLDIPVGLGADAETFYQEFRLNGGSESLTWFTGVSYYSEDLDNSRWEVDYVATALGFPIGSQRIESRAENKSFGIYGDVTWQMSDRLALIAGLRWNSDEKDWCTNTLVDDFGDSGGPTDGPLCDEKDWDEFTSRLVAQYNISDDTMVFASVSQGYKGGGFNTSVADLDGDFIAETLVPFDPETSIAYELGLKSSLLNGRMQFNGSIYFTDYESLQVAIFSFDDGQQIRDAGNAETKGFEGELSYALTDGIVLMANYSHMDTEIVEGPLSGQTLAYAPEDTFSIGANINHAFLGGSLNWFAMYNYTGEFYHDIGNAVEEKSYGLLNANVTYQPESARWDVSLTADNITDEDYAAFRADFGWGDQLHWGYKRMMRAEFNLYF

SEQ ID NO: 20687 - protein, 463 aa, Pseudomonas putida
MASRNQDRRRARPGTVRPLSRWLGATLFACAAAAHGAPQPDGDAEPRWQAGADGIGFWPGGDADGFDASAWATEAGPARRGRDDSGDGPQPDAVPFTARKITLGQRTGGAGPACAAAHDDGMDGIGFDDNGAAGGCEPAAPRDAKADDAPAGGVVHADRMPYELHPIDPSRLPDLPAAQAPPLLTQLMGDDRNMVGLGWHFVGTTGRSTPVTTHTDALGLNSFQNQGSSLSLSNTNTLAFTFTHFFSENWAAELGAGIPPVLTLRGHGSIALPLDRIFSGVQGRFPLIDLANTQSNPLATTRAWLGSVVFKYYLGERDDRFRPFAGIGISYTRFTNTNLNPVFQRKLASLGGLLAAGADIGSLQSLLLDPSLFQRIWDAGGDLLLSGKTNVSAKVKSVWEPVFTVGASYQITRQFWITGMVTYIPLRTKITLDIDQPNRQLASNTFDISANPVLASVLLAFRF

SEQ ID NO: 20688 - protein, 227 aa, Pseudomonas putida
MNKSLLGASLVALALAAPAAHAYQAGDMILRAGAITTAPNESSGDLKFDGNKVSGTKATLDSDTQLGLTFAYMLTDHIGLELLAATPFKHTVAVKGLGGGLDGKLADIKQLPPTLSLQYYPMEPNSRFQPYAGVGINYTLFFDEDLSSARKQQGFSNLKLQDSVGIAGQLGMDYLLTDNLLVNASVWYVDIDTKASVNGPTALGYSKTKVNVDVDPWVYMVGLGYKF

SEQ ID NO: 20689 - protein, 810 aa, Pseudomonas putida
MSRAVDHILRPSLMALAIGLAAPLTSPALFAAEQSMSRAYNLPSAPLATTLNQIASQAGIALAIDPALVSGRTSAPVSGQYDGLGALQAALSGTGLQLQQSRAGSYSLVAVPDGTLALPETTVNATSASESAWGPVEGYVAKRTAAGTKTDTALVEVPRSISVATREQMKDRGVHSLDDAVRYMPGIVSASFGSDTRYDWMRVRGFEPTQFLDGLPLPRGVYANPKAETWNLDRLALLRGPASSIYGQTPPGGLLDMVSRRPQAESAHEIELQYGSDNHRQINFASTGKIDDEGRFLYGVSGVIRDSGTQIDHIDNKRYNIAPSLTWNIDEDTTLTFLTQFTRDDTGATSQFRPIQGTKIDMPFGKISHHKNLGDPDYEFYDRTYYALGYAFEHRINDVWQFRQNLRYTKSDLSFQTITPGSYYEPGGPVKDDGTVSRMSTNTDEDISQFAVDNNFQADFATGDINHTLLIGLDHQRINTNYLSIFDFTVPDSNVNNPVYGLPITRPDRSTAFYDYNQKTRQTGLYVQDQMVLGNWRLTLGGREDWVHTGTKFFNQGDATNTQRDKKFSGNAAISYVFDSGFVPYLSYAESFQPSSNASVSASDSFKPTEGKQWELGVKYQPPGSNTLLSAAVYDLTQKNVSVTNTVGGVTITSQTGEVKVRGLELEAVSDVTDNLKVIAAYTLAKSEVQDGDFKGNRLQLMPNQQASIWGDYTWHSGVLDGFGIGLGARYTGNTYGDQGNTYLGKAKAYTVFDGSVHYDLGRLNGSLKGASVAVTATNLLNKDYLSTCDAYYCYYGDERSVVASATYKF

SEQ ID NO: 20690 - protein, 398 aa, Pseudomonas putida
MNPQAGARVAGTVIAACLSSFVPNVAHAQSSVTLYGLIDTSITYSTNQRTRGAGSPGGGSVAMTSGALNASRWGLRGREDLGGGMAAVFALENGFSGTTGKLSQKGVDLFGRQAWIGVSSKTAGTLSFGRQYDLILDFVTPLGASGPGWGGNLAVHPYDNDDSNRNLRINNAVKYTSPTVRGLTFGAMVGFSNTAGQFSNNAVWSTGVSYANGPLKLGAGYLKISRDRNAPNPDGALSTVDGSATITGGNQQIWALAGRYAFGPHSVGAAWSHSATDGVTGVLQGGNIAPLKGESLVFDNFSIDGRYFVTRALSVAAAYTYTMGRFDTRTGQTRPKWNQVVAQADYALSKRTDAYLEGTYQSVSGGNGNPAFNATVWTLTPSANSNQVVVALGLRHKF

SEQ ID NO: 20691 - protein, 336 aa, Pseudomonas putida
MLVNVKFTFDNPTAENKIIGFVTPESGSGGEGEGKGNRKPEPLNIKSFKTTVNGKEVKSNVELLSKLLSKGVLDNNVIKEYTEKEKNFYNYVYYFNADFKQGENVVEHNYFYTGSYGVYERDFSYVVTTISKWKNKTVEDFEIEVQPGNYFVKLPYSFWKNNNKINWEIVGKGKMVTIAPTKKPNDEDANGIEKFGVIYLKLDNGFVRYKAKNFSPTDDFYMVRMDNILGFGYEFPEGKVQGYKFKDKYFDIAARGNSYGDTGFIKEYQQDLNDKDLDIIRNYPYALAGYDFDKKDLKDYFSQFIWYSPVSKNVKIDSDSNNIIKAVDEINTKRKK

SEQ ID NO: 20692 - protein, 443 aa, Pseudomonas putida
MYKSSLALAVALGVLAQQAGAAGFVEDSKLSLSSRTMYFNDDNRDGGTDQEESGQGFKLDYLSGFTQGVVGFGVDVQALWGIHLDGGRGSRPDANNSFFPSDSDGSAVHDWARIGGNAKARFSKTEAHFGSALAPNLPILVANDGRLLPQTFEGGTIQSKEIDNLTINAGQLTHAMGRASSNRTGLSVAGSAVDSNKFYYGGLDYKLTPDLTLQYYYSNLKDFYKQHFLGATHVFKLSDDSSFKTDLRYFDSSSDGKNGDGGEYFFNNNGGYAKNAGEIDNKTWSAMFTYTLGGHALMVGHQQVSDDGGFVWLNQGNVEDGNGNLEGAGGASFYLFTDSMINQFARAGTNTTFGQYSYDFARVGVPGLKASVSYLRGTDIRNQSGSGTYHEWERDARVDYVIQEGTLKGLGASLRHGIYRGEGEAPVDKDQTRFIVNYTYNFM

SEQ ID NO: 20693 - protein, 1602 aa, Pseudomonas putida
MSTNCTNMAAGVRVVLRWPLVFALLLLSTLYSGKAAAAASQYCPTLNATVVQGGSVQIDVTTCDGTGVDDIGVGWDGVQPPHGTLTVPNPSGAQGTQIVTYTHNGDSATSDTFPLEDGAGDTITVNITITPSRTASIAVSPSAANEDSGTSLVYTVTLSQTNTSATTVNLTRSGTATSGTDYSGAVTSVVVPANTASASFSVTPIADTAVETDETVIFSVANGTGYSTGSPSSATATIVNDDFPSASIAVSPASVSEDGATNLLYTVTLNQPSPTALSIGFGVSGTATSGTDYAAVSSPLVIAAGQTTGTITINPTADSTVEPDETVVISLNTGSGYTVGSPNSATGTILNDDQPALSINDVSVNEGNAGTTNATFTVSLSAPAGAGGVSFDIATADGTATAGVDYVASSLTGQTIPAGSSSATFTVLVTGDTLAEPNETFFVNLSNVTGASVSDGQGLGTIVNDDAQPALSIDDVSVNEGNSGTTTATFTVSLSAASGQTVTVNYATADGTATAGSDYVARSGTLSFAPGVTAQGVAVTVNGDTAVEPNETFSVGLSGASNATIARATGTGTILNDDAVVTISPASLPAATAGSAYSQTLSASGGTPGYSFVISAGTLPAGMTLNAAGVLSGTPTASGSFNFTVTATDSGAPTSGSRAYTLTVAGANVILPATTLPAGTAGQAYSSAITPAAGGIAPYSYALTAGALPAGITLNSGSGALSGTTTSVGSFSFTVTATDSTSGTPSQGTRGYTLNIAAPTIAVAPSTVPTATRGTAYSQTLTASGGTAAYTYAITSGALPAGITLASNGTLSGTATLEGTFNFTVQATDANSFTGTQAYSLTVAGPNLVLPASTLPAGTAGQAYAAAVTPATGGTAPYSYAVTAGALPGGVGLDAATGGLSGTPTVSGTFTFTLTVTDSTPSPAAQASRSYSLTINAATLVLGQPTLPAAVRGTAYNQVLTASGGVAPYRYSIASGTLPAGLTLASDGTLSGTPTVQGTTSFTIAVADAGNASATQAYTFTVNDAAPVAVADVAATMTDTAVTAAVTANDTGSITAIAIASAPTNGTSVVNGLEVVYTPNAGFAGTDVLSYTASGAGGTSAAVTLTITVNVRPVAVSVTAAAVPGEAQQVDITRNATGGPFVAAAVVAVLPASAGTATITRVGGTASAAAARASGLSPAAAAMAETPTFTLTFTPNPAFVGQATVQFTLSNAFATSAPASVVFNIAPRRDPSVDAEVRGLIDAQSESTRRFARAQIDNFQRRLEATHRGGGSFTNAVSFQPTSHCRQAERGISAQPCSPDTQDVDNDFRDAPAATGTTGSSAQTQGDLGLWVGGAIRSGSLNRQTNSNGVDFQTDGLSVGADYRVASSLAIGAGLGWGRDDSDVGNNGSHSKATAYTMALYASFHPGKAFFFDTLVGYQLLSYDLRRFVTDDSSLAEGNRDGKQWIASLSTGADLQRGTLQITPYARVDVARATLDGYVEAGVAPFALRYADMDVATTTGNLGLRLEWRREVAWGRLTPQLRVEYQRDFQGRGDAILSYADLTGGPFYRTAQSAFDRNRLMVGIGAALLTEQGLSTRLEYRGITDGDSNNDQTWMINLEKKY

SEQ ID NO: 20694 - protein, 744 aa, Pseudomonas putida
MREISRARVIGMLLAGASLSAVPAHAQDATSPAAEASQGGLADIVVTAEKRPSIAQRAPIALSVVTSEAIKRQGVGNVADLTTLTPSVGFSQNGANTVITVRGVSSRDTNQLGDPAVSISLDGFYFQRSLGLNIALFDLERVEALRGPQGTLLGRNATGGALNIITAKPTDSFSAALTGEVGNYDLIATQGYVNIPVSDKVKLRAAFMTRDRDGYRHNAPARDGDDDHSRAARLHLLFQPTDRWDILLTGEYSHQDGVGPVIQPVAHRFLPNGQLDTSRVDIPGDGKRFAVPSGGFIRLNSYNFRWNTNYDLDFATLTYLGGYRSLKYANVRTLGADYATNRRNFTFDQHERPRSWNHELRLSSKSDTPLIWQAGLYYFREKNSTVSLFRDFRVPGQFPTPAACLCEPGVELQIFRKPDLLLQSKAVFGQASYAITDQFRLEGGARYSSDKKHNLSATNIATNVNTYINTGAINYVNNPPSAVRLSSHRTTFHAAANYQWTPRNLLYAKFDTGYKSGGFTDLQVYGPENIKAWEIGSKNRFLNNTLQVNLSAFLYKYKDQQVQQQITLPSGGIGTGTVNAGASKLYGGDVDIVYQVTPNDRIELFGAYLHARFTDFVAVVNGANKQLAGNRLQQAPDWVFNAGYEHVFPVGDGSITTRLQTHYESKSYFTFTNYGADKQPGYMRSDIIVTYAAPDDRWRLEGYVRNLEDKLIFSNADVVSTTYVSYRYQYQAPRTYGARLTVNF

SEQ ID NO: 20695 - protein, 371 aa, Bradyrhizobium japonicum
MKCKYLAIAVAMLTASSVQAQSSVTLYGVVDAGIEYLNHAVASTGTVAPGAKGHSLVALQSGNQSGSRWGLRGIEDLGGGLRSLFVLESGFSIDTGTSTQSGRLFGRGAYVGLENQWGRLTLGRHTVPFYDFAVTYDPMAISSRYAIGAQDPFMGAARADNSVKYMGTFGGLSVTGLYSFNYNNQEVPGNFTNGREYSLGANYSGGSFSIGAVYDQINQSAATALQTNSLTQRAAVAGTYAYGNAKVYAGYRYAHAFNGASLPGSTVANTASNLAWAGVGYQLTPALSFAGSAYYQNLRNSRSGNPWQFVMVADYALSKRTDLYTAASYVLNKGKSSLGVNGFNSQLGTTSEAVQPGANQFGAVVGVRHKF

SEQ ID NO: 20696 - protein, 705 aa, Bradyrhizobium japonicum
MPRFGKFYPQSKWVIGSLALGLSAISGSTIADSGTAPDKQSKQQDAAGNIEVITVYGQKIERTLKETASSVTVITEEQLRKNADQSTISEILGGTPNLIYAGNTDAPIIRGTDTKGPVAAGNAYLSKPVPGATISVDGKYLSPAELDLGAAGVWDVSSIEVYRGPQTTSQGANSIAGAVVIHTHNPTYTPEFAAQALYGSRNKQRFSVMASGALSNDFAARISADYSARDTFVDYVNPEFTAHDLDFEFKNQNLRAKLLWEPEKYSNFSAMLTYSSTEAKRPRNEVVSEPYDDLENRSIFQDNQEVSNHVGIFDLEYVFDNGMKLHNQLQYSEGQFDYRFAAPYQGIAKRDNENFSNDIRLNFGDKSSEFSGVAGVFYWDDKTNNKLNNVFGNADADLRHTSFAPYGEVIWRFSPKWAFTSALRYQSDEISHDGIASYIPNVRHQYEETFTALLPKVALSYDLTDNVLVGAMISEGNIPGGTGINFRGGEYYTFDAESAWNYELFTRIELLEQRLIINSNLFYTRFKDSQRSVTDYLDGRPFGSVIINADEAQSYGIELDWNFKVADSFSLYGGLGLLETEISEFNDYRGEEFVGNEFSKAPGYMFNIGFDYSITDTIKVSGDVRHTDGYFSTDTNEPELRVGSYTTVNLNSSYQINQYFEAFVYARNLLDERAPVAKMADRSTGGVDAYLLEPREIGVGVRAKF

SEQ ID NO: 20697 - protein, 686 aa, Bradyrhizobium japonicum
MRAHASFKLTTLSTCLLLAFAPLAQPVFANPTLNGVEVQAQREALSAASVQVAKEKLNQTAGGTAVVEAENFEAGKAVTIKDMLDFTPGVFAQSRVNEEARLSIRGSGLSRTFHMRGIRLLQDGIPINLADGGSDFQDIDPLALQHVEVYKGANALQYGAASLGGAINFVTPTGYTTPNSQLRLDTGSHEFARAQFKTGDVLGDWDYFASLSQLRSDGFRQFSGQKNTRLNANAGLKISPQLETRFYVIHGDMNQELPGNLSKAQLQTDPTQANAASANTNSQRDFLITRIANKTTWISPAGVEYNAGVYAVDKNLYHPLSFGLIDQQTRDVGTFGNRIAQGELWGLRHDTTLGYNLVHGVTEARIFNHVRGDRISLRSYEDQKAHNMELYGESRLHLTDTLQWINGLQWTHAKRTADDQFLSDGDGSYQRRYAQFSPKTGLLWQATDTVQVYGNFSHTFEPPTFSETSPTRALEAQESSTFEVGTRGVAREVRWDISAYYSQLSNEFVSYQLNPLVPGLSAILNADDTVHQGVEIGLAGPFARDWIQTGDTLNWQLAYTFGRFRFDNDRVYGNAAIPGIPEHYVRAKLDYANTLGWTLSPNIEYVPQGYFVDLANTLSTDPYLLLGLNASYKFSDTLRVFVDARNLTDKVYAATTGVIVNANGADSAQFAPGEGRSVYAGVEVKW

SEQ ID NO: 20698 - protein, 779 aa, Bradyrhizobium japonicum
MSQMKSSRKSLLIAWWASGALGAACIAFAHADDPGGKPAVNVGEVNGQAGGSTTDKKHRAKISMASPVQSVHISQAVIEEDTPPGGSMVEAIAANTPGFQARRTGTASGANRYQIRLNGIQIGFDETGQAEMNGNQVLMDGIPLNNPLASYHGFSTAELPIASMFSGINVVYGPGTAKQHWFDSMGGTIDFSTKSSGEKPSVFVDVGGGSFNAYNASTGISTGSIDGWRTYIAGGYTRTGQARVSPSLTGPSQSTAFFLKTQKRFEGGHFAMGFYFNNTQENRPHLIPVYPFAGGSINGNGVAGQALSQTTSGFYYTPSSDLWTKNEQYHTYLGYIKLTSNLTRNVKFNNALWYRAGNRLKVRIDNYPMVPKLNTEYYPTSSGNFGYRGDFTITLPWNKIDVGGYYQQTTYDSSFAGYGSLVPGHELGSNSPLYYRDDHDHWSAASAFLQDKITPVSFLSITPGLNLINYHISVNNVTSVTAPSLFPGDSVGSFPTVAGDTANFTKLAPSLALNAAIAPEIHAFATWSQNFQTQIDSAYGEGASHPVIAPTEPAKINSYMAGLKYAHGPVEGQVAFVHQKLTDLAVQITQAESQNIIVEPANETINGVNFLLAYGRRLGFNARLIGSILHGSENTINASGDPVNGARVTGLPTYNINFGIGYRVYAARTLWSARILDNYQSATYLSSDISAAPTSLKLPFSAVNLVNLSLSARTTMFDRDVPGLKLMRVSLMLDNLLNREYNVQGYVSAGGNYGPGSVGTILASPGTPRAVYASLTAMF

SEQ ID NO: 20699 - protein, 850 aa, Bradyrhizobium japonicum
MLQLRQFFCVGIAGTIYLIGIGTAKAQNDENISKIPITNISQISDIKRPHTNVKEWLAQQQAQIIQVTGVSLNQTSNGLEVILETTASDKLQTSLNSEGNILSVDIPNAQLRLASGDSFLSQKPVAGITEITVINQDSNTIRVTVIGETSLPKVELDDSENGLIFVVTPITTSAQQPQTPQTNQADSETPATQPSAQNDEPIELVVTGTRFEIPIQDTPQSIQVIPRQVLEDRGAVRLDEFTDNVSGVQRITGGDGLGSSGFIIRGFSDVYENLRNGFRSQGGFPRDLANIDRVEVLKGPAAALYGGGFQSGIVNILTKKPLDEPRYEVKATVGSYDFYRGELDLTGPLVENRSLLYRLNVAYQNQGSFRDFLNYKSFFVAPSLTWNISQRTSLSFDYEYFNTDYPDDETFRAEPEFLRISPKTYLGEPDLANENFTAHSLSLEFSHEFSDNWQYRLGFNTLWQDVFDEGATRSGRLQADRRTLNRQFTRRTNDLENLTLRNEILGKFNTGSVRHNLLFGVDYSRLEYAYTFSSAPIAPIDIFNPIYGARPTAALSLNSNEAYGDDTLGIYLQDIVEVLPSLKILAGVRFDNVNGFYENRETNTSINEVSDSKFSPRLGIVYQPGNTTTLYASWSNSFTPQIFGRNSNGEQFKPVTSEQYEVGIRQEFLDQRLSANLALFQITRQNVATTDPNSSDPFARIQTGEQRSRGVELDINGEILPGWKMILTYAYTDAQVTEDNRIPVGDRLPNVPYNSASLWTTYEIQSGNLQGLGAGLGIVYVGDRQGGLPNTITIPSYVRTDAALFYRRRQFEARLNFKNLFDTNYYDATDGTSINPQEPFTLIGSFSYRF

SEQ ID NO: 20700 - protein, 203 aa, Bradyrhizobium japonicum
MMKRLGVMSIAALAIGGAANAGSYTAPVIEAPVIAPAAPALSHSNTWTGFYAGMQMSYSDFSVNRDGVDDATGGVYGIHAGYNHQLHNNMVIGGEITFDHSSADNDVWQVERLMTVRAKVGYAHNNWLVYGLAGYAHVRTEGADRAHGKSGGAVFGIGADYAVSDKWLVGGSWEGYRFSDFKNDPDNMEVDGGSVRFRVSYRF

SEQ ID NO: 20701 - protein, 636 aa, Bradyrhizobium japonicum
MSFQDKAIKKRISVATIACAGAVLWLHGSVVPAWAENDEMKVLEMFYEDKELVVTPTRDPKPISQVAENVTVITAKEIQALNAHTLGEVLNTIPGVHVEPRVTPGGLSPTLSIQGSESNHVRVIMDGVTINNVSDFLADVGAIPVQRIAAVEIIKGPASSAWGSSLGGIINIITKSPDEGRKLGGTVSASMGERTTGDFRLELSGTRSSLGYYLAADGITSDGLLPHTGVDSGSVYGKMTWDPQEDTRVFATYSYSRGKRGLGEFPQYGLRQEGDYEHLIATLGMSHALSESLDLDIAGRFSHRDYSDVSGALGAGEGLNNNSYEQPNLGASAKLAWRTGIHSVIIGTDYDNGTIDADLRENGGTVRTKTHGRLERRAIFANDTIVWNNWSITPGLRYDWTSTSDDFFSPSLGVTYNLSDHTVLRAYVARGFNVPSLTATTVGAQGLQPNPHLEMEKVWSYQLGFETTFLRYLWLKNTVFRHDVSDFLAYDGATNSYVNQGKQRRQGVEVEVKSIPFFNTTIGVGYTFIDARDRLADERVPNIPRQTWDVSINYDDRKLLRGGLVGRYTQWNAREDFNSRENAMIWDLTGGVRFLTGQVSGEIFFVAHNLFNGSQYLHYFFRNPGRWFEGGLRFNF

SEQ ID NO: 20702 - protein, 710 aa, Bradyrhizobium japonicum
MRRLVVPLLALPAFACHTAFASTDSDTPLALEEMQITAPTEQADGPIDGYRATRSASATRTDTPIHEIPQSISVVPAQVVQDIGAVRLEDALDYAGGVERGNNFGGQGLTEFLIRGFTSQEFYRNGFAVNRGYPNMPDASTIERIEVLRGPAAMLYGRSDPGGTFNIVSKQPQAERRTVLGSQVNSEGLRRGTLDTTGALDEQAAFTYRLNLVAEGGDSFRDDVESERYNVAPVLRWQLNEDTAVTLEGDYLHNRHPLDRGVTRYSNQNGKLPRDRFLGEESAGKLTNENATTQLRIEHLLSDSWTLRGGVQYLDGEIHGGAVENNSNAYTGLPAGASSIGRNYNERWLNWNDINAQANAEGNFDLAGFAHTLLLGVEYDKFNYNSLIRRSPGGDAYPIDIYNPVHGQPLPALTRTTTHDSENLESYAFFVQDQIALTERLKAQLGVRIERFEQSYNDKLNPNGSWDQAHNAVSPRFGLIYDLTDELAVFANTSRSFKPNRGADRLGNSFDPEKGVAHEVGIKYDLADRDLSLTAALFHIVKENVLTSDPLDSTRSIAAGEVRSRGFDINLAGNITPQWRVIGGYAYVDAEVTESTSATMPVGTRLGNVPRHSFNLLDTYEFDGGPLAGLGLGIGLKYVSERQGQTSNNTFDMDGYGLVDLLAYYPLTENVRLNLNLNNVFDKHYEERAWNSWAYPGEPRTLQAGISVSL

SEQ ID NO: 20703 - protein, 387 aa, Bradyrhizobium japonicum
MQAFSFATTAQILCEAGSAIRLAELCRERRARRVLIVTDPGITRLGLLDAILPGFPRLGLAVEVYDQVLADPPESVVEAALGRARGMAAELVVGFGGGSSMDVAKLVALLAHPEAGQGLGEVFGVGNARGPRLPLIQVPTTAGTGSEVTPIAIVTTGETTKMGVVSPHLLPDLALLDADLTLGLPPAVTAATGIDAMVHAIESYTSKLKKNPLSDLLAREALRLLAANLERAVGDGGDREARQAMLLGACLAGQAFANAPVAAVHALAYPLGGHFHIPHGLSNALVLPEVIRFNAPAAAGLYAELAPLLLGDRLRPGDRDALTVQLIDELAQLSPRNGLPSRLRDAGVDEAMLPRLAADAMLQQRLLVNNPREVGEADALAIYRAAY

SEQ ID NO: 20704 - protein, 2302 aa, Bradyrhizobium japonicum
MRPRLPLVLLSALLACFISPSWSDYTLTGNGDTTISFADGQYTITPPEGDPVTQADSPGDIYLTDITASGTYEDGYNRVLNLEGGTYTKLQLWNIAGTASGVTIGGTNSFVINIGEGASLLNTNAQLMGWSNQDRIVSADITLNVDRNAGTINGFSLVGDGNKNDAYQTTGTYTVNIHGGEWAGISVSNPSSSWCIGLGQESFRHTGDVTFTIDGGTFAQLVTAGTTRGAGQKSTIVGNVSLNLDGGTFNGSVALLGRGQVQLGDGTNACTARLSITGGQYNANVYGLSDATSSGSAANIAEHSSASVEITGGTFAQSLFSQGVATTITGAVFSGDGTKKIFAGARLSTSAWNLADTNMTLDLGSGTVAAMIAGGSWVETGESTLNITGSTNLTFKSGTYTGQIWGGSYINGTATAALTGNIGSTNITITGGTFDGAQISLGTYVERNNTSSALTIGEANLSISGGTFNNVSIYAGGQKVNGTALTTALANVTITGNDAIFTGTTTLSGQGRGDTVTRSVLNLNGVTRADMFTNASISGFDEISAGEGTDAVIANATVLDGRSAFTKSGAGKLTLSSSTGFANALTVSSGELSFGLAGGVAFGNSITMGSGARLTSAGNMALSPSSVLTMDLTGLNSSSSAVIQSGGTLSFNTEGTLTLAISGVDQTMENDYRLITAGSFGTLTASNFSFDSSGLSEDYTYALELSGNTLYLRVKALGEALNWNGGNAGIWTAAGGSAVWLDKDGTAVVYDAAKSANFEDLAGISASAVTIEGNVSSARLTVNNGETAYTFTGTGALVDGADPMSLIKRGEGVLTIENTGTNTFSGGTTIMAGTLNLNAVQGLGTGTVTLNGGELVLNTAGTTEGTLGLVAANKIVFGGGTFTYGTGATQDISGLIDSAASTNAIRVNTNGNHVSWAAYTQELGDKDIVKLGDGLLTINTIQGGIFAGSITVSGGTLFYNIGDNGVTRTWSGNISIAENATLQIQDNRAHNSVNTDTLSGRITGAGTLVLGKKEGGTFPGGGRYSVTGDNSGFTGTMRLAGNGTNAAWNEVGFANAAAIGSARLELDGRGFFVNSAADPVNADIHVMAAGGWLNGSSNQTLVLAGSLTGEADANLGVTAAGDPTLTAIFTGDLTGFAGTVHSGRGNAILSFGNGGAASTLNTGEFIKAVSLGGTGTYRVNYTGTAGNLLYAGNVIDTASLSVQGSDKLILTGANTTTGELNIAQNSSVQLGDGTGDNAAWAGTIAGAGNLTVSTSGSFAVGDRANGLTGTLTLAKGTLDLSGAAAATNILIQSGALANAGSYAGTDTNKVHVNAIADSGNIALGDLDAAGLGSVVTASAGTQLTGLKQGSIWTVNGTDSSLAVGAGNISGDPFSGEDFLIQFEGTGDNLGSISFGDGSTLTLDLTSVMDAMKTAGGNLEILLTNGGFAQDLETLKSHMTANPLFAALGFGIVGVNGGSIVLSGDTDLVYVSSVDGTGSADNPVTDQSLNFYQAVIVDQDLYVQSDGSMVIKNLTAPGTGPGQTGTGNLIVTNTAEDKGSIELQNNLFHEGMGVDTSFAGDISGLNGAAANTDLVKTGANKLTLSGNVTLAGDIIAEEGTLQLNGTADVEALHLNSADADSPAVIGVGGRATARTLAGGDNGGKLDIASSGTLTLTGATDGLSHTEIAGTGTLAIAEGASLGLAADSTLSGVVLDLGGSLSLEADGSAGGLNGSGSLELNGQTLQIQAASGQTHTYEGTLGEGTLDVSGAGTQVLRSSGADTGLTISGGNLVLQGKADVDGARLSYGNLVNSGNLTIQASDNSLTAVNTTLSVENASFSSGSATTFTLNTDADMTASFIEVSGDVVIEDGASFHVTSIPDVNITWKSGNPMELTLMELTGNGTIDLGENTLTVGGLFLTYYKNAHLVQEGDKVVLKAEEQTDNIYAGVADTANSMAGANLLWDAARHGSIDQAVTDFLGALNNDMLNNPSAARRSLAAMAGSTVNALGTAQRDALRDQMGWIRNRTTLMGVNPAYVNDDLPRFHMWMEGTGSYAKLDTRGDESGYQLTTWGGTVGVDADLSDRLTVGAAFTASYGDLTAGAADSADGHLDSYYASLFGRYQDRRWAHTLILTGGWNDAKLNRTVNYGEGSYGTQGSTSGWGFGAMYELTYDVYLNENRSSVLQPLFNASVVTTRMDGYEETGAGNAGLNVGRQDWTTGTLALGGRWMGLVGSNIFGREALAEIRVNAAQDLGDRRGETNVSLLGNPGFAQSVRGAKVGTTALQLGAGLSVPVGTKGTIYVNGNADIRDGSSALNGSIGYRHDF

SEQ ID NO: 20705 - protein, 782 aa, Bradyrhizobium japonicum
MLISAQFSPLVWANNNDVAVLDEVSVVGSTPSISQGSEVTLLKVSDKIIAGKEFKKRSATLGNALAAELGVHSNPFGGGASKPIIRGQEGARIRILQNGSDVIDMSNLSPDHAVVADSLLAKQVEILRGSSTLLYASSSPAGIVNVVDKRIPTEIPEKGYEVELNSRFDTAAKEKVGALGATFGIGKHIAVRAEGLTRHSDNYRVPGINLGERLNYVPDTYNKSKVGTLGLSFVGEQGYIGASYSKRRDNYGLPGHNHKFDFCIGHIYGNKQGKYAYTYLYPHLIGEENIGSNPHFHCGTDHAEDGTHSHDNPFEHDHDHTHPGPWVDLESKRFDVKAELRQPFKGIDKIKVSYADADYYHDEKDAGVLATRYHKQLKKDQDYGKPVNIFKNRGKNARLEIYHAPLGGLTGVWGVQYQTQKSSMHAPKDREVKFPLVENTNKQMSLFGIEQYMWDNFALEFAGRVEKQKIEIEYDRNEIKRLQDHYRISGGKQVEPDLSPYNQNAYAYSSTLNWFFHPDYQLSFTASHNERFPTPMELYYHGQHIATNSFEYGNKDLKKEQSNNVELGLGYQTERVGYKVNVYYNHFKNYIYNENLFRENQLFMRRYNQAKARFYGIEAEASYRFNDKYQATIFGDMVRGWLTNLPPLTVNSDYSVFKDYLPKDAKPGEDYLIYRADQNTPRTPPVRLGFRFNAEFTPNWSGDLELIRTFTQRRTSQLEYITEGNTMLNIGVAYSNKWKDLDYKISLNGTNLLNQPVYIHTSYHQFVPQTGRNFILVVNVKF

SEQ ID NO: 20706 - protein, 1164 aa, Bradyrhizobium japonicum
MVTCNTIGNRKFLLRRLGGSTAGLALLVGLGLASSPALSDPRSVPLDYLYVKDDKGNDELSRITIWVSTNDGQRRQMLFDTGSDSANMQLGSDVSGVKPTPGTEPRGYFYGDGTYGYLLQQVDVDDIAYHAADGSESFTLPVAGQSTYQVARIVDVIYTADYTGPEKPMLSADPVYVVTNEDGSKTAYYADLNARKQMAQDKPIDDGGTLWGTFGAGDYLGREWASTSGLIGRATKTGYVIAANGNTESGKQGLTPGCSPCLIVDVNSAVRAQFTSVMPWGDKNGDDAKGTLPNFPGSGAPASAEFEGNYTLAFGDDDAAPSLTKVATLLDTGTPGGGQITISTARLNALVASGVRVDIDKDGNKTIPSLNLVAGEGMPVGLSNIDVVEIEGNADTPVQFIAGMDFFVSQSVMYDLENQSTAYTPYFVSANNFTTDTPAVDEIGLSRVTAEMGSPFPMKDDDGTEYTVGYFGAAGVISGAGDLTVAKHAQLRLSNANTYTGQTVIETDGKLELAGIGSIETSSRVVADGTLDIGDKGNRIAFWGVSDAYNDARIRSLSGSGTVLLYDRNLVLTAAQDSFRGTITDLDAENTHHGGGLIVQGGVQTLAGNNQYTGATRINTGAGLVLTSKGSLASKVLVSGGFANDGTVNDHTTVQNGGTAGGTGTFHGLTVADGGAVATGGAVPLKVEGSFTQQAGSTLVFGPVAGGAQPGIAVSDQALIENGASVTLDRATAGRLSLGREYLLLDATGGVSGGYNMLAGDLVTDAPFLSFALNNSPANVVLEVRRSDIAFADVAQSANQASSAFGLESLGSGNPLYDEALYLGASEAASAFDSVSGEIHASMQGALIDESHFLRDAVNGRLRAAFGTVGASKSGVMALTADGAVDAVATIDGPVYWGHAFGARGRTDGDGNAAQLDRRTHGLVLGYDAPVEDWRLGGVLAMSDSSYDVDDRVSSGSGNGIHLGAYAGTEWGQTALRAGLTYSDYRLKTDRHAAIGEMAAPLSSKYNGHVWQAFAEVGHRVDHGNMALEPYAGLAHVRLRTDSFAERGGSMALGGAEGVMNTTFTMIGLRAATTIRSAEHDLAVSGGIGWRHAFGDVDPELAMAFAGGANFDIAGAAIARNAAVLDLGVDMNLGKKAIMRLDYQGQLASDAREHRLGATFSMRF

SEQ ID NO: 20707 - protein, 705 aa, Bradyrhizobium japonicum
MLTTALTATGATAQEVAPVELPPITLESALRDTRDIRDTPVAASVLEGEALEQRQADTYEELIGDIPGVVIEGGPRGISQEPNIRGFQDEQVVLRFDGGRLNFNQAHRGRFFFDPDIVQRVEVVRGGGSTLFGSGALGGVISVETRDPSDLLRPGQTTGARVRLGYASNGDIFSGSTTVYGDWGNLDALAFIGTRQFGSDLDDGNGRDIRNSELDATNGLFKLGFEPAEDQRFEFTWSHYRDDGTTPPNANAASSEDDVDRDAEISTARLSWDFNPEGSNLVDLSVLLYGNTLRIEEDRTRDGRADVTDYDTYGLEITNRSSFDWGIPVALVYGAEIYRDDQNGTRNGTDRLQLPDATAETTGVFAEASFGVSDQLDLIAGLRFDSYSRDVDDPTLADVDEDFLSPRVGFSYRPNDRWQIFGNVAQAYRAPTLTELYNDGVHFTSPGFPIGGGITFSGVNQFVPNPNLEEEESIQYELGFRFEDTGVRTSGDTLRFSANAYYAEVDNFIESRVEFIDFSTLVFGPGGGVVGGTTTQRNVDARLWGVEAELDYDAGLWFAGVGLSIPRGETVGGDRLGSIPQERITGTLGWRPNQTWTVGARATYAASVDDGSGGNEPADSYALLDLFATLTPTRGAWDGTALRVGVDNLFDEQYTIFPNGLSQPGRSFKVSLTQTFCPFVTHRPSLRRHHWPRCAHVQAGHTLSA

SEQ ID NO: 20708 - protein, 848 aa, Bradyrhizobium japonicum
MIMKKTYLAWLIAVSCGATSPLMAQETQDQSADKTAEEKRIEEVLTIGYSDSIKRAVQEQRESSGIINVLKKDDMGKLQDDSVSDALQRIPGLSVERDQGEGRFIRIRGLAPDLNSVSYNGTSLAAPEAGRRAVALDVIPADLLESVVVNKTLTPDISAGSLGGNIELQSMTAFDREGSFYSFTADVGYNEQASETNPKVSGVVSNTFDVGDKADSFGIAFAGSYQDRSFTTDNVETGGNWDLDEPGLEEFEQRAYSVTRERTGLALNLDYRPSDDSEFYLRSLYSEFADTEIRQGIVTEFSDPIGAEASAGGEIVRELKDRKETQEITAIVLGTKQKFDDWHVTLEAGTSKASEDQPFAIGGAKFTQEFDEGLGYSGLKRLQLNAPDTAYQASEYEIDEVEVSDAYTEETEKNVKLDVAYDWLQPSYQVTFKGGVKLSQRENSAEENIFIMKDFADLGVTGLTLADYETSSNVEYGLDRFGPGASAGKLWDMINTFELQNFRDEVESRIASYEIDEDISAGYLMADMGFGKWQVIAGARYEHEEREGRGNRYDDELETFTPVSDKFSDANWLPSVVTRYDLSNDTIIRAAYSTGLVRPNFEQVRSSYYLENDDGDLKAEFGNPDLEPLTTQNLDFGIEHYDETLGVISAMAFYKDIKNFVYEADVAGRPGYENFDEAVTYINGDDAYVYGLEVNFVHQVSGFNNWLDNFLINTNLTFTDSEATVDWIDDGQLVSRDITLPSQSDTTANFALGYEVYDVSLRLAANYKSKYLAELGDVEDSRYDIYEDDNLTLDFSAKWLINDHVSLSFAANNITDEPYYVYTGQKRYNAQYESYGRSFTLGVQLINW

SEQ ID NO: 20709 - protein, 770 aa, Bradyrhizobium japonicum
MCEKLGGRLRTVFRHLSLRNYAPSRLMRTWGSALYAGTRFRAAIMARKVFASIEFPNSRCFCRALLVRAVALLFAFSPLASAGSGDDIFNMSLAELAQVQISIATGNSTPLDRAPATASVITADDIRNMGARTLDEVLETVPGLHVSLSSLSRLDAVYSIRGIHTGFNPHVLLLLNGVPIQSSLQGSRPALLRLPITSIDRVEVIRGPGSAIYGADAYSGVINVITKDAAAVDVTRVGGRTGSFDSRELWVETAGRWGDVGIAFSSTYMTSNGDDERIVRADMQSTLDAVLGTQASLAPGALATSYEILNSHLALNTEKWQLNAWNWISRNAGLGAGGAQALDFRGNEDSQIWLLDSAYHFNTGIQGWDSSVSISHFDYGQDVTFILFPEGSRLPIGADGNINFDATNMVYFPDGVIGNPGGTVRESKIDWINIWNGWDNHRFRLALGMRRQAIDSEERKNYGPGVLDGTETEVSGQLVDVTRTPFVFIGDRARHIQYASIQDEWRLTSSLELTTGVRFDYYEDFGSTTNPRLALVWSASNELTTKLLYGSAFRAPSFSELGYQNNPVSIGNPNLHPEQIDTIELSFNYRLSRDMQSNLTLFYYEASGLIEFSQDIATQTKTARNARDQDGEGFEWELTWNPVANWWLNASYAYQNAHDKQTGFAIADAPGRQFLFSSRWDFLPRWCLHTQWNWVMDRQRQSDDVRSSIEDYNLLDFTLQREEILPQLDLSLSVRNAFNTDAREPSTYEIPDDYPLTGRSIWLTFNYRFQ

SEQ ID NO: 20710 - protein, 250 aa, Bradyrhizobium japonicum
MKKFLLATVALAALSAPAMAADLATKYPVKAVAVVPVFSWTGFYIGANVGYGGDKFTFDEVESYYYGAYPYYANSTSLNSSGFFAGGQIGYNYQFANNVVLGVETDLQWSGIEGKEDYSSVYIYGGYPYTSSYGASVDYFGTIRARIGYAFDRFLPYITGGAAYGKTKVSGSYAGEGFGSFDSSSTNWGWTVGGGVEYAITNNWTFKTEYLYVDLGSTDYTYGSYDGFYTYAGTVDTKFHTLKAGVNYKF

SEQ ID NO: 20711 - protein, 498 aa, Bradyrhizobium japonicum
MKKLLTLLIIGISAQYTFAQNVADAVRYSTQNITGTARFRGTGGAFGALGGDVSAINVNPAGSAIFNRSFVSLSLSSDTFDNQTYYNDGITATEDSDLDLNQFGGVFVSNGAAGLRKLTFGFNYDRTTDFDNGFIASGTSNNSISDYFLGYAQGTSLDLLELQSDETIDDLYQYLGESASFGAQQAFLGYQGYLIDPVSSDLSNTEYTNAQNGNTFDQDYQYTTFGNSSKFSFNAAAQLSDQFYLGLNLNAHTFDFTRNTIFYESNTGTNNAVTNVRFDNEYRAFGTGVSAQFGAIYHASSSLRLGASYDTPTFYTISEETEQYLSTAGANGNIILDPDVINIYEDYDLVTPGKLTASIAYVFGQRGFLSFDYSYQDYGSIRFRPDSDPFFDDLNNQVNNQLKPVSSFKLGGEFIASNWSFRGGYRLIESPYENEYTLGDITGYSLGIGYSFGNTRIDVAYDWAKQDQNPSLYDGAFTNTAFIDTINSSILASVSFQL

SEQ ID NO: 20712 - protein, 880 aa, Bradyrhizobium japonicum
MLNNQVSKAVRLAIAFGAASTAVFSASSIAAEEGVEKVERIAVTGSRIKRTDLEGSVPVTVIDRAAIDFSGQTSVSDLLRNTSFNSAGSFRPQSGSSAQGVSQINLRGLGASRSLILVDGRRLPKSPSTGNSQDLNSIPMAAVERIEILSDGASAVYGSDAIAGVVNIITRKDFNGIEMRIGASEVSLPKDGGDREEGSVVFGASSDKSSVIGGVSWNSRDIIYENAYEWVQPGASSFGANWVRPSGYDGIGADGEPSAGGLSSILSASACDGIDNFFSLGDDFCAYNFNATNANEASTSNTSAFLKANYDINDDWRILSHTLVSKTKSFGRYAPTLNDAGVGAFMSADSPNNPTNPASPFYDAPSDGLGAREVGYRHRFAALGNRDSQVDNWSTDFMISVEGQIGNVFVDFGARKNQTKTYEIGRGYLMGSNARTAVDSGDYMLNDPFGTRFTTDEERNNYAKVLNGLNVTTSRIGTFQQEEVFGSAAFDVMEMNGGTLQAVVGLEYRKEDYSDTYDSLSEAGQVGGSAGNSAGGGRNLTSAYFEALFPVMEGLEFTLAGRYDDYSDYGSDFSPKVSVKYDVNDELVLRASYGEGFRAPTLDILTAKPAPDNPSVSDDPSCLNLGLAAGCDVQVSAITLANAEMGSESSEQISLGLAYQPTDWLNFSADYYEIEISNMIRFFGSDTILTREQTGDPIPAGLGVTRLSNGGIDLITQGYANEGKWEVSGLDVNLNTTFDFDAAGTLKQTLQFSHQFESKIDGGRNTLKDTGEPQQRASLSNSYAIQDFDFTWNINMIGSQYEDVRQVAGGNVERTGNIATWITHDLQATYSFPTGTKVSVGMQNAFEKEPQLSSFGGRSYNFDLYDAYGRVTYLRFSQSF

SEQ ID NO: 20713 - protein, 616 aa, Bradyrhizobium japonicum
MARGFKRRYFSLAAIAATVSVFTLNAQAARVESIEKIVVSANKDTQALEDVTDDVTIITEQDIEELGVQTLPELLKEIQGLDIVQTGGFGQPASLYLQGLNPDKTLILIDGIRFNDPTGLNGGQLELIDLSQIQRVEIIRGPQSGVWGADAMGGVINIVTKSAQKGTHGGWSMEGGSYSTYHGNINLFKGFEKGYFGVALSKYQTQGFSAYSAKRGEPLYGVKVSDLPLEDDGYENRKIQLKTGWEIYGAKLFANFIKIDATVHYDGFGYDAPDSPYTVNVINDTLFQAGLEKSVESHALKLQYSYSGFKRSQYGGYEGSVRELEFKDRVVINSLITQFGGGWQRFYQKKSAGTPTNDGCQNRYLFITNTLQSNKLLINVDARYDSYNRFDDKLTYKVGIKYPIVKDIYVGANGATGYKAPSIFQLNYNATSNLNPEKSFGYNFFIGNDMIKFTYFHNAIKDLISYTDPDGDYRTPNDYYYNAPGKSTFKGYTVAFSKDFFEKFYLNLNYTYLDAKDAFGNDLPRRAKEKIGYSLSWYPTDKHTVNINGYYVGKREDVDGTNIGKYNVTNLSLQHNFAKHMTGFIKINNIFDRFYQEVHGYATADRSYYIGIRASY

SEQ ID NO: 20714 - protein, 711 aa, Bradyrhizobium japonicum
MQLVHPPLTLVAATISALLAGPVLAAPTSNAQGAVADETLTVLGQTYRNTATKTRLDPMETPQAISVVDGETLEQRGVSSVSEALRYVPGVNTELRGGAVNRLDLFNIRGFDNYQNFYDGLLLQYNDWNLQPQIDPVAIEQLEVFKGPTSVLYGSMPPGGMVNLIAKRPQREARHSLSVATGTGTLKELTLDSTGAINEQLAYRLVGLARQKEGQAVTSQEERYVFAPSLDWQLSDRTLLNLNLYYQKDPQAGIYTTVPASGSVKFNPLGQLGSDSFLGDENWNHYSREVTLLGYKLSHDFNDNWQLLQNARYMDASANQQNTYNAALAADHRTLARNAYLTDEESRGFVIDNQLAGKVMTGSARHNLLLGVDYQYLDARILYRDTLDYSAPAIDIFNPNHSQIVPGALTFNYQDSKTIRQSQTGVYLQDQVRLNRLVAIGGARYDSYRMDTDSQTLYQGAASNTLAQIDQDNLSFRLGALYELDGGFSPYVSYAESFEPVAGADKSGKAFDPATGHQWEGGLKYLSEDMSKTFTASVFHITKQNALVTDPDNVYGPKQQTGEMVSRGVELEGRVDLTSQLDLALSYTRQDMEITRDTTSLQGKTPVWVPKQMASLWSNYQLDNGLRLGAGLRYVGEAQLDAANTDRVPDYLLMDMAASYDLAQLSQRLKGVEASVSASNLFNKTYYSCYDQNNCWFGAERNMEARLKYVF

SEQ ID NO: 20715 - protein, 238 aa, Bradyrhizobium japonicum
MSPRRGASALRASILGSSTLGASALTAALGLATMSAPARAADPAAAPASEGGLTAGSLLVRGRVIGSIPVGQFSRVEPIGGRVITPARALPDLDVTYFLSDHFAVAGQVGVVSTKTSIRGSFIGDLPIGSTWSLNLTGAVQFHFLPDNAFNPYVGAGAGYTHPIAYEPAKPLITEMRADPQLGPMLQAGFDYHLGGAWFANMEIKKIFLPPLVSRIGAGSATVRLDMLIIGAGLGYRF

SEQ ID NO: 20716 - protein, 875 aa, Bradyrhizobium japonicum
MTMPKHSGAKTFLLGSAAMGALLLQGAFGPAYAATTSPDPSEVTQPRKPARHKPAPATHGAPAQGATQRQAADKAAASSALKTSSEDITVSGTAAPGNNVLSTSTRRHSTTQVTVISASDLKATGQTNLIQALSQMMPSVSAPPLPGVGNNAFVQTMQLRGLSADQTLILVNGHRRHLGANFNANAGPNWGTEPADISLIPVGAVDHIEVITEGATALYGQDAIAGAVNIVLKEDTQGLSANFKNSGYYAGDGQALDGSITKGFAIGRHGGYLDLSAQITHQLPTSRTGDYINPATYPNDLYYALPGGQVDPRAAALGRNIQRILGIPKQTRESISANMGIPITDSIKFYSTDTYGHRRVNAAENFRSAADDLTVNAIWPNGMQPYLDLEENDFEVDNGFKGTTAGFNWDTYVNYGRDIQRYWMQDTDNPTYGVNSPTKFDTGSAVTSQLTAGFRASHALRLGFLPKLANVEFGAEYRRDMFAMGPGVYESYGDGGVPILEGPNAGKTANPGSADHAGNPPLAVTNQNRDVYDGHVNLDFYVLPRWEWTLGGRATSYNNLATVTTGSVGTRYNFSDRFALRASINTGYRPPTLGQEYYFYSAPFATYSIDQLPSNSAPARALGAHALKGEYSRSYSVGVDATPVDNWHVTGNLYYIAINDRLASTTTLGGAGVGALLASAGLGNVTYASYYTNPVNTATYGGDIATDYSLPTRRLGTFRFAFSVSLTDNEIRSSNAVPQVLQSMNLAYFNQYARTVLLHSAPKNRENLSMNWSRGRWSAFVQESRYGSLIYAATPSLPTNLWLVQRPAFITNIEVSYRVLPQWTVAVGANNLGDKYPTRLNPKSIATSFNAYKYSFFSPYGFNGGMYYVRTGLNF

SEQ ID NO: 20717 - protein, 632 aa, Bradyrhizobium japonicum
MSRITVLLFTTALASPAAAQDSAVRSAADAFGERVGIEQLGLYNEGQVRGFDLNNSGAYRIEDAYFSRAAPINDPVLAGVGVRVGVNAAALAYPAPSGVVNYRLREPAARNSLTLGGGVRDYRTPTVEANGSWSDAGGRFGLAGGIVWRPVARWGAGTEGDAVDAGLVGRLALAEGHVLRAFASAYVRDYDGDYAFKSADGAVPPDARRTHEYSPVWARVEAMNANMGVLYDGELAGWSVDLAAFRSIFDTERTDFTLVETRADGTAEATLFLSPPKRNVSDSGEARISRVFGTGPVDHLVSASLRGRRSEVELASSLAVPLGPLTLATDVAPSEEPAWSGSRGLDVVEQVTGSLGYGLAWGDRLQVRLGVHRTRYEKDVLTIAGVRTRGTEETMLYNASAVVGLTGRTALFGSWVTGLEESGVAPQSATNRNEVLPPVEAEQFELGVRHALTDNLTFIGALFDVSKPTMGIRADGSFGHVGQVAHRGVEGSLAGRLGEKTRIVLGTVAFRPEVSGPLVEAGVVGDRAAGISSLVANASVERQLGGGWSVDAQLSYWGERWADSRNTFKTPAQVQLNLGARRSFELGDHPAQFRLLASNVTGADGYWASPSGLLWPIGAPTVRALLSVRFGG

SEQ ID NO: 20718 - protein, 800 aa, Bradyrhizobium japonicum
MKNEYRLVFWSLVVSSFLTQNANAEEKKQGGRVFFNGYEVPIRKGNNLEKVLPKHLGASLMQGTVIGNGQIEVVKDGGTSMSATVKEGGIQVVTSRGYAHNTKIESGKQFVFEREGFGSSERRPQVVRPKGENSRSGRPPRDISAVVIGERKASAYDATVSGENGKWGEQNVYGGGEAWNTQVKKGGMQSVFNSGFASGTQVFDGGEQRVLAKGKVGSVTLHNGAKQVVYTGGELSDLLTIGNGARSWVEIGAKLGGKIDVKSGGHLYVYGSDNKARIIGERFKLDQEGAMELFSVNVQRGTGASSIHITDLSGHGKIHLPTSDYSGRYPQLNVDNLSGDLHFIINLGGGYYGNSFIRIKENSSGNHKVSIVDTGVEYANSSTLTSKLNLISDAVGGAQFALANLSGNGIENVDLGAYKYKLGYDEKSQETDDEKDKRTWYLALDTENSKNFTSLRKSRKRRVIDLDYEDDGSGYGGYTANEISLPSSLESMQTANFSTTPSTDAILSMAVASELIFYNELDALRTGRGIIDRTKKNTALWTALFKDKERLSTGHTHFDLGQTGIVLGADLLKELISGNLFIGGFSSYDQARITHKAGGVSGVNTYSLGIYATYFDHNGWYLDGIVKYNSYQSDLKAVSTNGLAIQGNYRQSALGTSFETGYRFETGYNSWVQPYSQFSWVRVAGKEIELSNGMRGDIDASTSFRTEVGVLLGRDFNVGDSAFVSYLTASWRREYIDDNHTTINKKYKFITDLSGNTGKFGLGLKGSVSDNLTLYAEVNYLKGSKRKGSVNSLIGLRYSF

SEQ ID NO: 20719 - protein, 200 aa, Bradyrhizobium japonicum
MKRIVALALGGLLAAPAFAGGPVTVAPEPVVEPVPAPVVVAPVADWSGFYVGGQLGYGKVDTNIDDLDGNGAIGGLHAGYRYDFGRAVVGAELAYDVTNIDLDGIPDSELDNVTTLKLMAGGKMGKGLLYATAGGSWADASIGGADVSDNGYVYGIGYDYMVNDRWSVGAELLRHTWDDFDDSGVDVDATTLQAKVGFRF

SEQ ID NO: 20720 - protein, 243 aa, Bradyrhizobium japonicum
MKKVLIAALIAGFSLSATAAETIRFATEASYPPFESIDANNQIVGFDVDLAQALCKEIDATCTFSNQAFDSLIPSLKFRRVEAVMAGMDITPEREKQVLFTTPYYDNSALFVGQQGKYTSVDQLKGKKVGVQNGTTHQKFIMDKHPEITTVPYDSYQNAKLDLQNGRIDGVFGDTAVVTEWLKDNPKLAAVGDKVTDKDYFGTGLGIAVRQGNTELQQKLNTALEKVKKDGTYETIYNKWFQK

SEQ ID NO: 20721 - protein, 391 aa, Bradyrhizobium japonicum
MNKILIFTAAGALFAAAASSAFAQSSVTLYGIVDEAIRYQTNAGPGGKDQVAMTSGPETHSRWGLRGSEDLGDGWSAIFRLENGFEAFNGQLHVPGTLFSRQAFVGLSNKTWGSLTFGRQYAPAYDTLGDIFDPLTVGNYWQNSWMYNGIGPYLEINNSVKYKGSFYGLDVDALYGFGNQAGAVGLGATYAVELTYTYGPAMLNAGFQQVSVPTSATGSSVGTSVGSPINGAKTNFLHISGAFQVTHDIRLLAGWLRGQDRTGLTDSYMQQSGAPTLKGGSPNRIDDTYYVGANWHAMSALLFTFAYYYGQTRNAELLDGTLGRGVNQSATVLAEYSFTKRTEVYGITDFARGTGAFSADYPGGVNGQGVPTNTIGRTNQVGVAIGLRTIF

SEQ ID NO: 20722 - protein, 726 aa, Bradyrhizobium japonicum
MFRTSIKRFALAGLMLAGSSLPVLAHAAEDQGNAPVEAEADADAARSGIVVTGQREKVTPQAEQAAVYGNYVQVVGAEQIAASGASNFAELAQFLIKGANVGYSPDEGEYTIRLDGGGDRDTLVVLDGVPLYDRGPALEEIWGTTTIDPHMIEAVEVFRGGNSLFFGSNGGIGVVSIRTKRPDGTNRVELGASYGSFNSRELWGNARMALDGEGGAHSVMVYGSSQNTDGPRIFNPADFVDNVRLAGGVQKYPLNRNNVGLKYRFKPSDATEVNLNAQYTQIEFFDAFPDNETYSPNRVRYPIIDASIIHKWSDALASQLDAYWSNPKLNNTETFAEICRVKAGCVDTQTGKDIPFGTATGRSIAYQYKGYGAESKVSGFMEWGFNFRNTLTLQGVGEAVAGVQMVSYRNDSDPVFKISNEWNRTTGLYLDLRPHLPFSPTTNISLAGRLDFSNAFDSKFIWKFGVRQPMGDFYVRANGGTSYSLPKTNELFADSATTVGNPNLKPESTETYNGAIGFQKTSGSLNVSAEIGVFRTDITNRIQGTSGLTPNTYFNNTALTQIRGITADFNLAIGEQWSINAGFTRQKAHLKGSTLQINETPEYMIQGTLAWNSPDQRWHVNLFPRYQGPEYATGGLNNSLRHNFGNYLVVNGSLGWWAGEDRQHRFQVRVVNIFNEKYAERYGYGNQRFSSAFVRGEITTTSPNYFYGYPFEGKPRAVYVSYTTAF

SEQ ID NO: 20723 - protein, 845 aa, Bradyrhizobium japonicum
MRGALAACALAGTLAAAPAAAQPTAAPASAGARAWHIDAGPLGEALARFADQAGITLLYDPAAVRGRASAGLQGVYSVPDGLARLLDGSGLDARQRGAGTYVLQALPAGPVAQLAPVTIEADGVRADPAWARTATRRELDARQVLDWSDIGKRVDPGVNYNRRTKSINIRGLDENRVVTRIDGIRLPWLDDGARGIQGGLNAVDFNTLSRLDVVRGADSSAAGSGALGGLADLRTLEPADLLRDGRRFGALAKSDYDSADASWGLNAALAGQVHDDTSWLLQAGTRNGHDLDNRADTGGYGSKRSQPSPEDYAQNNFLLKLQQRIDGGHRLGLTGEYFKRRADLDQMYQQGAGTSYQYGANRTHEETTRKRVSLDYQYNAPQAGAAIDSARAMVYWQRLRLDSSQDARRTRDGRAYARPGDPYFYGYPSGPYGRSNSIQESILGVNGELSSRFEGMVSQRVTIGGEWYGNRTEQYSDGYDNCPAIPPGTPAPMGPRLCDMLHTNQADMPRVKGSQWAIWAQDEIAFADGRYILTPSLRYDHYEQKPQQGGGYQNNPNAGALPPSSSGGRFSPKLLGTWKAREALTLYAQYGFGYRAPSATELYTNYGGPGTYLRVGNPSLKPETSKGWELGARLGDDQLGGAVSLFDNRYQNFIDKNVPLGKGSPQWQPAWDGQYPLGVTGLANRARVRIYGAEASAHWRFAPNWRTWGSLAWAVGKDENTGQHLNSVPPLKAILGLGYQRDEWGIDAMLTAATRRDDVQYPEASASARYADFQAPGYGVVDLSAYWRPAAVKGLQLQAGVFNLFDKKYWEAINVPTAGAIAIPRPLDWYNEPGRSVRVSLTYQY

SEQ ID NO: 20724 - protein, 884 aa, Bradyrhizobium japonicum
MRANSTLTKAVRFALIGGATTAALSTMSVFAAEDDNAKVERIEVTGSRIQRTDMESALPVTVLSAEDIAKTGLSDVSAVLAQMPFNTAGSFISDAGSSASNHASSGMRGLGSNRTLTLINGRRIAPSATFGGDATNLNLIPMDAIERIEILRDGASAIYGSDAIGGVINIILKKTFDGLAFDAKFGNPTQGGRDEKSASVTFGNTSDKSSSLVIIEHKQFDPLEGGQRPHLTANWDEKYGRSALYAPEGTYRPVASRPIKGADGTFSDPVYTGLQVPGKDCPADRIVTSKAGSACGFNHFDGTDYLPDQTKDSVFSNMTYRITDELEWFGQAIVMRDKSITSSTALWTPNLYIAADNPLNPTFGTANASEVQAYHRLKGVADRTTEFDSNVVDVVTGLNLELDAGSLSWYVQYSDQIVNIETDSYVFEDKLQEAVDKGLYNPFVEGGNATQATLDTFLHTATRKATSNTTGTGLSWAALAPISLPGGDLGYAVGMEYQKIEYKDTRDAQQAAGNVLGTYGGDSAGDRSYKAAFVELELPVLDHLNVKLASRYDQYSLPDVGQLSNSVNVRYEALDNLVLRASYGQGFRAPSLDDLLGEPATSYDYVTDTTLCQSLPADQQKGNPACEDTQYLRKSSGNKELEPEKSAQYSFGAVWNITENIDFVVDYYNIEITDQVSYIDAQTIVDLEAIGGLGAYDPNYIYVKRKADGTIDEIGAGNINMDGVQTSGLDVSFTSNFDLADLGTFKFAVEGTYALEYTEQASPIAKRYDVLGTKGYPPLRFNTTFSYAIDDFSTSLIAKYIDSYDGETPQQQEVGTNKQDFSSFTTWDLTFNYDFNSYGNVTVGARNLFDAMPAVNYSLGYPGYDTDTHNILGRVVFAGYKVKF

SEQ ID NO: 20725 - protein, 321 aa, Bradyrhizobium japonicum
MTGNIKPENTDAKLEEQTTNFYFSLSKNWATGTSFTVSATGEYYTIGNYHKWAVYPQASLTYLKSPQHIFQLSLSTDKTYPGYWDMQSSVTYLNGYSEIQGTPGLRPMTNYNLNGNYILKQKYIVGLFYKHTSDYFAQSPYQATDRLALIYKNTNWNYMRMIGANIIVPFSMGNWYDARLTLVGMQARQKCDQFFDIPFDRKKWVFVGTLDNTFKVGKNLSFELTGNIQTPFVQGTLDLASTFNLTAGMKWNFAKDKCTLTARCSDIFNSGMPDMKVRFKGQYLDMNSSFYTRTVSLNFTYRFGGYKKQEVKEVDTSRFGH

SEQ ID NO: 20726 - protein, 1086 aa, Bradyrhizobium japonicum
MNASPTRQRRAPDCARVARHPLIPSLLATALWAALPVQAAELQGPLKVVNGESLQLGADDRLLHSGGGFALDVNGAGSTATIDGSRIDITHGGSGIQAMAGGTVLIEGGHIQLGNVTDNAGYALNASGAGSVIRANNLVIDAYRNSSGYGTVNATNGGKLWLNGGSVSSEGHALYSSGRGSELHVSGTTISNGANRGVYAEGGALLSLDALSMTFAEASNGSSGRLSASGSGSVLSLRDVDTSNGYFDIYNGGTLQIEGGRATANGGSIRLLGNSANRVYSSGDITGGRFETVGGYGVNVNSWGKLTTHGAHFTVRDGNSGVWLSGADSLADMTDTVISTFGDNGYGHGVDVWGGTATITGGSIDTHGAGVYGLRASGSNPPTPYSRIRAKDLDITTYGNGGGGVFLGGSTADAELQGGSITTRGTSSFGIVQMNTAKLTADGLRIHAQGANSGAYRSYLTAFGPYWNRLVFNNSQLQTEDGPALWLQGSNHELTLNNTDVVARQQGELDDGRLLRVSDTVFTDGSSVATADILFTADNSRLTGDVVVDSATANVRMTLRNGTRFSGALRNASGYQVAQLAIDGSSQWDVRADSSVATLDHAGTIAFVAPGADGFKTVTVTGDYVGNGGQWLFNRALGDDASLGDQLVIEGDSRGTATVSVRNAGGAGALTREGIRLISVSGQSDAQFTLHGRAVAGAYDYFLFKGGISTPDDGNWYLRSEYVPPVDPPLPPDPPIDPPTPPIDPPVDPPRPPIDPPVQPPIDPPLPPEPPRVERPEPAAYLANQNAAQGMFRHSLHDRSGDPATAADDDGNAIAWAQVRSSQPDSHGRGQQVHVDSRLSSVLLGVGRRFEANAGGQLQLGVMAGQGRARNDSRSQVTGYTARGEVIGSSIGLYATWLQDARMDGGAYVDGWLQYGRFRNSVQGEGLQKERYRSHSWTASAEAGYVLPLQRSAARGIYLEPQLQVLHSRYDADAVVEANGTVVEGRDKDSTTTRVGMRLYTRSLTQGEGQVQPFVAVNWWSGGNGAGLAMDGERLQRQLPRDIYEAKAGVQLNLSGGWRGWGEISRQSGGMGFRDIGAQLGVSYRW

SEQ ID NO: 20727 - protein, 491 aa, Bradyrhizobium japonicum
MGQVTSVSQLSDVRPTDWAFQALQSLVERYGCIAGYPDGTYKGNRAMTRYEFAAGLNACLERVTELIALATADLVTRDDLAVLQRLQEEFAVELAELRGRVDALEARTAELEANQFSTTTKLNGEVLFWVTDTWGERAEARGEPQSENDRTEAALGYRVRLNFDTSFMGKDRLRARLQARDIPNWSARDLTNTLMTRLGTDESDPDDTVVLDKLFYQFPVGDQLQVIIGPQGVEVDDFQTVLSPFESSGSGATSRFGRYNPTAYRGPDDGGLIVQYKPAKQWQINAGYLAGEPENPREGNGLFNGEHSAFGQVAFEPNSKLAFTVNYVRKYFIKDEVNVTSSTGSFRARDPFDGRRTTADNIGLEAQWKLNDHVQIGGWFGTTWARPEDGNNDDDDDITIINGALTIAFPDLFKDGSLGGIIVGVPPIITDGGNDDNLKDPDTSVHVEIFYRYAINDFIAITPGLFVITNPNHDEDNETLWVGSLRTTFKF

SEQ ID NO: 20728 - protein, 259 aa, Bradyrhizobium japonicum
MMSVVNPPLLYSYGILLLFLFPWDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 20729 - protein, 4234 aa, Bradyrhizobium japonicum
MGSNKKRAEARPKLLVPTGMLVALVGAGIVPADALAACVGTTTVSCTGATTTYSNGANNLNLTVGSGATVSVVPLIGGTALSLTGSGVTLTNNGRIDPALSGLSLVSNGTVVGNIASASTVNVTNASTGVMMGSTSSLLNGPALTVYNGIGGTTNITNAGTIGTTGLLGFSAGPTAQVVTTSGGAQVNFTNASGGAINGSVVLAPSGTPGAGNTFTNAGTVTGNVSLGAALGTSNTFNAQTGSSVGLGVDAGLGGNNTLNLQLNPAAGSSASGTLAVDTYGNFTHLAVQGGTWNITGASSAADASLAGGTAIINNSAGLGLGTIAAGGGTLEAGTAGLNLLNNVTLGADLTVDGATGLALSGTIAGGGALKASGTGTLTLNGANSFTGGTNLTGGGGLVVGTDTALGGGALNVSGAGGTLGTSVGGTLLGNAINIDTGVTLGLNGSAGLGLSGAIAGNGGLAQTGPGITTLLGPNTFAGGTTLSGGGIVAGTGAALGTGALHVTGTGGSLATNAGGTLLGNAVNLDAGATLGLNGANGLSLGGTIAGNGGLAQSGTGTTTLLGANTFSGGTALSGGGLIAGNGAALGTGALNVSGTGGTLATNVGGTVLGNAVNLGAGATLGLNGAVDLSLGGAIGGSGQLAQTGAGTTTLLGTNTFTGGTTLSGGGLVAGNGAALGTGALNVSGTGGTLATNVGGTVLGNVVNLGAGATLGLNGAADLGLSGAISGAGGLALGGTGATTLSGANTFTGGASLTGGGSLIVEGGSALGIGGALNVSGLGGSLSADLAAGAALANGINLNGASLTLNGANDLGLSGAIGGTGGLVLSGTGTTTLSGANTFGGGTTLSAGTLLAGSNTALGSGALNVAGTGGALGASVNGTALGNAVNLGAGATLALTGANDLGLNGVIAGSGGLAQIGSGITTLSGANTFSGGTTLSGGGLLAGNGAALGTGALNVTGTGGSLGTTVGGTVLGNAIQLGAGAALTVGGPNDLGLSGLISGAGGLSVSGPGTTTLTAAETFTGGTTIGSGTLAIGAGGSLAASSPVNLTGAGARFNIGGATTPQSIGTLSGVAGSTIDLGANNLTLAGSGSGVFAGDIGGAGGLTLAGTGSQALTGNNTYAGGTALTGGSLVVGSGTALGLGALDVNGSASLGASVPGVTLGNAVNLGTGVTLGLNGANDLGLSGTIAGNGGLAQTGTGTTTLLGANTFSGGTTLTGGGLIAGNGAALGTGALTVAGTGGTLATNVAGTLLGNAVNLGAGATLGLNGAADLSLGGVIAGDGGLAQTGSGTTTLLGANTFTGGTTLSGGGLIAGNGSALGSGALNVTGAGGSLGTSVGGTVLGNAVNLGAGSTLTVGGANNLGLGGAISGGGNLSVTGPSITTLTGAGSYTGNTTIGNGSTLAVGASGALSGGSVFDLAGAGATLDLSAATSPQTTGGLVGAAGSAVNLGGNTLTLGGSGNGTFGGTIGGAGGLTMAGTGTETLTGANTYGGGTTINSGTLAIGAGGSLAAGGAVNLGGAGATFDLSGAGLPQAIGALSGVAGSTVNLGGNGLTLGGAGSGTFGGTIAGAGGSLTLSGTGSETLTGINTYTGGTNLTGGGTLVAGNGAALGTGALNLAGAGGTLAASVAGTTLNNAVNLGTGSALTLGGTNDLGLGGIIAGGGSLAQTGSGTTTLTGANLYTGGTTLGAGGLSVGNNTALGTGTLNVTGSGGALSASTANLLLANAVDLGIGSTLNLGGAFDFGLGGTISGAGGVVQSGSGTTTLGGANTYGGGTTLSSGGLSVGSNTALGSGALNVTGNGTLSASVNGTTLGNAVTLGAGATLGLNGANDLGLSGTISGSGGLAQTGAGTTTLTGTNTYDGGTTLSGGGLVAGNGSALGTGALNVTGAGGSLGTSVGGTTLGNAVNLGAGATLTVGGANDLGLGGGISGSGGLSVSGPSTTTLTGVNTYTGNTTIGGGSTLAVGAGGSLSAGSALDLAGTGAALDISAATTPQTSGMLSGVAGTNVNLGGNTLTLAGTGNGNYAGTIGGTGGLTMAGTGTETLTGTNTYTGATTINSGTLAIGAGGSLSASSPVNLAGAGATFDVSGATTPQTTGTLSGVAGSTVNLGGNNLTLGGTGSGTYDGTIAGAGGSLTLSGTGTETLTGNNTYTGGTTLNGGGTLIAGSGSALGTGTLHTSGAGGTLGTSVAGTTLTNGIDLGGGSTLTVGGANNLGLGGAISGSGNLAVNGPSTTTLTGASSYTGNTTIGGGSTLAVGAGGSLSSGSAIDLAGAGSTLDVSAATSPQTTGTLSGAAGSAVNLGGNTLTLGGSGNGTFGGTVGGTGGLTLSGTGTETLTGTNTYTGATTINSGTLAIGAGGSLSASSPVNLTGAGATFDVSGATTPQTTGTLSGVAGSTVNLGGNNLTLGGTGNGTYGGTIAGAGGSLTLSGTGTETLTGNNTYTGGTTLSGGGTLIAGSGSALGTGALNTSGAGGTLAASTPGTTLGNAVNLGAGSTLTVGGANDLGLGGAISGGGNLAVNGPSTTTLSGANTYTGSTTIGGGSTLAVGAGGSLSAGSAIDLSGTGATLDLSAATSPQTSGALSGGTGTNVNLGGNTLTLGGAGSGTYGGVIGGTGGLTLSGTGTETLTGTNTYTGATTINSGTLAIGGNGSLSSSSPVSLTAAGATLDLSGAASPQSTGAISGVAGSTVNLGNNNLTLGGSASGTYAGNIAGTGGVTMSGTGTETLTGSNTYTGATTINSGTLAIGAGGSLSGTTPVSLTGAGATFDLSGATTPQTTGTLSGVAGSTVNLGGNNLTLGGSGSGTYDGTIAGAGGSLTLGGTGTETLNGTNTYTGGTSLTGGGTLIAGNGSALGSGALNTSGAGGTLGTSVAGTTLGNAVNLGAGSTLTVGGANNLGLGGAISGSGNLAVNGPSTTTLTGASSYTGNTTIGNGSTLVVGASGSLSGGSAVDLAGAGATLDLSAATTPQSTGALSGVAGSTVNLGGNALTLGGSANGTFGGTIAGTGGSLTLSGTGTETLNGTNTYTGGTTLSGGGTLLAGNGSALGTGALTTTGAGGSLGTSVAGTTLTNAIGLGAGSTLTVGGANNLGLGGAIVGSGNLAVNGPSTTTLTGASSYTGNTTIGNGSTLAVGAGGSLSAGSAVDLSGTGATLDLSAATTPQTTGAVSGVSGSTVNLGSNTLTLGGAGNGTYGGTVAGTGGLTLSGSGTQTLTGTNTYTGATTINSGTLAIGAGGSLSGSSPLNLAGAGATFDVSGATTPQTTTALSGVAGSTVNLGGNTLTLGGSGSGTYGGTIAGTGGSLTLGGTGTETLTGANTYSGGTNLTGGGTLVAGNNTALGTGVLNASGAGGTLAAGTPGTTLNNTVNLGTGSTLTVGGANNLGLGGAISGGGTLAVNGPATTTLSGANTYTGGTSVTGGGTLVAGTPTALGSGTLSVGGNGGTLGTSVAGTTLGNAVNLGAGSTLTVGGANNLGLSGPISGGGNLAVSGPSTTTLSGANAYTGGTTIGNGSTLAVAGNGGLSAGSALTLAGNGATLDVSAATTPQTASALSGAAGSTVNLGGNTLTVAGPTGGSFGGTIAGTGGFAVQGSGTQTLTGANTYTGGTTIGSGSMLALAGAGSLAPTSPVILAGSGATLDFTGSAAPQSIGTLSGTTGSNVNLGATPLTVNTAGTSSFAGTLSGTGPLTLAGTGAQVLSGTNTLSGPTTVTGGTLAVTGSLANSPVTVGSGATVTGTGTIGGLVVSGGGTASVLQLGQPLKVAGNATFQPGSTLQVGATPQQSGGLDVTGSATLNGGSVQVVAATGQYQPGKLYTIVNAGAGVQGQFSAVNSTYAFLTPTLTYNPAQVLMSLTPNGTPFSSVATTPDGQAVAGAVGTLGAGNPLFDTVLTSDAPTANRAFTQLAGDLYPSTRSVLLSDSRYVRDAVLDRARLGSQPGGALCGCEASVSADDHSVALDRRMAAENGCTPAKSYKPAVWGRLYGSHSRFDGDGVASIDRNLYGFVVGTDAEVSSHWRVGIAGGASRSQLNTDQNESAKVNGETIALYASGRYNAWNVRGGVSQSWYRVHSERNPSFGSFSDHDTASYDANATQVFTEIGYSMAFRNVALEPFVGLAYASLHTDGFKENGGAAALQGDSDTTGLGFSTLGVRASTDVAVTTKGKVTAFGTVGWRHAFGNTQPASRLSFASGGSPFSVTGVPVARDAAVLEVGVDAAITKNLSLGLSYSGQIGGSISDHALYGNLLWKF

SEQ ID NO: 20730 - protein, 1014 aa, Bradyrhizobium japonicum
MITYAQEITVTGKVTAGGEEMPGVTVAVKGQTRGTITSTDGSYQIQVNGNESLIFSFVGYETVTIPINKRKVINVELKETTQMVDEVVITVPYGTAKKSTFTGSASYIAAGTIEKAQVSSVSKALQGTVAGLQSFSSSGQPGSDATILIRGVGSVNASTNPLYVVDGVPYDGALSSIASSDIASITVLKDAASAALYGSRAANGVIMITTKQGNKDSAPTVELSAKYGFSSRARADYDQLNTNQYYELYWEAMRNYRMDNGYSAEEAAAWASSNVTGNLGINPYGSAYPEPIGHDGKLVAGAKPLWNDSWDDALSQDAHYTDLNVHVSGGSKTSKYFVSAGYMDDQGAYICSGFKRYTLRANVTSDIRKWLQIGLNVSGTHSVQDYPKQDDSTISNVVMFARSLPSFYPVYQRDLATGAYLLDENGNRMFDYGEYRPNSYAKYNLLASMPHDKSEIKRDAASLRGFIQITPIEGLSYKMSLNIDYNNKTNHDYTNPTYGTGSISGGSVSKYNYRTTGMTFNNVINYQHTFNDVHDIRVMAGQEYYEYNTSNFGGSRSKVIMDGFYEPDAASSLGDFGGNSDQYKLLSFFGSAEYSYDQKYFLSASVRSDGSSRFHPDHRWGTFWSIGASWKIMQEEFMKDTSDWLSNLSLRASYGAQGNDQVGYYAYQALYSIRNNLGESGLHAYRLATPNLSWETNLNTNIGLDFGFWNNRLSGTIEYFERRSKDLLFSKDLVPSSGFSSMDENIGAIKNYGWEFQISGYPIMTKDWKWKLSFNATTYKNKITSLPAEEMWSGNKKWVKGGSLYDFYLVEWAGVNPENGNPMWYRYNTNGEKVTTEDYSSTTPDDKVKCGNSLPDWTGGLQSDLSFKDFTLSFLFSYSIGGKIYNGDKVSLMSQGPTGTSWSVDMLDRWTPENPYTDVPRLTTSPKSSWTNSSNRFLVDRSYLRLKNITFSYNLPKSLLNTLTLKDASIFFQAENMLTLAKQQGLDPEQTFGGSTYYRYPAMKTISFGINVKL

SEQ ID NO: 20731 - protein, 730 aa, Bradyrhizobium japonicum
MVQLVSPSVINQFFEGTHADPFSVLGMHETEKGIEIRALLPDASRVVVIDRETHNAVCELEHVDERGFFAAVIPKTRTFFAYQLQVFWGAESQFIEDPYRFHPMLADLDNWLLSEGSHLRPYEVLGAHFMECDGVSGVNFRLWAPNAKRVSIVGDFNYWDGRRHPMRFHQKSGVWELFLPKASLGQLYKFELIDCHGQLRLKADPYAFSSQLRPDTASQISALPEIVPMTEQRRKANQFDQPISIYEVHLGSWRRNLENNFWLDYDQIADELIPYVKEMGFTHIEFLPISEFPFDGSWGYQPLGLYSPTSRFGTAEGFKRLIEKAHQAGINVILDWVPGHFPSDTHGLAAFDGTALYEHADPREGYHQDWNTLIYNYGRNEVRNFLSSNALYWLERFGLDGIRVDAVASMIYRDYSRAEGEWIPNQYGGRENLEAIEFLKHTNWKIDSEVQGAISIAEESTSFAGVTKPSTEGGLGFHFKWNMGWMNDTLSYMQKDPVYRQYHHDQMTFGMVYQYSENFVLPLSHDEVVHGKCSLLGKMPGDAWQKFANLRAYYGYMWGYPGKKLLFMGNEFAQGREWNYQESLDWFLLEEEHGGRWHQGVQLLVKDLNHIYQQHASLFELDGSPEGFDWLVVDDRQNSVFAFERRSKDGERIIVVSNFTPVPRHDYRFGVNMAGNYVEILNTDSAFYQGSNVGNYGEVGSEAIPSHARAQSICVSIPPLATIYLKYQGE

SEQ ID NO: 20732 - protein, 483 aa, Bradyrhizobium japonicum
MPLSTLRTYPRGVYYRDPIFALIKSQVCQRMECLKTLCRCMQAVSPSNGLTGPPLLRALNTMHKTTLGFTVAMISTHLYAGGFALNEQGISGMGTAFAGRASAAEDAGTVYGNPAGMARLAGQQVTGGATFIDASTDISQASGRSSGSNDGDMVPFKAIPFGFYTRRLNEHWAIGLGAYVPFGLATDYERGFQGRAFASKSDAKVLTLQPTLSYAFNDRVSVGFGPTINQFAGSLESDLTLNPAIADSNVKVKGKDVALGFNIGVLASLTDTTQAGLTYHSKVRYDLDCHTEVATGAGTPAQLLSSNRYDCSLQVDTPESYELSVTQKLTDAWTLYAGTTWTRWSRMKDLSFSTENIRPARGGILAASLSGAIAGGLDWHDTWAYALGTSYRLDSHWSLRTGIRLDQSPTSNTNRSPRTPTGDRTIFSVGAGYDVSKELTLDVAYAYLKEESVDVSRANALASYSARYQNRASFLGVGATYRF

SEQ ID NO: 20733 - protein, 518 aa, Bradyrhizobium japonicum
MSFCGHAGVGPEAGRDRRERHQHKKRTTMRKQKRSGTASKMLLAWGLPALAGVSLTGVAHADDAASVPLTIAQAAPSAGTGATVAQATTPNAVVNAEATQAVTPPEEPSAQSKSKGFIADSHLNFLFRNYSDVLDSKGGPHRHAWIQGVMANFESGYTAGLIGFGVDASLYAALKLDGGAGAGNMVHIAKGGGGSNQLAWAYPGIYDVKARISNTVIKYGLQAVDNPFMEQHDNRALPPTFLGATIVSNEFKNVMLEAGSFTKTDARGHTTLTNLTTQYGGTRVNRITYVGGTWDYSPNGEVALYANQADDVWHQYYASVKHSIGSPQTIKWTGFGNVYSTHDTGDALQGKIDNNAYSLSLAAQHGPHELMLAYQQVLGDQFFDYLNETNGIFLANSMDVDYNAPHEKSLQLRYTFYGKEAGLPGFKAMIWGVTGWGADGSAGAANDPSRSSIYWSNGAPVQGRHHEFGFIPSYTFQSGKLKDTKVTFIAMWHNGSAHYSDATNREYRLVVNVPLHAF

SEQ ID NO: 20734 - protein, 189 aa, Bradyrhizobium japonicum
MLRRFSLFSLGFLGWLLVSGNASASFSSTLSEGYHTLSNNVAQTWNEPEHYDLYVPAITWHARFAYDKEKTDKYNERPWGAGFGVSRWDEKGNWHGLYLMAFKDSFNKWEPIGGYGWEKTWRPLTDQNFHLGLGYTLGVTARDNWNYIPIPVILPLASIGYGPATFQMTYIPGTYNNGNVYFAWARFQF

SEQ ID NO: 20735 - protein, 650 aa, Bradyrhizobium japonicum
MIRALLSSTALATALLAAPALADDQKAPEADVAGATGANGVAELVVTATRTVQPIEKVGAAVTVLTQPAIEASQAISVTELLAQTPSVTFARNGGVGTATSLYIRGAESHHTVVLIDGVKLNDPSSIQGGFNSGNLLVGDISRIEVLRGAQSTLWGSQAVGGVVNIVTAEPTTPFTSSLSAEAGARKTGYLRGAVGGASDKVTWRVAGGYYTTDGFSAHKTGKEADGYQNAGASGRLRVKLTDAVSVETRAVYSRGKNDFDGFNTDSPEFGRTKELVIYQGLNAALLDGRWNNRVGFAYTDTDRENYNPARAAVPMTFDAAGKNKRWEYQGVFAITETWTATFGAESERSRMRTRSPSVANPNVAFRTGKTSADSLYGQLQAEIAPGLTVTGGLRYEDHDAYGAHTLGQVGAAWALNDNATVLRAGYSQGFRAPGLYELFSEYGNPALSPEEFDSWEAGVEQRFLEGKVRASATVFHREADNEIRFFSCSFGATDTICAPGGVFRFGYYRNLQKTKAQGLELIAEARPVEGLTITGNYTYTEAELAAGANTGKQLSRRPKDLANLSATYRWPVGLSTTVAVRYVGKTYNNEANTVAVSDYATVDLRASYPISETLEVYGRVENALDKDYQTILNYGTPGRGAFLGLRARF

SEQ ID NO: 20736 - protein, 1021 aa, Bradyrhizobium japonicum
MRTKLNGILTLILVLFVQITFAQTNTVTGTVTDPDGLPLPGVNILIKGDNTGTQTNFDGNYSIQASSNQTLIFRYVGFTTKNVKVGNQLQINVSMAIDSATLDEVVITGYSNRNQTVATSASVSISAEEIAELSPTTSIDNLLQGKAAGVQVTAANGKPGQGAFVRIRGVTSLAAGASSPLYLVDGAPIREQDLASIPNSDIANIEILKDASRTARYGSRGASGVVIITTKSGNRNKDAKITFNSRFGETQRVEPNFKMMNAQQKLQYESEMFALGISGAGSLPGVTTEPGSVERQFLLDNQTDWEDLTLRKGIVQSNAISVSGGADKMDYFFSAGHDRNTGIIDQLGGFERINTRLNVNFDAKEWLKIGVSVGYSRSTSDEPRDRNNVQNPFRAMLDYNPYETEFVLDDEGNPVLDANGDPEYSTTSTGFNNRGALLSEPSVDINNLLSSSFSADILLSDSFTYSFRTSINSLNFRSDGYSKPGGILDALIGSDEFPGNKLDNGTYRFDLTVTNSLNYNFTKGKNTLNVLGLYEYNLNEFRSYSVRSRGFTSPLLTTQINAAEVTAGNTRRSELALVSYGLFADYDFDQKYLFTASGRVDGSSNFGSGEQYGFFFSTSAGYDISKESFFDVASVDELIFRGSYGTTGNRAGISRYASQGTVGFGSYPGGSATVPANIANPALKWETSLNTNIGVQLSMFNGRLTAVSDYFIRDTEDLLFQIPRADEAGVGSVAGNLGEIQNKGLEISLRGDIIRNDDITWTVGGNVLFLDTEIVSLPDGEDIAPNSFNILYREGSKINEHYLVRWAGVDPATGRSQYLDANDNVVFADALTAEGAEDARTLQGKSTIADVEGGFYNVFRYKNLSLRGDFVFKSGNWINNFVRQQRNSDGDQINSNQATSAFNYWKQPGDTNVQPNPRFRQDDIDVNSDRFLEKGDYIRLRNVTLSYNFSKEILDKTPFSSVRLYAQGQNLLTFSDFYGDPEVGLSSGETISFANSVAPGEATLYSYPNLKSFQMGLDISF

SEQ ID NO: 20737 - protein, 1098 aa, Bradyrhizobium japonicum
MIFFQHHEGVKENYWLIKLLITMKLTFIMIICLSLQSMANVYSQTKISLRMESVALKKALAAIEEKSDFYFVYSEQKAISQLKVSINSNEEPVLEVLKKMLLNTGYTFEPMANNLIIIKPVGAQQTVSGVITDETNQPMPGVSVKVKGTTRAVITNAKGAYSIQAATNEVLVINYIGYEPVEETVGSRSTINISLVTSNQGLNEVVVVGYGTQQKREVTNAVSQIKGSDIRKSSAPAITNSLAGRVPGLVVNQRNGEPGRDEASVLIRGLSTTGDSNPLIVIDGVANRDGISRIDPNDIETFTVLKDASAGIYGAQAANGVILITTRRGKTGASQFNYSFNQGYVSPTRLVKMADAGLYATIVNDINLQSGTAPSFSPEQISQYNSGQLPSTNWQEEILRNHSLQSRHSLTMDGGTENVKYFLSAGLSTQSGLLKKDETTGFKQYNFRSNIDAQASKRLKIGLDLAGRRENIDFLQVEQQLLFQGALIAAPNIPATINGLPTAGRQGYNPLAIAQGTGYDKEERNTLNGTLRYTYDIPGVEGLYLDGYAAYDYIQGFRKVWSQPWTYYEADANDVLAPKSFGPARALRQYFTRSNSLTLNSKINYKRAFGKHDVAGFLAYEQNEGRQDLFDAQRTGFVSSQIDQLFAGSLGNMTNYGEAFQTARQNYFGRFSYAYDSKYLLQVHFRYDGSQIFPSGERFGLFPGVSLGWVMSEEAFLKDNPVISNLKLRASWGKSGNDRIDPFQFLNKFTYGNGGYVFGGQDFQALNPGVAANPNITWENQVSRDIGFEAGFFQNKLTMEVDAFFNKRTKIQAPRNITVPQYTGLLLPDENIGKVDTKGIEASLTYNGNWNEMKYNIGGNFSFARSKVIFIDEGNTYPEAYQKLEGKPLGSPLLYNVIGIYQNEADLANFPGLSGVKIGDYIYADTNGDGVLNSNDQIRVPLSNVPQIQFGLNLGVSYKGFDLSALIQGQAKARQYMDYTVSLGNNGPDYFLSNAWRPDATGNELARAGRSLLGQNNTSFYHDVSFVRLKNLELGYTLPKPLLAKIGVKALRFYTNGYNLLTFDGLKKKGLTDPENANEKGWRYPLTKSINFGANLTF

SEQ ID NO: 20738 - protein, 875 aa, Bradyrhizobium japonicum
MIRLQPLCCAALAGTLVLAPCGSLLAFAADARASEEAPADEGDAGAAPGAEPAPATRAPGDGAALAVRPPELTGAVEAAYPQAAREAGLEGSVVLRLTIDAEGRVTGAEVAEPAGHGFDEAAQQAALRFRFTPARRGDRSVASRILYRHDFRLPAPTPAAAPVAGAAGAVPITGVAGAAPATGPVRAAPVAGAAGPALPAIEVSVRGASEAERLRTSAQAVQVIETVEARRQAADLGQVLARAEGVSVRRLGGLGSDARFSLNGLTDDRIRFFLDGVPLDLAGHSFGVANVPVNLVERAEIYRGVVPLRFGTDALGGAVNLVTDQDTRGAGASASYQVGSFGTYRLTLSARHAHAPSGLFARASGFVDRARNDTPIDVMAFDERGRLSPARGRRFHDGYVAAGGAAEVGVARRPWADRLLLRAFFTSHDKEVQHGLLVDMLDGRVKSPPFGEVAFGRQTGGALLRYAQPFSGRARLDALAGYSYARTTFLDVATCTYDWSGGCVERPYRGEVGDDANDQQVRQHTAFARVNLAWHPATEHVLRFGLSPSHVTRTGRNLVVAEPEKDPLTAERELWSGVAGVEYEARPLEGRLANITFAKLYLQSVRTREHLPSGRIGDVDRASHRVGAGDSLRFRFTDALYAKASYEFATRLPTPEELFGDGGLIVRNVHLEPEASHNVNLGVTLERAETGAGQLRLSASGFGRFTEDLITLRRHLGYSEYGNTLSARSVGIESTAGWTSPGNWLSVDGHVTWQDFRDGSTGVRIQNQPYLFGGVAARARWPEIAARRDALSLTWHADYVHAFFVGPEGRGAADSKAEIPSQLVHTLALTYLVERGGWTVSSTVEVQNLTDEKAFSFYGVQRPGRAAYAKLALSL

SEQ ID NO: 20739 - protein, 279 aa, Bradyrhizobium japonicum
MRILGEVLKNLSVAIAAATIFFALVPSPVDAQNVNTQDPVEQDVNTQKTSEISDQSFLEKGRFQSVLDRMHIRAGITSIRFREGLDVKADGNIAQTIDLFTDLEVSFDEIFELENVNTFVLEVGYRASQYLSFAASVPTPPEEEEPEGGEPTEFGKIIRGIEYWPIVVEARFHPSFVDWIDPYVGAGVTFLRVRATDPGPLEEVSANNTIGFGVSAGFEIPIARKFGLFGDFKYYDLDTDGTFTAITADLGDRGDLVVDGTGVVRFDPTVFTFGLSYHF

SEQ ID NO: 20740 - protein, 743 aa, Bradyrhizobium japonicum
MRERLYRGIALAGVAAASIFAAAPVLAQEVQSDRAVPDGEIVVTATKRAESLQSVPISVSAIGGDTLAKARVGSVDSLVTKVANLQLTSIVGDNTPIFALRGVSMSDYSLNQSSPVATYYDEVYKGNFAFLGVTMFDLERVEVLRGPQGTLYGKNTTGGAVNIIANSAKLGETSGYFSAGYGNYDRFDLNGAVNVPLGEKAALRIAGTYARADGWFKNVVPGKPDLASTDEYAIRGTLNFEASDTVRFVLRASTSYQNPQNYGIYAQPEDVNRPGLDRWEIASNIATKRKARTYSVALTSNFDVSDTLTVTSITSWDKGNLFFYEDTDGTASQLLEIPYTDRATQFAQDLRLTSDTGGPFDFILGAYFNREKVYNETAFEIGKDIDLTGDNIVTADDCVEGLTNEDGSDDGIACLFRNRFDQVKKSYAIYSDLKYQVTDAVTLRGGLRYTHDTGRQSGFRSDALGVDGSEVANLIPLSSLSYSQDNLSGKIGLDYKLADGNLLYASVSRGYRAPSFNAQAFFDPSELSVAKPEQVTSYEVGAKTQFLDRRITLNVAGFYYDYRNQQFINVDPVLGSQTLLNIPKSRIYGGEAELTIRASDRLTLHSGMGVLATKIQRGSVSGVDVSGNRLSNAPTFTFNATIDLTLVDGDMGKLSVHPDVAYQSSQFFEVLNIPRLRQTSYALVGGHIDWESADGRFNASVWGKNLSNKFYFTSRVDLLAGFGFDYNHIGNPRTYGVTVGAKF

SEQ ID NO: 20741 - protein, 242 aa, Bradyrhizobium japonicum
MKKILFATVALAALASSSAFAADLGARSYPYATKAPAYVAPIYNWTGFYLGAHLGGAFSSDNNFSGLGTGNNSNGRFLGGVQAGADWQFAPTWVIGAEGQYSWLSGSVGAAFPGGYVYNNSQRGLGSITGRVGYTWGPGLLYVKGGYAYSDNNEKVTLAGNQVGFATSGDHRNGWTVGGGIEYMFAPNWSAKAEYQYYNFGSATFAAPAALVPTGSFTTDDHTFKAGVNYRFNWGVPVAARY

SEQ ID NO: 20742 - protein, 980 aa, Bradyrhizobium japonicum
MAPNHFRLASLVVPSSRTTLAALCLLAGVAVGAQAATSRADVALAASRARTAGADSVHDFDIAAGPLDQALAAFASQSGLRLAIDATLTRGLSAPALRGRHTARTGLRRLLASSHLQAVVHDDGSLVLRRDPTLPTFELSPVRVLSDPVRDVYLAPRSSVYVSAVDIARFGVVSPADLLKGLPGVQTGDSRNGGGLDVNIRGIQGQSRVAVKVDGAEQALDVYRGYAGTQQRSYIDPDLVSDIVIDKGPSLAPAAAGAIGGTVRMRTIGVQDILRDGQSVGLRVTGSLWNNGVSPASRDPHPRHPPEDAELAAPPRTQRGNLFGSDAQAGSVAFAYSDATFDVVAAYARRSQGNYFTGRHGHDRYRVFEGNAERASVATAYRPGEEVLNASARTESVLLKGALRPADGHSVELGYRRLDGRYGEIMPSDIFRYGTAGIWQYPLGTVLVDTTTARYRYTPSGTDLVDATVNLWTTYAKTRQLNTVIAPASEFYRDDRNWVRVANRRIGGDFGNTARLSSAYGEFRLELGGAFQYEDIGPQRGVRITQHDRNGNRYLRDAARRELGLNAKLTYQPTERFTAWAGVRYARMRHRDHNSHATPRQAQRLMRRIVITNPDDDGIMSYGYMDWFPDANGQFTDATDPRLHNGTVYRDAELPSEGIAFDDFLVNARTNVRVTDASVRDTVIGYDFSPPRINRDQGLAPALGVDYEIAPDMHVYASYTQGLRMPSLFETSLGVLQTTPGAGLRPERAHSWEAGIGAMRDDLLQAGDSAAYKLAYFRNDIRNYITRYYRPGANGLMTFSNAERYRVHGLELQTRYDVGRYFADLSATYYLKTGTCDPAFAAQLRASAGRGRSTQDTPDCTPGSFMGSYANTQNPPRLAVNVTAGLRLLSQALTLGARMTHTSGPTARADRPWQQGATTAQLLYHPLTVYDLFLAYRVHKRVALNISLQNLTDRYYLDPLAQSYMPAPGRTLRVGLQAWF

SEQ ID NO: 20743 - protein, 832 aa, Bradyrhizobium japonicum
MGHGARTFSGGINISKALASALMMSTAIVAGGIMTNRDAYAQNAAQTSFNVPAGPLNRALTAFGRQAGLQVTYLTSIGAGKTSPGISGPATREQALARILQGTGLSYRFTNATTVAISEQAASGGGGASVAGAIALDTIDVQGAANPNSTMTVPPVYAGGQVASGGRVGFLGNRSVFDIPFSQTNYTEQLMRDQQVRSIYDVFENNPAMRPESSPYNFQQSASVRGFTLNSRDYAFDGLYGLINFRRPQLEGIERVEVLSGPATFLYGFPPSGTSAGLVNLIPKRATDDPIARITANYLSRGNGGLAFDVGQRYGDQKEFGVRINGTGSAGQTPIDKNELGIGSLTAGLDYRGQDFRASLDAGISHQAYKAVVNGLSLGANDFPIGPAPRLTSNFQQPWADVKYNQRFAVGRAEYDITNDWTLFGAYGASYQDEKNFSTFAVLNNTAGDITQTTAPFRTSVLSQSGEVGVRGKVWTGPIKHSVSLVYTGYRNDSQTGESYNEVFANNIYAPVNFPAPDRAAQLAALQQSKFNRLLTGIALIDTMSVADDRVQFSIGGRRQHLEINRYDVNGLLTSRDDQDANTPMLALLFKPWQPLTLYMSYAEGFGFGPQAPLGAANSMVFLGPRRTKQIETGAKVDFGRFGATLAFYRISQPSAFLNPVTNIFGYNGEQMNEGIDFTMFGSPIDNVRLLGGVTFLDGRLTKTLGGVNDGKRAPGVSNVQLSVGAEYDVPWVPNFTVTGRVVHVSDNYLDPANFQRVGGWERLDLGARYKFRAWDRDMVARLNVDNVTGRNYWFANPSGQLSLGVPQTFRLSLSADLLPSPTTPVAPMYRK

SEQ ID NO: 20744 - protein, 195 aa, Bradyrhizobium japonicum
MVMVFRGLFFVFFPVFFFASQADAAIPYVGGSTGFAFMSGDKLTINGTYLGDPEYDTGAAFSGALGMDFDGYRLEGEVAYQKNEIDNLGSDVSVLSVMANGYLDFQLEKSKIIPFVSAGVSYANVDVDALGDDGSDGLLAFQLGAGVGFQVSPTVTVDAKYRYFASADPEIEIGSSKLEMDINSHNLLFGFRVSF

SEQ ID NO: 20745 - protein, 227 aa, Bacteroides thetaiotaomicron
MENRISGLALTLLTLGSGVISAQAEDSQAPPVLHLQQDSRLSLDQSPEHGIWKAGTGEGFKAGTKEAGFAFGAGLGMSIFGSKQAHDLALGKIHYGWIFTDVLGEEHWYRGNWELLGEGFGGVQYRPHHAYVAGGTAIFRYDFATGTCFIPFVDIGGGLTATDIGKPDLGGTFQFNLQAGGGVNYFWRDNSAITFEYRLLHISNAGIERPNLGLNTSMFYLGMSWFF

SEQ ID NO: 20746 - protein, 286 aa, Bacteroides thetaiotaomicron
MRISLACLAALCALPAGVMAQDASVHDKPAVRGSIIANLLQDHDNPFLLYPYESNYLLYTWTSDLNKEAIRSYDWAENARKDEVKFQLSLAFPLWRGILGDNSLLGASYTQKSWWQLSNSKESAPFRETNYEPQLFLGFATDYQFAGWTLRDIEMGYNHDSNGRSDPTSRSWNRLYARLMAQNGNWLVEVKPWYVVGSTDDNPDITKYMGYYRLKVGYQLGEAILSAQGQYNWNTGYGGAELGVSYPITKHVRAYTQIYSGYGESLIDYNFNQTRVGVGLMLNDLF

SEQ ID NO: 20747 - protein, 1033 aa, Bacteroides thetaiotaomicron
MNCMPFARNHSTLYAGIAIALFASAASTSVSAQQADGTPAPTGQAEVQATDLDAVTVTGYRYAIEKSLEQKRNANAVVDVITAEDVGKFPDKNVADALQRVPGVVISRDGGEGKNVSVRGLSSELVLTELNGNYIATAESNGDPTRSFNYTLLPSNLLGSAELYKTPEARIDEGGIGGTVILQTRRPLELEPNSGFVSAEGTWSDTSKKTDGQFSGSYSWHDKDNRFGVFVGYTQQKRTARTLNASTESWQWYGRDEVGPAVDVNGNPSDFNANWWGGTGFWNQDGNYSTGFMMPTAVSLDAKREERERKGGQLTLQFKPTDDLTLTANYFRFDLSQNSQTNTIKIPEWNIARYNGDGNWRGGRLLDGLQFDPSGTIVTGAAYSLRPGKTYYCSEAQAAAAGLPPGGWGSDDCTVPTPQITGSYNIEKSQSQTVDLGGEWRGEQVDVAFKVGRTWAKGGPELQFSLPIKPRLQNADGSWTNGNFASAWDLTGTPSMTFSPQLMQNLRDGILQVDLGSTGSSWTRNTNQQQYAQIDTTWHIDGGFFDSLQFGLKRRDGGIHRSTGNNYWVCPGTDPSDYDNRYWNGRCNAIATQFSPGLLFAQDNLAGGVNASAFPAINFPGYIGYLNQTYGAMQTRSEDNFVYNVDEEIYSSYLQLNFHTERLRGNVGVRVARTGQRADSTDKVTAYNDYFFDAADGNPLACQQGAAMPGGAPADTYCGTEGYWRLSDSVQRTESFVISGLDRNYTDVLPSFNLAYDLTENLLLRAAAAKVIARPSYNDIAAPGSLEFYSPEYVADRRLTGGASEQGWYGSGSNKNLEPYKANQFDLGLEWYFHPGSVAGLGLFRKNVENFAVDVISDVNMMVDGQPVTVQNYSTQAGGQDAVSQGVELYAQHTLPFGLGVQFNYTYNDASKAAVRLEDGTEAGKTSMPGSARNQTNLTVFYEADSLLLRASYNRRGELVQGLVNGLNVFEEPYYQIDLNAAYNITPALSLTASVLNLTKQESRSHLGDDTRARFYTGGYAGRLAYLGLTYKF

SEQ ID NO: 20748 - protein, 273 aa, Bacteroides thetaiotaomicron
MYYSQRWGGTSLLVGKINAVDLLANDPFFGGWGTDRFMNLAFVAPPSGVVPAVLMGGLLAQQIGEVNLSALVFDPADQTSNYWVDGLFEDGVNVSLAAQWSGTAWGRATNLGLSYTFSTKDSVDLRSILLPSDSKIIATSYPDNLSLQFGHVFFPSKVRPGKGIGFYGKVAATRGNPNPIGWSFIGGITGEGMFENRPYDSFGVGFYYYSWSGALDAALDPFIPLDAEKGLEIYYNFAVTPWFILTADLQVINPGRTNFATETVAALRAKFTF

SEQ ID NO: 20749 - protein, 211 aa, Bacteroides thetaiotaomicron
MKFFSKDLFKKVTPLFLSVYFLSPTLTQAKSRFYVASQYQVGKMIMKKYNDLKRTIEGASFSLGWEINPTNYWFYSRYYFFMDYGNVILNKRTGAQANMFTYGFGGDLIMEYNKNPLYVFSLFYGMQVAENTWTISKHSANFIIDDWRSIQGFSLKTSNFRMLGLVGFKFQTVLFHHDASIEVGIKWPFAFEYDSPFVRLFSVFISHTFYL

SEQ ID NO: 20750 - protein, 346 aa, Bacteroides thetaiotaomicron
MMKTIKLTLLAAAVLASPSVMADAYKFYGRIDYSVTHSDSGSATHSGKSGTILENNWSRLGVKGDAALNEEFTVFYQIEVGVNGASEGKSNNPFSARPTFLGIKHSTAGQLAAGRIDPVFKMAKGTADAMDMYSLKHDRLFAGDKRWGDSLEYKTVKWNKLQFGASYILEDNYYDEDDVRRDNGNYQVALTYGDKLFKTGDLYLAAAYTDGVEDIKGFRAVAQYKIDKLMLGTIYQSSEIVNPNLDNWQQRDGDGFIVSAKYQIDKLTLKAQYGQDDSGTGKIAGRVYSQLGAAATEVPEVSQWAIGAEYRLSKSTRVHTEIGQFDVKQYSDFDDTIASVGFRIDF

SEQ ID NO: 20751 - protein, 960 aa, Bacteroides thetaiotaomicron
MLLKTQNKKTPLGDSNLARHLVYASLLAASAFHCKAYSACVTTTGPGDPYNPASGESVSCSSTAPNPDPQRIDAVAGASNVSVSVAQGAALNVAGADAVRLRNTSTLTNAGQTSAAAGFAGVSLAGNGNTLTNAGTITGGTGVLGGGSGNAVVNRGTITGTAGAGVSLTGGDSSLVNSGSIAGSGATAVQFGAGADSFTMEGGTIQGAVSQGDGVNRAVISGGTITGAVTQGNMPDDFRMTGGQIGSLAQGDARDTFFMSGGTIVGAFEDGDVATMTGGTIGRVDMKLDNNIFDMSGGTIRGNLVAGFGNDTIRLSDGVIGGNISVSGGTDSLTITGGRLEGSALMSFGSDTLTWDGGGTVLGRIDMGPDSDTATLRNLGAAQLAPTASFDGGLGTDTLTLDNTQAGGVARFVNWESVALQRGSGLSMDGDLVLGDSGTGTGVLTLDATSTLKAVPGTVASIRAMTAGQLASVTNAGTIDLTGGSAANRLTIAGNYTGNGGTLKVDAVLAGDGAAADRLIVSQGRIGGQSLLSVNNLGGAGAATVTDGIMVVQATNGATSDAAAFSMPQTVKAGPYQYFLYKGGVSAGSQENWYLRSTVPVVPPPTAPADPQQPAPQQAPGAPVVLPPAIVLAQPQQTPMEVPIYRPEVAVQGAVVATSRQLAITTLDTFHQRQGEQSLLTGKGRWTGSWGRVFGETIDNRYSGGAAPQLDGHIAGFQLGQDLYTWQRDNQHQDRIGLLASYARAKGDVRGFTLAQSGALSGSLDIDGYSLGAYWTHIGPTNWYTDAVALVTWLSADMKSRDGMDRSTRGTATTLSLEGGYPLPLGSRLTLEPQAQLIAQYMSMNGFNDGVAQVSFSESNAYVGRLGLRLKSTFESGGRLVEPYLRANLWREFSGTDQTVYDGGAAVPTRFGSTSLQFGLGVAARVQERVSLYAEVDYLTDVSGDYRQGWTGNLGMRIRW

SEQ ID NO: 20752 - protein, 1107 aa, Bacteroides thetaiotaomicron
MLQIYEKIAEKIAHKRVFLTFLSLILIQTFALAQNDSKITIQQKNITVIDALKTVEKQSKMSINYSDSELTGKVIAQLNLQNASLETALDTILKGTGFSFQIQGNYIIIAEKKPVVAQILKNIKGKVTDESGEPLIGVNISVDGSSTGTITDFDGNFTIKAAEKSILKVSYIGYAAQIIPVSKKDFYPVVMKQDTEVLDEVVVTALGIKRAEKALSYNVQQVKGDALTTVKDANFVNSLNGKIAGVSINKSASGVGGATRVVMRGAKSIEGDNNALYVVDGIPLFNTNMGNTDSGIMGEGKAGTEGIADFNPEDIESLSVLSGPSAAALYGSSAANGVILITTKKGKEGKLSVQFSSSSEFSKAYMTPEFQNTYGNKKDMYESWGEKLLTPTSYDPKKDFFNTGTNFINSVTLTTGTKSNQTFASVSSTNSKGIVPNNEYERLNFTIRNTATFLNDKLQLDLGASYVKQKDKNMVSQGQYWNPVMAAYLFPRGEDFDGIKSFEHFDESRQLPVQYWPVADPVYASQNPYWTAYRNVATNEKSRYMFNVGLTYNITDWLNATARFRMDDTHVLFERKIYASSDDKFAEGKKGLYGYNNYEDRQEYADFMLNVNKHIADFSISANAGWNYSNYWALERGYKGTLLGVPNKFAASNIDPANGRISEKGGDSRVRNHAVFANLELGWKSMLYLTLTGRNDWNSRLVNTDEESFFYPSIGLSGIISEMVKLPEFISYLKVRGSYTEVGAPVSRSGLTPGTVTTPIVGGALDPTGIYPFTDFKAERTKSYEFGLSLKLWNKLSAEVTYYHSNTYNQTFLGDLPEFTGYKQIYLQAGNVENRGWEASLSYSDQFKFGLGISSTLTFSRNINEIKEMVENYHTDLMDEPINIPEVLKDGGRVILKEGGSIHDIYANTFLKKDHLGYVEVKSDGTFGMEKGEPVYLGKTSPDFNMGWSNMLTYKGFGLGFQINGRFGGVVTSSTEALLDRFGVSKRSAEAREAGGVLLKGQGLVDAKSYYQMTGTGNYETSGYYVYSATNIRLQELTFSYTMPNKWFGNVLKDVTVSFIANNPWMLYCEAPFDPELTPSTSTYGQGNDYFMQPSVRSFGFGIKFKL

SEQ ID NO: 20753 - protein, 452 aa, Bacteroides thetaiotaomicron
MQNLRRAVFAGLVAGTLSEGAAATAGDGGFVEDSELQFLARTYYFNRDYRDSPNNAGRNRFKPRSERNGYREETTQGLRLQFASGYTPGSLGFGLDAHAMLGLQLDSGGGRTGTGNLPVGADGHPDHRYGKVGGALRLRHGETRLKYGQTTTSAPVFAASSNRTLSGMAYGLLLEDRSFDGLLLEGGRFTAASGPGESKVRGDISTVYGRLGAYPVRLDAVGFLGGQWQATERLQLSLYASRFDDIWQQAYFGASHRQPLGGERALRVDLDAYRTRDSGQSRFGRIDTLASSLALGYEQGPQRITLAYQRVHGEQPFDYMAFGDGRSSASMVLANSVGYSDFNGPGERSWQLRYDLDLGALGLPGLSLHALHARGRAGASASSAAESIYAGLYGRDGRHRESDLGFAYRVKAGPLAGLALRTSQAWHRGNASYLDGDIDETRLVVDYSRSIW

SEQ ID NO: 20754 - protein, 2039 aa, Bacteroides thetaiotaomicron
MRNMYVVASELARGHSKVKAQVCASETHSPNQKSEYGQIIKATRAALACAVAAALGFFSPLAMADNQVSYADAQPHVLDASTPPISYSGTDEGAALYVSGVATVGWQPTTVTGTGLVIETSGGGADDPDGGKYVSNAISLDHYAILELTDAKITTTGIYTQGISAADGSTLRLTDSTLTIDGNFGVMTLYTGSEATLDGTIVEAANSSSAQVQQGSTLNVLDGSTITLAQGQINVVAGNTATDEGSTLNLSDSSVSSAGTMSTIQGTNKAALNLTNATITHTNASGAAVQANNATTLDITGGNITSAGTGVYILASDARIDGATINADGDGIFITSKRKLDGYEDLNALTVSDANVTSKTVALNIDGSTTINDPIELTNSTFTAPTAIKLGSKATIQAEKTMLTGNIVQTDASSSSLSLSQGSTLTGSVDAMFTTLSLDDTSQWNMTDPSTVGNLTNDGDITLGNASGSTGTLLTVDNTLTLQDGSQINATLDTANSAPIIKAANVTLDGTLNLSSTATFVAPETDEHFGSITLIDSQTAITTDFDSVTLDADTSAMPDYLTINAGVDANDNTNYELSTGLSWYAGANSARAAHGTFTVDAGSTFTVTSELDETTATSNWNGSKLTKQGDGTLILSNTGNDYGDTEIDGGILAAKDAAALGTGDVTIAESATLALSQGTLDNNVTGEGQIVKSGSDELIVTGDNNYSGGTTISGGTLTADHADSLGSGDIDNSGVLKVGEGELENILSGSGSLVKTGTGELTLSGDNTYSGGTTITGGTLTADHADSLGSGDIDNSGVLKVGEGDLENTLSGSGSLVKTGTGELTLSGGNDYSGGTTIIGGTLTADHADSLGTGAVANSGVLQVGEGELENTLSGSGSLVKTGTGELTLSGDNSYSGGTTIIGGTLTADHADSLGTGAVANSGVLQVGEGELENTLSGSGSLVKTGTGELTLSGDNSYSGGTTIIGGTLTADHADSLGTGAVANSGVLQVGEGELENTLSGSGSLVKTGTGELTLGGDNSYSGATTITDGTLIAANVNALGSGNIDNSGTLILDANGAFELANVTTHSGATTALAAGSTLDAGQFTQEDGSTLSIDLGAATDDAVITADSVALGGTLNVTGIGSVTDSWTPEAYTYTLIGSDSAITTDFDDLTVAGMNREDVDFLTIDGKVDEADNTHYDLTASLSWYADRDNATTDAHGTFTLSDPDGSFNVAATLTDVDDTLDPGSRWDGKSLTKEGAGTLILSGDNDYSGGTTINEGTLVAASTTALGTGLVDNNATLVLDADGEVSAVGGITTHSGATTQLALGTSLDLGDSALIQQDGSTLNVELNSDSVQPLITGSSATLGGDLVVSDASLQARASDAEFQSFKLMDMTSDISGDFTSLTMNLTDKPDYLTVTGTINPEDASEYLLTEGLSWNATATSATPAHGTFTLGAGDSFEVTSVLGDKTGNGDWDGKSLTKLGAGKLTLSGANTYSGDTNVQEGTLWLSGDGSIGEMGSQQAVNVASGATFGGSNGTTVNGKVTNEGTLVFGNSEETGAIFTLNGDLINMGTMTSGSSSSTPGNTLYVDGNYTGNGGSLYLNTVLGDDDSATDKLVITGDASGTTDLYINGIGDGAQTTNGIEVVDVGGVSTSDAFELKNEVNAGLYTYRLYWNESDNDWYLASKAQSDDDDSGGDDTPSDGGDDGGNVTPPDDGGDGGNVTPPDDGGDGGDVTPPDHGGDVAPQYRADIGAYMGNQWMARNLQMQTLYDREGSQYRNADGSVWARFKAGKAESEAVSGNIDMDSNYSQFQLGGDILAWGNGQQSVTVGVMASYINADTDSTGNRGADGSQFTSSGNVDGYNLGVYATWFADAQTHSGAYVDSWYQYGFYNNSVESGDAGSESYDSTANAVSLETGYRYDIALSNGNTVSLTPQAQVVWQNYSADSVKDNYGTRIDGQDGDSWTTRLGLRVDGKLYKGSRTVIQPFAEANWLHTSDDVSVSFDDATVKQDLPANRAELKVGLQADIDKQWSVRAQVAGQTGSNDFGDLNGSLNLRYNW

SEQ ID NO: 20755 - protein, 1001 aa, Bacteroides thetaiotaomicron
MKKNLLITCVMLLFAVVSMAQNKITVSGVVSDKTGMTVIGATVSVKGAPQQGVVTGLDGDYKITNVPSNAVLLYSYIGMKDQEIAVNGRTTINVVMQEDNMLIDEVVVVGYGVQRKSDLTGAVGSIKSDDLKKISTPNVANALQGRVSGVFISASGAPGSSPEVRIRGIGTTNNSNPLYVVDGMFMDDISFLSNHDIESMEVLKDASATAMYGSRGANGVIIVTTKQGAEGKAQVNITASEGFQFQNSGKFEMCTASEYAMLQNEANLNINPDGGLVYDDPASFGKGTNWFDEIFRVASVRDYQVAVSGGTEKVRYNLSAGYFQQDGIIKENSYDRFTLRANNSYKINKHLTIGHNLSASFSHTKNENKGVVKSAYKLSPIITPYDENGNFSDPQVASTANPLATLHYMNSDNWKDRIVGSAFLNWEVIKGLNFKTSLGIDYINGRSRNFTPKYYISEYQKVDENSLSKTWTRDFTWLWENILTYDWQINDKNRLNLLGGITAQKYTNEKLGGSGRNFFSEVEDYWYLDQSSSDTRGLENNGKHEAMMSYLFRANYALMDRYLLTASIRADGSSKFGPDNRWGYFPSVAAGWRISEEAFIKDNVEWLSNLKIRGSWGQIGNDKIGNDKYYALANVAPTYDAVFGGDYYSGGTVTSLYNTQIHWERSEQLDLGFDLGLFNNRFSLEFDYYRRDTKEMLVNVDVPASVGLASVETNVGSVRNSGLDFTVKWEDSFKDFRYGIRLTGTTIKNEVTNLGGKRITSGDIGSGKSVHMTEEGMPIKYFYGYKTIGIFQSNEEIEQYNAMAAAASGDAKKKYQANVAPGDLIYADTDGNGYITAEDRTDLGSPTPKFIGGLGITAAWKGFDLSIDLQGNFGNKIYNAKQAERNAGVDNWDRSFLDRWTENNRNTSIPRMTFEGNNYFVSDRYVESGNYVKLQTVELGYTFPKNLMQKVHIQNLRLYFSGNNLLYFTNYNGFTPEILGGLDRDIYPITATCRFGLNLTF

SEQ ID NO: 20756 - protein, 936 aa, Bacteroides thetaiotaomicron
MKKNGLSYIPVLRALLICTLLLLAYGASAQHHVSTCTIRGKVTDMAGKEGIGFATVLLADQAYGVACDGKGEFVIKRVTAGSYRVVVSCMGYASFETTLHIKADTTVHFRLKEHSIALKEVQVLATYKNKTDGNVSVDRTALEHIQPTSLRDIFLLLPGNVVQSNSLTGFVGTTSRQIGSDDNTSLGTNISIDGMPLSNDAMRTQLYGITGVDRSDLYVADRTVTRRTGMNAGIDLRTISTDHIETIEIERGISSVGEGNLSSGAIRIRTKQGSAPLQMRVKADPLSKLAYVGKGFKVSKRGASIHTGIDFLHNKPDVREVLDSYKRSTLHARYSDQLNYGDKIVDLGIGLMQTFSIQDSKSDQLVNEYEETYNSKYLRSSLSFDAKVRFSGSWLNSIDWLLSADYTSDLLKRKKYYISTSGPKSMPVATESGEHEGVFLPSAYYAYYEIDNQPLYFFSRFKANTDINFTERHHHHLLYGLEARSSKNIGRGVVADPTRPPYPGNNSYIRPRPNYNIPASVYAAFFVEDRASIEWGANRLGIQAGLRATHLFNLPSSYVLSRKMLIEPRIKANWQYRAEHLSINLRAGYGMENKLPTLDHLYPDKIYRDFMVLNAYMQNPELDHLITYTYIHNPENPAIRENRNVKKEIGIDMTYKRFDFSLTLFHEESRRGFEYFDSFLPIAFDRYTKLIAPLPPGHKPQKEDYIQEHHKDFFVIPTVQNSAKVVKRGIEFRLRTPYLKAINTQVEVNGAYYHTLYASGIPIMFRPIVSEYEQALYPYVGYYEGSLHKHYQRFNTNVWVNTHFPRYKLIFTSFFQIIWHDASYRGHEESEFPYAYMDLDGVVHPTSKAAILEAAATNDILKYLSRERTELYYRATYKPISLRINFKATKEFSDCMRLAFFVDNIIDINPKYKQANNTTERDWSIPYFGIETTFTL

SEQ ID NO: 20757 - protein, 368 aa, Bacteroides thetaiotaomicron
MKKIITFAAAAAMASPLAIATAAAGDLDIYGRAHISVDHLDDDTDSSQYLMSNSSRLGVRGSEYLGMGLTGLFQYETAVDLVDGGGSGLFGQGRDSYLGLTGDFGTLLGGRLSGPLKSAVDRTNVMIDQLGDAHNLLSTAVTLGVPGNNVRHNNVLAYVTPSFEGFNATFVYGPRQGTDKGDRFVIQPEFNGQVGAGNLFVALGYLRANEGVVNAAAGAQVDETHEVWQLVAEYKEAGNWRIMGVYQDYSSSDTFDLLFNGNGDDRVYGIGAGFYIAPSTELKGQVMFYDADRSNADSDMFALAVDHHLTDRTKVYGNWAMIKNDDNVARIMHNYGHGSGTNNIGDEGTTPALGDDQWGVSFGVQHNF

SEQ ID NO: 20758 - protein, 758 aa, Bacteroides thetaiotaomicron
MNQTISSRAPQKRLAPRLLCVMIGAALGTLSASSWAAAATDSTAENAKKTSATAATAKAEDSKTNDTITVVGAQETFRAGGNDLIPTYLDGQVANGGRIGFLGQQDARNVPFNVIGYTSKMIEDQQANSIADVVKNDASVQNVRGYGNPSQNYRIRGYNLDGDDISFGGLFGVLPRQIVSTSMVERVEVFKGANAFINGISPSGSGVGGMINLEPKRAGDTPLTRVTVDYGSASQVGGALDVGRRYGDDDQFGVRVNVLHREGESAIHDQKERTTAVSTGLDYRGDRARTSLDVGYQKQTIHHMRTDVAIGGATVIPEPPSSTLNYGQSWVYTDMETTFGMLRSEYDVSQNWTVYGSVGASRNEETGQYGAPMLTNNNGDATISRLYVPYVADSVAGLGGIRGHFDTGPITHKVNLGYAANYRTTKSAWNMSGQEDTNIYNPGVIGFPQTVMGSDSQDPQLTSQVRASGLSLSDTLSMMDDKVSLMLGVRRQEVTIRNFDSGVPNSAGSLDAMKVTPIYGIMVKPWEKVSLYANHIEALGPGKSAPYQYNGKPVVNAGQIPGIIHSKQNEIGVKFDNQRYGGTLALFEITRPTGMVDPATNVYGFYGEQRNRGIELNVFGEPVFGTRLLASATWLDPKLTKAADSANNGNDAVGVANYQLVFGGEYDIPVVEGLTATGTVVRSGSQYANEANTLKLKPWTRLDLGVRYTMPMKDTSLTWRANIENVTNERYWESVEDSGTYIYQGDPRALKLSVSMDF

SEQ ID NO: 20759 - protein, 600 aa, Bacteroides thetaiotaomicron
MCFSHASFSQSDTINVLGEVMLYNKQLKDSVYTTNVLVLKDSVLRLSQPSLTNLLNFNSTVYFKENGLGMVSSPSFRGTTASQTAVLWNGININSQTTGQTDFNTINTRGFNTIEVTPGGGSVATGSGAIGGSINLVNTLKYDTGFANQLFVNYGAFNTYGIDNQTQYATEKASFSLGLSRNESENDYPYPNTDRKNENGQYNNTNVSLASGFKLNKTNTINVFANIYKGRRNFSLPTPNALKTKYTDFNTRSLISWKSTFSKVVSNLKMAVTTEEYQYFANIDSDYFTFGNVQNFIAHYNLDYSVSSKVLLTAGAQYTHNDGRGSDISSATRNLGAATLSMKHKVSSTFLYEIGLRQETNEAFGNPLLYSAGLRYTFSPFYQFKLNTSKNFRIPTYNDLYWTGLGNPNLKPETSYQGEMSHVFSYKKATLLVTGYYNKVSDLLRYVPGTDGIFRPENTNNVVIYGLESVFGYEKKIANHTVTVNATYAYTVSENTEIKKQLIYVPYHKFTMALGYRFKNINAYYQYINNGEVFTTSDNSTQDILDSYMVANLGAEYNFGKANTYKIGAQILNLWNEDYESVLNRPLPGRNLNVYLNITI

SEQ ID NO: 20760 - protein, 287 aa, Bacteroides thetaiotaomicron
MPKFVDYGKIRVSYAEVGNDVSPYLTVPKHSIDPVTGNPTFPNVVPLKGSDFKSELKSEFEIGTEWRLFENRFGFELSYYNSKTKNQLFYIPAPSSGTPSNFIGVNSGTIKNSGIELIADAKIIDKDKFSWKTIVNYSHNKNTVENIPVDLGNEVVLTPAGNNGYQYSLIEGRPFGVILGRTLRKDDQGRAILAADGSLQYNNQMEEIGNANPDFMLGLANNFKIGNINVNLLIDGRFGGDVLSLTESINDFYGVSQASADARNNGGVTLQTVNASGVAGTTTFPAE

SEQ ID NO: 20761 - protein, 248 aa, Bacteroides thetaiotaomicron
MKRLLLATVAFAALSAPAMAADLATKYPVKAVAVVPVFSWTGFYIGANVGYGGDKFTFDEVESYYGYPYYANSTSLNSSGFFAGGQIGYNYQFANNVVLGVETDLQWSGIEGKEDYSSVYVYGGYPYTSSYGASVDYFGTIRARIGYAFDRFLPYITGGAAYGKTKISSSYAGDGFGSLSASATNWGWTVGGGVEYAITNNWTFKTEYLYVDLGSTDYAYADGYGYYSYAGTVDTKFHTLKAGVNYKF

SEQ ID NO: 20762 - protein, 625 aa, Bacteroides thetaiotaomicron
MRNILFSGAIAVSLLGADNIASSAVIAPIKEFAPPPLITPNIAQSAFLENQFDRADRSRYYFVTNKLDESMDKFHLSSGIYGGSFYSSALYRYRGANFYTILNAHYTKANDYKDGDGDKVGFGYKRYGQNFIVGYLPNDISEIRATFLHDRIDDDKQPQHQMDAVKTERYATKLDARIGDEALGNTLNLEFMYRQVEREANNYALRNSSSKARVEIKRKIFDFGAKYDTDISDFHNLVGFKITRDRHEGRRYTLTNAGFVHTGNRFPKIDTKIYQIYDTISYDLNEQNRLSFGLDYVWNKSETKSLDEVFVMPNMPAAMSNNLNTTRKLWRSIYGKDFDGSINHDGLSGALKYEFKPNEKDSYSLALESLYRVPSNMERFNALFGAGDNGWISNPFLKPERHNRVKADFKFASEAYKSYLNSMYGEDSFALKGYLIADDANDLVIYDRRHGAASTPTVNRNAVTSRNVDARLYLANLGAELNFARNFGAKFNAYYSYGQNKTDDRPLYQMRPFEANLQLDYRDYASFGSFNLGTALRYVAKQTRGDFDKSTGFGIDLKEAAKSFTTMDIYSGIEFKNKVGIRLGVNNIFDKKYAEFISGAHVGALAPNLVNAPGRTFWLSVHASF

SEQ ID NO: 20763 - protein, 970 aa, Bacteroides thetaiotaomicron
MNRIFTKKQLPPGLEVLGFRVLPTFMVCALLCLPAPASASLKANVAVQVPQSQQQLTGTVTDDENITVPGVSVTVKGTKISTATNSDGVFKVAAAPGAVLVFSMLGFQTQEVTVGSQKVLSVQLKSTSKQLTEVMVVGYGSKNKSTFTGSAVTLKAEDLNKSSLSLANMLQGRAAGVQVSQSNGTPGAALSIRIRGTNSINANSEPLYVIDGFPVSDQVGFSLNPDDVASITILKDAASTAIYGARGANGVILVTTKSGSGRKSSLNVHSYGGFQNVVEQFDLMNGYQNALRINEISRQEGNTPPYSAGRLDSLQQGILGTDWQKQVFRTAYVNNHNLSFEGGSAKTNVFSSFDYMDQAGVVVKSNYKRIGGRVNVNHEINDKFKMSARVFGNYGIQNDLPLAPSSINGFLKQVLKANPASTFDSGISARRDAQNPLHFLEAEDRENSTFRTQAYYTLQYEPIKNLVLQSDLGADLSRSEALYFAPSTVISAQATKGRGSVTNIDERDLIINPTANYTFNKSGHNTKLLLGYNGQKYMYKEVGTNATNFSSDELGYDNLGVASVFQAYSSKTQIKRKSWFGRIDYDYKNKYIFTGTYRIDGSSVFGANNKLGYFPSAAVAWNFNEESFVKDLGILQSGKLRVSYGITGNDRIPTGISQATFSSDNSTKYTFDGVSTVNGIAITRLSNPDLKWEETNALDLGLDFSFLGNRIIVEADYYNKVTKDLLLDRTIASSNGFQTRFGNAGEVTNKGFELFLQTRNIDAKGFKWNTTFSYASNKNEVTSLGTNNADIYVGNFKPEGNANFETPFIVRVGEQIGSIYGYVYDGIIQTGDPVLTTTHPNAEAGDPKFVDVNGDGIVNADDRVILGSAVPKFNFGFTNSFTYKGFELDIVMQAQTGGKLVNVQKLDLLNPISSGNGLAQLVTDTWSEDNPTGSIPARGFYGNTHGGWVNSRFVESSNFLRLKNVTLGYT

SEQ ID NO: 20764 - protein, 420 aa, Bacteroides thetaiotaomicron
MKKLFLLGLFLLAGATTYAGGYRVSLQGQRGLAMGHTGVAVVNNAELAFFNPAGLVFLENKINAAVGVSAVFSDVVYQNEEFGQMARTDSPVGTPFYAYFSYKLSDKFSVGLAAYTPYGSSVEWEKDWAGSHLINDISLSAIYVQALGSYKITDNLSVGGGPIYVSGSVNFNRNLTRTLSNLEGDRSNVTIDASGVSAWGWSAGAMWSPIDSLNIGVNYRSEILVEAESGEADFENIPNSPLSPFSDTQFDATLPLPAELTVGASYQLNDKWLFAFDYNRTFWGVYESLDVDFANPNIPDSVNPREYEDASIYRFGAQYTANDMFTLRAGYYFDESPVQSGYFAPETPRNDSNNFTGGLSVNITNSVAIDASFLYSRFKEIDESYDFYTEGTPPNQVAVPFEGTYKSSAFVPGLGVTIKI

SEQ ID NO: 20765 - protein, 459 aa, Bacteroides thetaiotaomicron
MNKILIRRASLAAAIACALIASPSGALASGFQLIEQNGSGLGNAYAGQAAAAEDASAIFFNPAGLTRVQGLQVVAALNLIRPSPDFSDGGSTPATLQPTLGGTGGDGGSLALVPNGYVSFETVPGVIWTGLGLSVPFGLETEWDSGWMGRFHAIKSAVQTINLNPTVAWKVAPWLSLGAGANYQWLDAELTNSVNYSAAAFAVGGATALGALAASGCGGATGGCEGVANVSGDTWSWGWNVGALVELPTKTRVGVSYRSRIKHYVKGDVSFANRPALLAAGLPDGAIQTTIELPDTLSAAVAQPVGDALELLADYTWTGWSTLKDLSIFRESGAPLTSTPLEFDDSWRVGLGASYRATEALKIRLGTAYDRTPVQDEFRTPRLPDEDRWWLAGGVQWAFTRQAALDVGAAYLIIDEASSDLPNVDASPPAGFSAPPRGHLVGSYDASVWLASAQVRFSF

SEQ ID NO: 20766 - protein, 948 aa, Bacteroides thetaiotaomicron
MFNLGFKKAFLGSTSRVAIASLVSLSGAMGASSFAQVSDDGDEAEDVIVITVERREQSLQDLAGTATAFDGDEMKLLGVQSIADLNGRYPGLQIGNNQGNIEVFIRGVGSTNNTELGEPAAATHMDGIYIPRPSGFGSAFFDIQRVEVNVGPQGTLRGRNATAGSVNVIPWGPGLGVFDLAAEASIGNYGERSFEGVINVPVSQNAAFRLAGYAMSHDSYYENASPTSSDLGVSVPTASSEGVEVAEAADNWGARASFLVEPTSRLTMTFTADYLSEGGTGYTGTNYANPLGNGLTPSEISDPRSVIGRAMSPELDTVHWGLRAHLEYETDWFNVEYIGGHRDLVYDYKAATPLSPFYPGVIDNLRNPADGNLDEAFDNFSLFQSVTDSVSQVHEIRFFDELDNGAVWNAGVFAFSEDQRTFLGTTGDRGLFFSGLEFNQRTETEAFAVYADGTYPITDTFRVTAGVRYSEEEKTRTGVNARYGFAIGGAGYSCCGGVRVGTEGFEFNVFDRTIMNPDIDGDGTVTEAETLAFYMDGIRTFGARDNVDDIFANGPLVGVDLANPTQIASYPVCVDTIAGDFFTCPSPTDGIPWDDAATGIFTFALPFLGQIAPQNGFASFDFVDWRLRGEWDLTETNLLYASVSTGHNGGGFNDNLPSVTGVTINPAGGGTAPFDTSELAPTFNEESVVVYEVGSKNEFDTPDGRGYFNASAFYYDYSDLIQNVLLSVGQILDTSDVPLDTTAAPGSALGLVVNFNFNASDAEIYGAQFEAGYDLPYNLQWKGTLLWMPVARIQNSELIADSRFQADVAPLQAIPQSIDGFRLRRTPEWSIQTSISQALSFDHGDADWIISLGYRTEQHQDLFNGEVYPEFDFANDDPLRLNDLVDGYLTVDAGAGYNPGGNENLRIEAYVQNATDEQREQAIVITQFDNTRFFSRPRTYGLRFRWRR

SEQ ID NO: 20767 - protein, 1089 aa, Bacteroides thetaiotaomicron
MNLFDNMHGLKGCIRCLTFKNVLLAHFLLAFSVAGSVSAEALPTSYLNGIEQQSRKVAGRVLQRIDNEPVIGANIVVTGTTIGTITDVEGRFSLDNLPANARTLTVSFVGMTSQTLPIKSEMMILLEDDSETLDEVMVVAYGTAKKSTFTGSASLLKSEKIEARPVTSATSALLGSTPGVQVASASGQPGSDSDIYIRGLGSISATNTPLIILNGMPYDQSISSINPSDIESMSVLKDASSAALYGARGGNGVILITTKTGSKDRMSVNVKINQGFTNRQSQDYERLGVNDYLKVYWESARNQLISGGASPEQAGMAAAQNLISGTLGFNPFNVPDDQVVDANGVLNPNATFMWADDTDWEDAIQRTGSRTDIGVSVSGGNNKSDYYLSAGYLTEGGYIIGSKFDRYTLNTNVNSQITSFLKIGGTLSGNISKAEGQQSQASGNNNNPFRFTRYIGPIYPIHVHDPRTKEYVLDANGNKVYDFGQAYTIEEGVEAPSRAYISGNNPAIELQNISNGYKRNQLNAKLYAEIRFLNDFKFTVNGAVGTSSRLGHSASIYYPEKTEVGSSTKTVSFETTWTFNQLLSYTKNFGNHHVDVLLGHESYDYEYNYLKGSMQNQTIHNGNFEFSNYSVPDEQDSYTNTYKTEGFLARANYDYNSRYFLSASVRRDGSSRFYKDSRWGTFFSVGAGWRIDEERFMEDLDFIDLLKLRVAYGEVGNDAIGSYYAWQAAYEQAMNGLEAGYIQQRVVRNKDLQWEVSRNGDVALEFELFKSRLSGSVEYFDRRSSNLLFSIPQAPDTGTTSAYKNAGTMYNRGVEVDLNGRIIQTKDWTWSVGINATWLKNRITSLPVEPYNSGVHRVEEGHSRYEFYLRQWAGVDPATGNSIYVPDPELTVESVDLVEVDGKTYTTNVNEAIYDWAGESTPKVSGGLNTNVSWKNLSLSLLFNFQLGGKMYDVGYSDLMTQPSGSASLTSNKHVDILNRWQKPGDVTNVPRIEDFADTNMNAGTSTRWLISSNMLELASATLSYDLPKQWLEKVSMQGLRVYASGENLFLLTKRKGIFPRSNIFSGYSGNADVYLPARVFTFGLNLTF

SEQ ID NO: 20768 - protein, 1050 aa, Bacteroides thetaiotaomicron
MNLFEMEKHHTKTLWLLALLLTFSTVVWAQGTPVTGRVSDEKGELLIGVSVQEKGTTNGTITDTNGQYNLKLTSNNPILIVSYIGYKSQEVKVGKQKVLDVILAEDVSSLDEVVVVAYGHQRKVSVVGAQSSMKIEDIKMPTANLSSAIAGRLPGVVAVQRSGEPGHDDSDLWIRGISTLAGQNSKPLVLVDGVERSFNNIDPEDIESFTVLKDASATAVYGVRGANGVILIKTKPGKVGKPQFSVDYYEGFVTLTKKPEMADAFTYMDAANEAYMDTRGSMLYSPQYIEATKKAHGLLPNDNPLMFNPYLYPNVDWMNELFNDWGHNRRVNVSVRGGVPNATYYVSLSYYNEKGLTRTAEMENYDANIRYDRYNYTANLNLKPTETTTIDLGFNGFLSMGNYPQQSTSDLFASAMEINPVYLPLMMPDGSVPGISTNGDLRNPYADLTRRGYKNEARNQLNSNIRLTQDLGFWKWSKGLTASAMLAFDVHNSRDLKYNKREDTYNFAGTKDENGLWNDDVFDADGNYRYALTYTGHKDLAFDQGASDSRSTYFEASLNYDRSFGLHRIGGLLLYNQKIYRSSSDNLIGSLPYKQQGLAARATYSWNDRYFFEANLGYNGSENFSPEKRFGFFPAFGLGWAISNEAWWESLQETVSYFKVRYTDGLVGTDAVTGRRFMYLDQMASVDGYRFGDQNNGVGGWGFSKYGANVGWSTSRKQDLGVDLKFFKDNLSLTLDIFKEHRKDIFITRRVIPDYSGFVEMPYANLGVVDNKGFEATLEYTQQLGKKCFLTVRGNFSWNEDKIIENDDPRVQYPWMEKRGTNVNGRWGWIAEGLFTSEEEIMDHAKQFGEGHPGQISKVGDIKYKDLNGDGVIDDYDKCLIGQGDVPKIYYGFGADLQLGDFSVGALFAGNAKADRCLGGNAMYPFNDGSGITNLFANITDRWSADNPTNQDVFYPRLHHGNNANQNNMKTSTWWQKDVSFLRLKQLTIAYQLPKKLINQTFLKSARIYVMGTNLLTFSKFKLWDPELNTNNGTAYPNVRTYSVGVNVSF

SEQ ID NO: 20769 - protein, 833 aa, Bacteroides thetaiotaomicron
MAQECNRGGRVRLFRNTSAAAIFAGAVFASSAHAQAADPSGQGGADTLTEVVVTGVRGQPRSKLDSPTPIDVLSGEEIAKGGHANLYQDMQLQVPSFNYTTKAGSGTSSAILTGGLRGLNPDHTLVLVNGLRRHHTSLINVGQGLYNGSAPVDLGMIPTSAISRIEVLREGAAAQYGSDAISGVINVLLKDTEGGSLSAQYGQNMDRSDGEQLLIRGDYGFGISDAGSLNLFFSVTRQNRSDRSFPVASTVQLYPRLANGQPDPREATVNRLISRGFGIFPAKQWQIGFNGKQQIGELEAYAFGTYGRRITDIIYPPIIPNQSVALPEIYPNFAYPVQRIRETDGALAIGLRGDLNDWNWNLSSSLGENRAPQDMLESLNASLGPTTQTDFYIGALSAREWVNSLDVTRRFDLAGGGALQVSFGAQHRLERFKISPGEPASYVLGTYVRPAGQAFAGVPLPGGAFFAPGLRPADSGSWSRNVVAGYVELGYEPTDRLFVGTAGRIENYDDSSGTSLVGKIDGRYKLNEWLSLRGSFGNGFRAPSLAQQHYSKASVTPSTAAANLGTVITNQILPVGHPAAVALGSSPLKPEKSVDASVGLTISPAPNFNVTIDGYTVKLDDRIVLGSILQGAAVANILAANGIDRNLTGQYFTNAVSTRTSGVDIIATYRKDLENFGNLKLTAAVNINKTKITHIDPNPAALSALGAAYVQVDRVARGYLTEAVPESKVALGVNWTRDKFELNLQGVRYDEFTAPGSTAALDRFFPSQWIANAQVRYSLTDQVTVAAGADNIFNEYPPANNIPLAQYGYNQYPRFGPFGFTGGFYYGRVEVKF

SEQ ID NO: 20770 - protein, 471 aa, Bacteroides thetaiotaomicron
MKNTNTKEIKNTRMKKGYSQYHTLKKGLLKTALLFSLPLSVALAEDDGFYMGVGYQIGGAQQNINNKGSTLRNNVIDDFRQVGVGMAGGNGLLALATNTTMDALLGIGNQIVNTNTTVGNNNAELTQFKKILPQIEQRFETNKNAYSVQALQVYLSNVLYNLVNNSNNGSNNGVVPEYVGIIKVLYGSQNEFSLLATESVALLNALTRVNLDSNSVFLKGLLAQMQLFNDTSSAKLGQIAENLKNGGAGAMLQKDVKTISDRIATYQENLKQLGGMLKNYDEPYLPQFGPGTSSQHGVINGFGIQVGYKQFFGSKKNIGLRYYAFFDYGFTQLGSLNSAVKANIFTYGAGTDFLWNIFRRVFSDQSLNVGVFGGIQIAGNTWDSSLRGQIENSFKEYPTPTNFQFLFNLGLRAHFASTMHRRFLSASQSIQHGMEFGVKIPAINQRYLKANGADVDYRRLYAFYINYTIGF

SEQ ID NO: 20771 - protein, 460 aa, Bacteroides thetaiotaomicron
MQNWNHTFGKKQLICCAVLGAVFSLNAYAQNFSLDKGATQLVQTKEKIDTIFVSSPNIADYEILDDNTFIIYAKEEGRTEVTAFGADGRPLTSDTVNVDSVVTSIADTNKQLKSRFPNTNLSVKKVGKAYVIEGEARSQEESDEVRRIVGEALGSGRKVTETKLGEDSLPFLDKYHYDDVVDNANIADTTQINVKLSVVEVNKKLSEAMGINWSHVAGSGPLVGGNFGFGGGFNGNQGVLRLDAKGISAFINALDNQSNGKVLAEPNISMLSGETADILVGGEIPFAQRDRDGSPTIIYKEFGIKLAVAAKLQKNNRIRLALDQTVSTIAGNYNFDGIGNIPFFNTRKAKSLFEVANGESFIIGGLFSSNDLEGINKVPLLGDIPILGSFFRSATTERDKKELVIVATVNVVKPVNEKDVVYPDFEKTGTMERFFHTTPLKNVYYKTLTSNFLKNSGFIQ

SEQ ID NO: 20772 - protein, 698 aa, Bacteroides thetaiotaomicron
MKKGLLLIFIIANFSVFSEQIVNLPESNIKSDYIEINKMKNTKNVIVLEKKDIQEKGYKDLSSVLDDIPSINVGKTGWGDIDIRGQGEGSSAKNLQILVDGAPITTLVNHPLQTNYNIVPIENIERIEVIPGGGSIIYGSGTAGGVINITTNLKRLSKPVNSAEISIGTKGEKYSLAFGHKLTDKITLQLSYLRDNKDLYFKDTYRNSDYFTAGLNYKISDNQNLSLRYSKLFEKGQFVRTINYQNFMKEKKNYVPEDRKVTVGLDKAGHKIEEIISGYANADRKFESINLSYNLNPTKDTKYLVDVFYNKGNFSNTNLGNQVMYHHTYGFKNKFDIEYAKNTSFEGSSLLLGFDLYKQDAKLEYDDYKTLNYRKKTYVVNPLSFKYNKKTMAFYLLNTLRYGNFESSQGIRRDYTYWGFDKKAAKNKGNEVSHRHNTNYELSLGYNYSDTGKIYARYERGFTSPDGLEITDDFSKYDIKTTRGEDEIYDLYEIGWREYLGFSTVNLTAFYSKTDNEMSRNYILDPDLGFGRKTINILKTKRKGVELSLSQKLGKLELKESYAYLKGKREYNGREKEFVNPGSYIDWSNSGLQKVPKHSLTLEATYQFTPRFSSSIRYSYSGKYSNFSDIKAKEEEGFISSYSITDLSLNYHHENGITIYGGINNLFDKLYFEYVGSRMYTVMPADGRTFYMGIKYKF

SEQ ID NO: 20773 - protein, 606 aa, Bacteroides thetaiotaomicron
MKRSILLSTAALSAAFAAPAFAFDEATQLDDVVITATRISAIVADTPGARVIDAKTIEQRGAVFAADILSDVPGLSVTRTGAFGGLAQVRMRGATPGKTLVLVDGAPVNDAAEPNGAYDFSGFELGDIDRIEVLSGPQSSLWGSDAIGGVISFTTKEIDGLRAEAEAGSYDTVRGRLAAGVANETYAVSAYVSHFDTDGISAADEANGNPEADGFTTTTAGVKGRYAVSDNVKFDGSARWSKSDADMDNGFPVSDNDDTSESEQWSGFARASVEGFGLDHQFSVSTSDIERQTFSAFPSTFKADRQAYRWQANGEAGAATYAFGAEREESEGSISTGDKVSLGTSSVFGTARYEVSDALSITSGLRFDDTDDFGSKTTGRISAAYELTGGFILSGAYGTGFKAPSVSQAVCDFCFSSTPYPTLKPETADSIEVALGWASADGRFDGRATLYRLNVEDQIIYFFNEDTFDIYYDNVDRTRSDGVELEGRALLGAGFDLTLAYAWTDAEDRSTGARLLRVPEHAGSATLGWTGDRISGALTVRAEGDQDDSGGVRDSFVTANLNTAYQLTDQVALTARIENLADERYQQVLGYGEPGRSAYVGVRLRY

SEQ ID NO: 20774 - protein, 837 aa, Bacteroides thetaiotaomicron
MMSRLACAETETDNLGQRMLVAKADNTAPQRVAQTANFNNSFLVGQARSVDLGMFSRGNPVIAGLYRADLYVNGQWKGRRDMEFRNTKDDKEAVTCMTLAMLDELGIDTSALTDSAADMQACKTIDQWLPDAYARFDVATQRLDVSIPQAAMRRSARGYVSPSLWDHGVNAGFIGYAFNWYGGRNANAINSRRRSDSAYLGINSGLNLGDWQFRHNSSYSWHSNEGSLWQNISTYAQRAFPNTSSMLTVGDAYTSGELFDSIGFRGISLATDDRMLPDSLRGYAPIVRGIAQSNARVEIHQNGQLIYSTTVAPGAFVIDDLYPTGYGGDLQVTVYETDGRQQQFSVPYGSVPQMLRAGSQRYSLTAGKIRNNNLSHTPYLLEGTYQRGISNALTAYAGSTISQRYIAAIAGAGLSTPVGAFSLDGTVARTKLRNDTFSGTSLRLSYSKLLSPTNTNITLAAYRYSTSGFYGLQEAIMAMDYERRGLSTASIYRQRSQLQLTVSQQLGQYGSLYLTGSARQYWNQRGNTIQYQGGYNVSYKGVSYGLSALRSQIPSMPSDTQMLFTVSVPLGKAYPVIVTSQIGSRDGRYDNSRVSLVGASGKDSALTYGIAASDARNSATMIDGNVQYRSRYAALSGSYSHNRNYNQMSLGASGSIVLHSGVATLAPQRGDTMVIIEAPAAKGARVSNISGVRIDSRGYAVVPYVSPYRMNTITLDPEGTDPDVELETSSQLIAPYAGAISKVTFGTRKGRALIVNARTPTGKALPFGAQVIDAEGQSVGLVAQGSLIYIRAKDPQGRLTIKWGDQAAQQCHLEYQLPANEASTRPSSFTTLEAICR

SEQ ID NO: 20775 - protein, 490 aa, Bacteroides thetaiotaomicron
MRFLSVRRIDRSFRRGLTACALSTLLPHCIPAAHAQVLDNDIGSAPSIRVSTPLPAAASLTTSVPPFSQPEALFPNPFGLTRYLRDRGINFLFDNTNEFAGALTQPTPGFRNYRQGASNAGQYANELDINWEKLAGLAGFATHVITVGRYGTTANRMFGDWLDHASEDYGGGGNVAVHLVLAYGEETLFGGRLAIAAGRIPLASDFAASPLFCNFMNGSMCGRPKGITDSNYMPGYPASTWGFRVRGRPTRATYIQTGVYPMENGVYAVAQHRTGFKFNGSNILGYTIPVETGWEPVFGHGTLPGHYKVGAAALDEPMPDNLFDNDGRPYALSGRAPRMHSAGWESWAMFDQRLYHPKGGGKDAGITMLTGITYNDPHTSLRNYVGYVAFLDRGFWPSRPFDTIGAAFTYTKIDRGVSLTDGYLMNVGKSLPNHATGIQGHAEVLEVNYAIHVCRGVVFQPVFEYYFNPNAQSNLRNATLLGFKSHIEIL

SEQ ID NO: 20776 - protein, 680 aa, Bacteroides thetaiotaomicron
MMEPAQQPAMVLTPARVSQPQSEAPASVTVIDRTLIEASGARELYEVLKLVPGMAAVKVDGNVPSVAYHPTQARDQRRMLVLLDGRSQYQPGLSRVSWNAMPVDIRDVERIEVTRGPAAAAYGANAFSAVINIITRDPRDISKSSVTLQGGNNGIRDAHLVGVHQLENGALRASVSSRGDNGYDEPFEGETLPDGKRIDTLNTEWVWDADARNTLTMQAGGSRSRLERQQEAGVADIGEYQGDPVQKGERAFVSLQWQHSFSRTHQLQVHTYGQYNQEITDFDVCYLDPVTGQTGPGGGLFFSQELRDLYLQNGSDMGATFAAFPSDADATNRYLTLQGAGAPFCAGSELDIQEVRYDLEIQDTLQLTRWARLVSGAEIRHDRVQSDSYLGGTQDNISYRFFGNLALDVLDPVTVNLGGYWERDQISGDHFSPRVGVNWRVLPGHHLRYVYSEALRTPDIYEERANINIQAQTLSPPFASNTQALLGWAPAYFFVTQQSPGTFEPERIRSWEAGYYGQFSAVELDVRYFQETLTDLLSTALNPFEFEPSNEGWVNHQGTEAQLSWRPSVSHLFRVTGSHIHTRTNVKTERRLAARDAGSALWSWQFSPHWAFSSAYYLSNDYNDNVFERADVQFRFRHRAGPTELEWRAVVQHRLNGAPVVFAENDYQQDRMWLGVTVRI

SEQ ID NO: 20777 - protein, 206 aa, Bacteroides thetaiotaomicron
MEIYENENDQVEAVKRFFAENGKALAVGVILGVGALIGWRYWNSHQVDSARSASLAYQNAVTAVSEGKPDSIPAAEKFAAENKNTYGALASLELAQQFVDKNELEKAAAQLQQGLADTSDENLKAVINLRLARVQVQLKQADAALKTLDTIKGEGWAAIVADLRGEALLSKGDKQGARSAWEAGVKSDVTPALSEMMQMKINNLSI

SEQ ID NO: 20778 - protein, 850 aa, Bacteroides thetaiotaomicron
MKHRLLLLLLFVFTASVAGWAQKSVAPSYTIKGVLLDSLTQEGEPYATIRITKKNAPEKALKMAVTGANGKFQEKLNVPAGDYVISISSIGKAPVVKEFTLKSSTKVVDLGTMLSAEANNELKGVEVVAQKPLVKVDVDKIEYNIEDDPDSKSNSILEMLRKVPLVTVDGEDNIQVNGSSSFKVHVNGKPNNMMSNNPKEVLKSMPANSIKYIEVITSPGAKYDAEGVGGILNIVTVGSGFEGYTATFRGSANNNGAGTGAYAMVKQGKLTLSANYNFNYNNSPRGYSDSYRENFESDTEKYLESGSSSKSKGNFQYGNLEASYEIDTLRLLTVAFGMYGSSNKSNSDGSTVMYGANYEDVAYSYRTDNHGKSSWFSINGNVDYQRTSKKNKQRMITLSYKVNTQPQTSDSYSTYLDILPDERKDELIENLKLYNYHSDGKTNTMEQTFQVDYTTPIGKLHTIETGVKYIFRRNSSDNKFYEAAGGSNDYAYNEDRSSDYRHLNHILSAYAGYTLRYKDFTFKPGLRYEQTIQRVKYIVGPGENFHTNFSDLVPSVSLGMKIGKTQNIRAGYNMRIWRPGIWNLNPYFDDQNPMFISQGNPDLKSEKSHAFDVAYSSFSAKFNVNVSLRHSFNNNGIERISRLITAEDGEDFGGGHIAPHGALYSTYDNIGKNRNTGLSLYLNWNASPKTRIYVNGRGSYTDMKSEAQGLHNYGWNGSFYGGIQHTLPLKLRLSLNGGGSTPYISLQGKGSGYQYYGLSLNRSFLKEDRLSVNLYCNNIFEKYRSYNNHTEGANFVSKSSSKWPSRSFGVSVSYRIGELKASVKKAARSISNDDVKGGGGGGNAGGGGGQ

SEQ ID NO: 20779 - protein, 429 aa, Bacteroides thetaiotaomicron
MKQRIVPGLLALAAIAVTAAPTLAENRSGAGYISPFVGGYTFDGAQHLKTRPTFGLRGGYNLDKNWAAELLFGYVPTKQSRGQGNDADAYRYGLDVLYNFMPDSALVPFLAVGGGASTIDHSEGVSDEHEQYVNYGGGLKYFLTDNFALRGDVRHIYMLGPENHNFEYTVGLNYLFGGERPAPAKVAAPPEPPKAVEPPPPAPAPKKEIAPPPPPPAPAPKDTDGDGVIDDLDKCPDTPAGVKVDSVGCPLDTDKDGVYDYLDKCPGTPAGVKVDSVGCPLDTDGDGVYDYLDKCPDTPKDLAVDAKGCPERICITLGVQFDTDKAVVKPQYNDEIKKAADFLKEYPDATAVIEGHTDSVGSDAYNQKLSERRAKAVMKYLVDKFGISAKRLSAKGFGESKPIADNATEEGRYKNRRVVAVIDCGMKKR

SEQ ID NO: 20780 - protein, 778 aa, Bacteroides thetaiotaomicron
MSRISRWPARASRFTLQPLAAGVLLAASNGSFAEEPVSTAPAVAQDAKLGTVTVNARRREETAQSVPTPISVLNSETLETQRIYRVQDLQQLVPSTNVSYVHARQSSISIRGLGNNPASDGLEGSVGIYLDNVYLGRPGMAVFDLLDVEQLEVLRGPQGTLFGKNTTAGVLNITSRKPTFHREGSIQQSIGEDGYLQTQGSFSGPISDTLAGRISAYRTEDDGYVKNIHNGDHLNGGKRQGFRTQLLFQPSETFNLRWIGEYNEEDSNNGILSLYSSGPTINGVNRYESLAALAGATLVSGKDRKVNFDSDQQVTVFQGGTSVEANWTLPNDFTLTSITAYRWWDFTPRNDDGLNVPAAYNAGVAVRDKQYSQEIRLASPTGGFFDYVLGAYYFKQDLDNKSFTYYGPQADVWSATPAGALNDVTTLGDGHIDTDSYALFAQGTWHVTDRLDFTAGVRGTYEEKSASVTRDAPVGGALVTGAAAAARQGRVGAYDSGDLNQYSFSPSGLLGLSYRFNEQLLGYATLTHGEKSGGINLTVGAAPRLGTDSLLVGTERVNNAEVGLKSTLFDDRLQLNANLFWAEVHGYQANVYDHINRVQYLANAGRVRSRGLEFEATALPIRGLTVNFNGSWNDVRYTEYDDAPCPPEVSLVNATATCDLSGHQVVGASKYIANLNGQYKWQLTEHIEPYVTASYAFRSKAVGTIDDSDFGQIPSYALVNLSTGVRLDQGDGVLDLSLWVKNAGDKTYFTSLWNSANGGYAGVLGTPRTFGATARYDF

SEQ ID NO: 20781 - protein, 1006 aa, Bacteroides thetaiotaomicron
MKKYKNLMWACLACLAIPAGAQDADNNIRGMVVDKWGHPVYGASVMVKGMPETRVETDKDGKFSIEASAGQQLNIVSVDKGMTTVKAEGKSLIKVVLNYEGQSIDVGAGRTFTRAESTAAVSTIYNEDFDKRSAKNVSNSLIGQGMGMMVLQNSGNYADVEPTFYVRGLQSLSSSSPLILVDGLERDMSLLSPEEVESVSVLKDAAAVALYGYKGINGAILITTKRGKYNSKEIRFTYDHVNNYMDRKPEFVDAATYAQAYNEARGYEGLSPRYADKEVEYFRNGDFPYLYPNVNWLDETFKDSGISNKYTIEFRGGGSKFRYYSMLDLVTDRGFVKEGDMNEGYSTQNKYSRANLRTNMDIDVSNTTKLKVNILGTLSESLRPGASANLWDMIYTVPAAAFPIKDEDGLWGGNNTTWLGTQNPVAQSQGAAYSKGHTRSLFADLTLEQDLSAVTEGLGFNFRLAYDNYSSIWEDHSQAYTYGGYSVSYTDLTGPLYTHTTGGEPTEMGKDGSINNWTRQFNFSGGFSYNRNFADKHDVYSQLKWEYEYRDSYGLNTTIYRQNVSWFTHYGYDKRYFLDLALVGSGSSLLAPGHKWAFSPTVSAAWVLSEEDFMNNAAWIDFLKLRASFGIINADYLPASDVYDYWDQIYTTTGTRYMFNSAYDSSFGTTELSRLASTNYTHERGYKYNVGVDATLFKGLNLSVDAYYQRRNNIWVSSEGKYTAVLGQTPPYENAGVVDSWGGEFSLDYTKRIGDVVLNAGGSFNWNRNEIKEQLEEPRMYDNLVQTGHSLNQIYGLEAVGFFKDADDIANSLPQSFGTVYPGDIKYRDVNGDKIIDSNDVTAIGYSTVAPEIYYTFHLGAEWKGLGFDAQFQGTGRYSAILNTKSMFWPLLSTTTLSTHYYENRWTPDNQDAKYPRLSTQSNTNNYQTNTVWLADRSFLKLRNIEVYYNFPKSWLQKTKFIGDARLYVRGVDLLCFDKIDVLDPESYGATNPLNKSLIVGLKVGF

SEQ ID NO: 20782 - protein, 84 aa, Bacteroides thetaiotaomicron
MNERNNYAGGETAEAWTVGAKYGAYNVYLAAMYSETRNMTYYGNGDGEDSGGLANKTQNVEVVAQYQFDFGLRPSPVCVLRVKI

SEQ ID NO: 20783 - protein, 666 aa, Bacteroides thetaiotaomicron
MKKLFTSLLLFSALEANEKNGFFLEAGFETGLLEGTQTQEKRHTTTKNTYATYNYLPTDSVLKRAANLFTDAKSISQLNFSSLSPVKVLYIGGKLTIENFLPYNLSNVKLSFKDAQGNVIDLGVIETIPKHSKIVLPGEAFDSLKEAFDKIGPYTFFLPKFEATSTSISDTNTQRVFETLNNIKTNLIVKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNNLKTINLEDLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 20784 - protein, 754 aa, Bacteroides thetaiotaomicron
MMKNFKLSSLTVAIALICQANSSFAADKIQQEVSKDRVEKIVVTGTFSGKSVAKEDASYAISSFSEDDIKKLAPKSTAELFQAVPGIWAESSGGVSGANVFVRGFPGGGDAPFLTVQLQGAPIFPPPTLSFLENSTLFRLDETVSFMEALRGGPNPVVSNGQPGLTTNFLLKEGSEETEGLVKYSTSDYNLQRVDGVVSGQLAEDLYFMAGGYIKSSPGVRDAGFNAEEGKQFTVNITKKFDNGKFNVFTRQTDDHGVWYLPAPINVSTVDNQYNQIGTNNRQATVKFGPNGEAINVDFGQGRGWNGSVSGGSLDLTLDNGWGIVDRFIYTKGDADTYGLVPDGDPVMLSTIADSGSTASGAVTGTEYAGSTVVQQIGRWVVKKQIEAFTNDLAITKTFDNSTITAGYYHSTFSANDWWSIGNQAYHVVESGGEMLTGIDCNDNQDSCGWNYDINSVGDGSTQAFYVAASHEITDSLSMDAGIRNENHQIEYTVDEGLDGVISKAVSYDESAIAWTLGANWMFADSQGIFARISDGSKMPFFDDFRDNFDAYQSGEDLIKDVTQYELGYKLVADDYELYATTFFNEVKGDTFVAVPGAPAEVLTNQAYGLEVDFNYFTDSGFTLNLNSTIQQTEITESPTNKGNEAQRQPGWQVRMTPSYDIDFSNGMYATLYGTVSAVGDRFANNENTVTLAGYTKVDLGVIVNLTEEVQMQLAVSNLTDENALTEGDPRDSLSSNGRYILPRTIDFNVSYQF

SEQ ID NO: 20785 - protein, 831 aa, Bacteroides thetaiotaomicron
MRNVHLLGVSALALAIASPALAQSQSTPDNSVAEIVVTATKREQTLQDVPISVAVTGQQTIERAQVRDLIDLQSVVPSLKVSQFNATGQTNFVIRGFGNGNGNDGIESSVGVFIDGVYRSRSAAALDDLPEVERIEVLRGPQSTLFGKNVSAGAISIVTKKPQYDFGGKIEGTYGNFNAQQLRGTITGPLSDTVAVRVSGSYNKRDGLFTNLTTGSDVNNRNRWSVRGDLLIEPTDKLSMRFIADYNEISERCCGVSSILNGPATLAIGGVLRKPISDTTKVFERNVIFNTDPQNDLSGRGFSGQIDYDLSFAKLTAITAYRKQKNASFQDIDFTGADISNNRTANEIKTFTQEIRLASSSEGPFNWLVGGFFQDERLDTGRTVSYGTDIRAYTDVLSGPVPATLLGALPAPLRPALTGRSNLYAIEFLQSLVTPSIRPGATYFQAGQGIDDYYKMDQRSVSLFSQFDYEVTENLTLTGGLAYLKDSKKAKSFVTLRDPFSSLDLGAVPQFTALGLPGNIYSALGALQFFYGNTTNHAPVNYPNATESGQLKGDKITYAIRAAYDFGAVNAYVSYSTGWKAGAYNLSSDSRPPNANGVGRSANPEDVDVMEAGVKANFPGGYANLAVFKQSIKGFQSNAFTGLGYSLVNAGEESVRGFEIDSAWRPTGWLNLTAAVTYLDPKYDSFTGAACVNYDTVRCPVNPTTGRRPNFRDLTGDAPAGIPKWTFSTSATVNHSFGDYEAYARVEYDYTSKTQLTETTPPNLSTWGQNLVNASVGVTNTAKELEVMLWARNLTNDDGLISTFPTVAQDGSYSGYPNAPRTYGVTVRKSF

SEQ ID NO: 20786 - protein, 971 aa, Bacteroides thetaiotaomicron
MLSGMAMAAPSALAQEEDDDANTETITVTGTRIQAPNVVATSPVNSIGQQELEFQLTPELERVFRDLPVTIPGDGANVNNGTAGAATVNLRGLGSGRSLILIDGKRMVPYNYNGLVDIQTLPASMVERIDIVTGGASAVYGSDAMAGAINFILRDDFEGLEVSGSTSITEDADGEVYSLDTLLGTQFDNGAGHVMLGANYTRREGVLLGDRDFGIVGVSSTNGSGLDGSIVPPPAECESPNVVGVSGSGSTTSMPAVLDLVGGSLQFRADGSLGSRCTRFNFNPYNYYQTPQERYSFTTVGNYEINNNFDFYTRATFSATNVRQQVAPSGVFGNVFEIPLMNPFLTDSARQSIIANINGELAADPTLTLVDAGVIDRNSDGVLDMGDSISVPVRRRTLELGTRSEDFDSNIFQIVVGMRGDLFFGDWTYDTSFQYAESDRTTVRGGYTNVANVATALNTISDTECETPDGSVTAGCVPINIFGPFGSITPEAAAYASATALQQQLYDQTIASASMSGSVPLTSPFAENSVLLAFGAEYREENGEFIPDECLKLPPVSCQGGAGGNQLPIAGGFSVYEGFGEAIIPLVEGRQFMESLQAELGFRYSEYDPGDGNETWKAGLSWAVNDQLRFRIMQQQAVRAPNVGELASPVTTGLDNALSDPCSSTNAGNIDAELRARCIATGMRDSQVGNVNDIVSGQINVFTGTDPNILPDPETSTSFTLGAVWQPELGGVFSNTSISLDYYDIKIEDYIGTLSGQEALDACYVVGDDAACEGVKRIGGGLSTAGAGVEAFITNLEWRKAEGLELSASTDIDLPDGFGSLNIGLNANYYLANERLSAEFSPVTDCNGFYGSSCDPVPELRFVQRTTWTAGNFDVSLLWRYLGSLDAQPNEASALFEEFRSIDAYSYFDLTARWYMTENVNLSFGVDNLLDEQPPIIGSDTGTTSFNSGNTFPSLYDILGRTYTVAVKANF

SEQ ID NO: 20787 - protein, 1001 aa, Bacteroides thetaiotaomicron
MKKNRRKILSGSRKILFAILAMFLSLSASAQQITASGQVLDAQNEPLIGVSVQEKGTTNGAITDLDGNFSLNVQQNAILVFSYVGYKSQEMKATRQMKVTLQEDNEVLDEVVVIGYGSVKRKDVTTAISSVSTKDLDMRPIVSAGQAIQGKAAGVSVIQPNGTPGGEMSIRVRGTTSMNGSNDPLYVVDGVPVDNIKFLSPNDIESMQILKDASSASIYGSRAANGVILITTKAGATGNAKVSLTAQFGLNKVADKVESLNASQYKELQDEIGLVSLPDGLPDRTDWFDETYQTGKTQNYQIAVSNGNEKMKYYLSAGYLNEQGVLDISYYKRYNFRVNLENQVRKWLTVSANISYSDYTSNGGGAMGTGANRGGVILAVINTPTYAPVWDALNPNQYYNNFYGVGNITNPLENMARAKNNKDKENRLLASGNVLLTILPELKFKSTLTLDRRNAVNTTFLDPISTTWGRNQYGEASDNRNMNTVLTFDNVLTYNKNFKKHGLEVMVGSSWTDSDYSNSWINGSHYRDDQIQTLNAANKISWDNTGTGASQWGIMSFFGRVAYNFDSKYLLTANIRADGSSKLHPDHRWGVFPSFSAAWRISSEKFMEDLTWIDDLKLRGGWGQTGNQSGIGDYAYLQRYNIGRIEWFKKGEEGDKTDYANAVPTISQANLRTSDLTWETTTQTNIGLDLTVLNGRLTFNADYYYKKTKNMLMNVSLPAGAAAATSIARNEGEMVNKGFEFSISSKNFRGGAFTWDTDFNISFNRNKLTKLELQKVYYDAKTADVVNDYVVRNEPGRALGGFYGYISDGVDPETGELMYRDLNHDGKISSSDRTYIGDPNPDFTYGMTNTFSWKGFNLSIFIQGSYGNDVYNASRIETEGMYDGKNQSTRVLGRWRIPGQITDVPKANFKLLNSTYFVEDGSYLRLKDVSLSYNVKGKLLKKWGITRLQPYFTATNLLTWTSYSGMDPEVNQWGNSGTVQGIDWGTYPHCRSYVFGINVEF

SEQ ID NO: 20788 - protein, 447 aa, Bacteroides thetaiotaomicron
MKKYILMPVLAALSLSGSVAQAQDFDNKPVVNVSNSKENLNFTIGARFMMDGAYYHSDFTPVKSGAAITDARIRTSMSYEDWYFYADFDFSKGKFSQKNIFLQYSLEGVKGTHRFKAGYYNNPASMANNTSRGSLHFISRSAAANAFSPSRELGLSYIFYNNHFFANQGVFAENKYNDQPSGYQGMSFGGRWVWRPINNEDRTFHVGAAFRYANIATGVVENNVLKTELDLGSSLETYVDATQDFLSAKLPWAKNVFDVGAEFLYKTDNFFTRGEYMYKHVTKERDDQALFEANLGSIDSWGSLEAWQKGNPLGENSFHGAYIEAGYKIFGDPYQYSNSDALLKGLNGRALEVVARYSYTGLNDLVEGEKYIPGRDQYYPNGILADYPATSLSVGGGNMHSATLGVNYSFNKFAQVMLSYTYNRLDRDKFQYDKNFHVLQARLMFQF

SEQ ID NO: 20789 - protein, 695 aa, Bacteroides thetaiotaomicron
MQKKPLVIAIAIALTTTALSFTLAAEEGVTAQQKEKKPELVETEFDEVLVSATRLSEKVSQTSRSVAVVSEEQLNVAQASSVAEALKNEANITLTNGPRATSQGVEIRGLSGDRVLQTIDGARQNTSSGHRGSYFMDPELLKSIEVIRGPASSLWGSGAIGGVVAQNTKSAQDFLAPNETFGGYLKQGYDTNGDRTKTSAAVYGQQDTIDWLINGSYFDSNNINTGNDETLTNSASLGSSGLAKFGWQADEASRLELSARVNKINELVPSNPSAAVSSSVPLVRRKTDDQNVTLNYSLAPANNPYLDTKVQVYWNSTDYDEDRVTKGQFDSTEYRTIGINLNNSSQLGNTKLTYGVDGYRDTLKTVRDDRGQVGQRPGDIDGETTVWGAFTRADIQLTQTVNLDAALRYDSFKNESHNLNASADDNELSPSLGLSWQTQPWLTLSARYDQAFRAPTVEEMFSTGTHYCIPPIPGFLPQGLCNTFATNPNLKSEVARNKELKADFRFNNLAGDDELAFTVNIFRNDVDDFIVQQVSNPLMGIPGFEQTTSWNNVEDAQLTGFELSGRYRIGQTRLAMNYGQTRGEDRKTGDYIEGMPANKFNVDLSQGIMEGDMKLGTRVTYVASQSNTPEGYRVAKYDDYTLWDVYLAWEPAMGAMSGLRVDFAIENIGDEKYQQAWQTLYQSGRNMKLSARYMF

SEQ ID NO: 20790 - protein, 1971 aa, Bacteroides thetaiotaomicron
MKKRRLSLALLLAMLAWAPENALSVPVPTYYWDGSGLAADNIVSGGTGTWNIGNNNWTNFAGSANSSWTAGSIGVFAGVSGSVKVKGAQEIAGLEFTADGYVLTQGAAGALHLVGAGSGTSIIDVSGNAATIVTDITGDTGIGLEKTGTGTLTLSGENTYTGTTDIQAGKLVLNGGEAIKDTGTVNVGAAGMLQLGNHNETIGALTGSPGSQVDLKSYTLTTGNDVESFFHGVISGSGGLTKVGLGGFNLLGANTYTGATTISVGTLRAGAANVIADGSAVTVASGATYDLNSYSDTVRSIAGAGNITLGSATLTAGDNDNAEFAGVISGNGGLTKAGTGILTLSGSNIYTGLTDIRKGTLLLKSGSAIANNAAVNVGAQGLLKLGNDDETIGSLAGDAGSQVNLQSYTLKTGGNNSSTEFAGVISGTGSLTKAGTGTFTLSGNNTYSGGTALKEGTLAVAKNAALGTGDLGMADGTTLQAAATVSLANNVTLTGADKFDTVAYKMALTGVLSGNGSLTKLGTGRLTLSGNNTYSGGTALNEGTLAVGSNTALGSGALSMADGTTLQAAATVTLANNVTLTGTDRFDTDGYDMAMTGVISGSGSLRKISAGTLTLSGANTYNGETVINAGTLKAGAANVIADGSAVTVASGATYDLNNFNDTAGSIAGAGSITLGSASLGAGGDNSDTLFSGVISGSGGLTKLGTGTLTLSGSNSYTGLTDIKDGMLLLKNGSAIVDTGAVNVGSDGELKLADNETIGSLAGVSGSQVILQGNRLTTGGNNDISTEFAGEITGNSIGGLTKKGTGIFTLSGANTYKGLTDIQGGTLQLNGGSAIADNAAVNVWALAALKLGADETIGSLAGVSFSTVNLQDYTLTTGGNDDSTEFAGDITGNGGVNKRGTGTMTLSGINRYTGLTDIYNGTLLLNGGMAIADTGAVNVRVNGTLKLGADETIGSLAGVSDSAVDLQGYRLTTGGNNSDTLFAGEIAGTGGVTKTGTGTFTLSGTNLYTGLTDVQHGVLLLKDGSAIVDNAAVNVGADGVLRLGNADETIGSLAGDHGSRVNLQGYTLTTGGDNSDTDFAGKIIGTGGLIKKGIGYFMLCGTNTYSGVTDIQAGTLQLNGGSAIIDTGAVTVAAAGTLKLGADETVGSLAGVSGSHLDLQTFTLTSGDANNTGFAGAISGAGGLTKQGTGIFTLSGDNVYAGGTDLNEGTLAAGSNTALGTGALSMADGTTLLAAASVALANNVTLAAGMETVNTQAFSMTLSGDITGEGKLIKQGAGTLTLDGSNSYTGGTLVSAGLLKGNTGSLQGDIENNAGLEFDQSFDGTYAGALSGTGNLAKSGTGALSLSGGVSQADFSIENGAVTNSAAMTLSGSIDLSAGTILNNGVGGSITTVSGINGSNGVDRIENSGFITSDIELGDGNDLLDNSGTLVAANKVDLGSGDDEMTVSGHALISEVALLDGGAGTDTLVFDGWTGNPEDGKGYLGAQVENWENVQLTNNSMVHLGVGAMPRTLGLGELSIEAGSTIFAYGASPGTCTQSGNVINGGMITLIDPVKTGGDDDSLTIVGNYTGTGTLGLDVNLGTGGYDKFIIDGAASGKTTVVLQEVGDSSVLIRDSKLGLISVGKGGTDSFIPGEYHYGASIYDFNMTYDAGTESYLLSNFILRNYQETVAVLHGVMPFIERMGSESVSRFHERTNEGCGWWSRAYGSDYQLDINGRAGSSLNGETAGMQVGADLGSGCQSDGLGWNAGVFAGTGYGNADVAGFNTDKAGELKDYAYSMGLYAGVRASESFWINAVALATYHDLELNIVEGAEQFNRNVWSMTASLEAGFTLPLSDSFRLEPQTQLIYQHTGDLTVTRPDIGEASLLSHDGLIGRLGIAGIAGNSRTEATPFFEVNAVKEFSGDTEVLYVRNNETLKTTPDTLFVGGALGIRREAGEKEGLGYFIKGEAMFGVDSGSSSHTYGLSAGISKAF

SEQ ID NO: 20791 - protein, 664 aa, Bacteroides thetaiotaomicron
MGTTSLILLSLTPLPLAAQEGFLGTLVLGESKRAVQTDTAVSITTVDQEEIDDRQAGTVAELIDSVPGVSLVNGSTPQGSGINIRGFGANDIYGADSKVAVQIDGATTGAERLYRIGTQLFTDPFLYKSVDVIRGSVGSFEYGSGIVGGVVRLETKDASDLTNGELGYVLGQTLEFSTNGDGITSSSVLAWQPTEDMEFLLNYTWRDQNDQVDGDGATIGNSAFTLPSGLIKAKYSFGQNRDQSLTFSLSRTTASDRDVPFDSFTTTADSFGTVDRDTESTTAVLKYNFNPADNDLVNLDVVLSYADQQIDQSYVSGSSPLEGTPQGAGVLALANADHRYQTTKLAFKNQSLFTTGAVSHDLRTGLELIHKERLDASNAPGGKDRRVAVYAVDDMRITDAWTVTPALRYETSKITGSAAPNDGTYENNALMGGLSVRYAFGNGLALFTSAAYTEGLPMIDHLGTDAAITSSEKAETYEIGASFDRHDLFRSGDQFAIKGVYYETTLTDVSSYSVPGVRPPAPALDRVETSGLELEASYALDTGLYFDVNANVVRGTEYEPGGSSGDWRLLPADSLRVTVGKKFGKELDLSWEVVGNTSVTDDGETSAGFGVHNLRATYVPQNGILKDTQFRVGLENAFDKTYTPHLSTRTAPGRNVKFSISRMF

SEQ ID NO: 20792 - protein, 1058 aa, Bacteroides thetaiotaomicron
MGTVTDIDGKFTINDVPSSARTLKISYIGLKTQEVPIKAGTIRILMKPDAEVLEEVVVTGMQKMDKRLFTGATQQLTADNVKLDGLPDISRGLEGRAAGVSVQNVSGTFGTAPKIRVRGATSIYGSSKPLWVVDGVIMEDAIDVGPDDLSSGDAETLISSAIAGLNSDDIESFQILKDGSATSIYGARAMAGVIVVTTKKGKAGVSKINYTGEFTTRMVPSYKEFNIMNSQEQMGIYKELEQKGWLNSADLFRAKNSGVYGRMYKLIDQFNETNGQFGLMNTLEARNAYLTEAEMRNTDWFDVLFSNNISQNHSVSITSGSDKSSFYASLSAMLDPGWYKQSEVKRYTANLNTTYNILKNLSINLISSASYRKQNAPGTMNSSLDVAAGQVTRDFDINPYSYALNTSRTLDPNTDYVANYAPFNILRELDNNFIELNVVDVKFQGELKWKVLQGLEVSALGAVRYQSSSQEHNIMDDSNQAIAYRTGLDDATIRDENDWLYKNPDNPYALPISILPEGGIYQRQDRKMLGLDFRGTVSWNHLFAEKHITNLFAGMEVNDLQRSNSSFQGWGMQYSMGEIPSYVYQYFKKGIETGEKYYSMGHTRYRSVATFANATYSYDGRYTLNGTFRYEGTNRMGRSRSARWLPTWNLSAAWNVHEEKFFQSLQPTLSNLTFKASYSLTADRGPADVTNSQAIIKSYSPYRPFTDIQETGLHIVDLENSELTYEKKHELNIGVDVGFINNRINLSADWYTRNNYDLIGLIPTQGVGGTIYKYANVATMKSHGIEFTLSTSNIKTKDFSWNSDFIFSHAKNEVTDLRGRTRMMELVSGNGFAREGYPVRGLFSIPFAGLDEKGIPMFDINGNITSTDINFQEREKLDYLKYEGPTDPTITGSFGNVFAYKGFKLNVFMTYSFGNVVRLNPYFNYKYSDLSAMPREFKNRWTLSGDEAKTNIPAILSNPQYEANRTLYKAYNAYNYSTERIAKGDFIRMKEISLSYEFPKSWISAAKISNLSLKLQATNLFLIYADKKLNGQDPEFFNTGGVASPVPRQFTLTLRLGL

SEQ ID NO: 20793 - protein, 649 aa, Bacteroides thetaiotaomicron
MKKQQKVLRVSTLALAMGLAYQVQADDLERDPIFNVSEVIVVHGERASVTEAATTNWSIDAEEIKASGAQSLDQVLENVPGIYVRVGGDSTPRVDIRGLKTRHITFLINGVPASSTEDGQFDPSVIPTNQIARVDVSVGPSSVLYGPGGSAGVINIITKQGDNASAFSGRLEAAQDNTFNGDLSAAGSGDNWQGIMSVTHQETDGTPMPDDFEDTRNQIGDVRFNSDRKLTNYYAQGSYFINDSTKLMANYTQRDGEWGKSPTVDRKKAPSRIEDFNEQSMQLGAAHEINEQYVVRGFVYYNQTDMVENFYNHRMNNLNSIVKSTSKVSGTNLQFISEFDYGAVLTTSVIVEKQDWFSHTNKLRSDKGTGSGGGTGGGQGGSGDIDESLIVYTGAAEYQYQDDGKYGYSLGVAVHNYDLDVNSETDFSVQASAFYQATDSSRIHTGLARKVRYPSISDLYAANSGNVNLKAEVANQFELGLQQSLPFDTQLDISSYITDANDYIAKDDNNQEQNIGDFRFMGVDLQMTNQYFDSLGVTFAYSYIDTEDRATNERLQYRPTHNLRLQASYDFSFGLTTRLNAERIIDQVNGKGVQLDNYTLVDLSLSQNIWHDNLELYVRATNLFDELYYQSDFMPQAGRQVFIGINWQV

SEQ ID NO: 20794 - protein, 1017 aa, Bacteroides thetaiotaomicron
MKNMFSKGAHPSEFGHRQTTMLMLGLFLLVSQCLFAQSRIIKGTVYDEHKDALIGASVILKGTSQGTITDIDGNFSVEASDKNTVLIVSYIGYDAQEINVGSQTFVKVQLKPSSLALEEVVVVGYGSQKKSELTAAISSVKSSDFVRGNVRDAGQLLKGKIAGLSIVNSTGDPTENSSILLRGTNSLQGNNSPLVLIDGIPGDLRTVAPEDIAQIDVLKDGSSAAIYGTRATNGVILVTTRKANSDFSIDYNGYVGTEEFVKTERVLTGDEFRSLIQDGTISATDFGGNTDWLEAITRTPVNHGHNLSVKGGSEKTNYLLNVNYKKNQGIFKKSDNETLIVRLAVNHSMLNDKLRLNVSVNSNTQNYTTTGDGSSFNRGVYSAALVTNPTLPIYKQDVNKDVLSSMPEYDGPWAQPSALVAIANPLSTIETANGRHHRQRTRLNGNVTFQPIESLKFNALLSWDRYYETRGYRETFDNFNTTVAHSRDGFASRGTCETTDQLFEFTAQYSEVFGIHNISVLGGYGYQKNIWEDYWMRNWNFPTDQFGWDNIALGRGDSDIAGAAIPINSNKTSGNLISFFGRINYILAGKYLATISVRHEADSKFVGSDQVWGTFPAVSLAWRINEENFMKNIKWINSLKLRAGYGVTGIAPSNPYLATYRLGYTSNNDTFYYNGQWVNKLTPQSNPNPEFTWEKKKEFNVGLDFSILKDRISGSVDAYYRKTVDLLYNYPVPVPPNVYGTTLANVGTISNKGLEILLNGVVFNKKDFGWNTTLTYSTNKNKLDKLNNSKYQLANDYFYVGDAQAPMSGVPTHRVKVGEPIGQIWGWKVLDITEDGKWIYEDQNGNAVESKDVKIEDRKVIGNGLPKHYLGWNNDFRYKNFDLSVTMRGAFGFQNINFTRLHYENYRDQAMNNLKAGYEKVFGKAVLTDSKQFNSYYVEDGDYWKIDNIVLGYNFKKDFIKGIKGMRLYFSVQNALTITGYKGLDPEVGGSLLTPGTDDRNKYPTTRSYTFGVNLSF

SEQ ID NO: 20795 - protein, 327 aa, Bacteroides thetaiotaomicron
MNNEQRGVALLIVLMLLALMAALAADMTLSFHSQLQRTRQVNHHLQRQYDIELAEKLALASLTQDVKDNDRQTTLQQYWAQPQQLQLEDGNTVKWQLRDAQHCFNLNALAKISDDPLASPDFPAQVFSALLINAGIDRGNTDEIVQSIADYIDVDDSPRFHGAEDSFYQSQTPPRHSANQMLFLTGELRQIKGITENIYQRLIPYVCVLPTTELSINLNMLTENDIPLFRALFLNNITDADARVLLQKRPREGWLTTDAFLYWAQQDFSGVKPLVAQVKRHLFPYSRYFTLSTESISDEQSQGWQSHIFFNRKQQSAQIYRRTLQLY

SEQ ID NO: 20796 - protein, 447 aa, Bacteroides thetaiotaomicron
MEQRNRIRTLGSLALLAMVGSSGVQAAEAFSSESKWMTGDWGGTRTELLEKGYDFTLDYVGEVAGNLNGGYNDDKTARYSDQFALGAHLDLQKIFGWHDAEFKLAITERSGRNLSNDRISDPRAGQFSSVQEVWGRGQTWRLTQMWVKQKYFDGALDVKFGRFGEGEDFNSFPCDFQNLAFCGSQVGNWVGGIWYNWPVSQWALRVKYNITPEFFVQVGAFEQNPSNLETGNGFKLSGSGTKGAILPVEAVWSPKVNGLPGEYRLGYYYSTADAEDVYEDVNGNPQGISGAGFKSHSSKHGWWVVAQQQVTAHGGDVSRGLSLFANFTVHDKATNVVDNYQQVGLVYKGAFDARPKDDIGFGVARIHVNDDVKKRAEQLNAQSGINDYDNPGFVPLQRTEYNAELYYGFHVTNWLTVRPNLQYIKSPGGVDEVDNALVAGLKIQSSF

SEQ ID NO: 20797 - protein, 720 aa, Bacteroides thetaiotaomicron
MKKIISGSSIKVLGVILCMAPAHAVFAAEAGADSEVSSVDSGEIVVTARRRAESLQDVPVSVTAFDQAQLETAGIKSLRDMSRLMPGVQFTERGSLSTQLTIRGVGGDSRNIGIEAGVGMYLDGVYIPRTSGYNADLAEIAQVEVLRGPQGTLFGKNTIGGVINITTKEPGDTVEGSVYASYGNYNAFRTQASISGPLSDTLSAKLTVATYDRDGYIHNIFNDQDVNDENRRGARAQIVFKPSDALKVKLNADFTRDRRTVLQTQMDSPVGAAAPYYTGNRFEANSDQPNGDKRNMWGTDLTAEYSLPNDMVLASISAYRKIDVTVSSDIDQLPINLFNSNPLTDFVQMASQEFRITSPSDGPFRYVGGLYYYHQKGTALRKIYIGGSLANGALNRAKAITNSYAAYINADYDLLPQLTLNGGLRYTYEKKTGDYLQVRGPVLSYDFDDLRRTDKNVSWTGSLTYKPTRELTIYGTVSKGFKSGGFNLDTIGAANLISRDLIFGPESVINYEAGIKGQLFGRLLRYSLAAFRMDYSDKQVAQIVPTGASTVSSVQVTNAGKARIKGFEVEATLRPFEGLSLSGNASYLDAKYTRFDYSTIGSTVAVSYAGNRIEFTPDWMIGGQAEYRFPAGPGEVFLVGSATYTGDMYLQPEKLPKYRESGYTLIDARIGYEVGDLMIALWGKNLTKQDYRTYARVFGGLDQAVWGEPRTYGVEMRYRF

SEQ ID NO: 20798 - protein, 462 aa, Bacteroides thetaiotaomicron
MRRKAVLLTVVLSLSGGSAQAMGLLDAWELALRNDAQLRAAGFERDAGQEEVAIGRAGLLPSLQYTYGANYSHSKVTQRDRTLNNTTKRDYDNYVSTLTLRQPLLDYAAWARYQQGVTRKLMADQRFRDRSQDLMVRLYQSWSEALLAQEKLMLLDAQRRAYQEQLALNRRLLAAGEGTQTDLRETEARYTVTEAQRIEQEDTLDAAMTDLENMMGSPLQIQDLSPLALDTLPDNVTENRSLSQWRELTVRHNAKLAVQRENVDYSRYEIERNRAGHLPTLDLVASTRNSLSESEYNYNQKYDTQTVGLQVRVPLYSGGAVSASMRQAAAEYQQSQAELDNQTRQTFAELRRQFNLCANGAAKIRAWQMSVAAAEEAIRATRQSVAGGERINLDVLMAEQEWYNARRELTEVKYRWLQAWLNLRYTAGTLNEQDMMQLAAWFQSAPVINKTGINAATGNKTN

SEQ ID NO: 20799 - protein, 744 aa, Bacteroides thetaiotaomicron
MKRFLNIGIGLLFIFGVSANAENGPSLLVDMSLEQLLNIPIKTRHFTEQLNSAPRPLSVYTDSTLHRNLVHSSYDLSLLVPNFSMHRNFGRYQERPVIRGVASIVGESPAGILIDGISVSNMTQSIPMRGLEQIEVLRGPEAALYGRANFSGAINFVYKRPVQNNYAIVNSKFANNLYRTLDFEGNIAPTNTTGLLLTAVKQSNSNSVDNNLGDTTRGYGAEQTQMLSLAGTWQPSEHLAFYYRATKQDDNDGHIPAYLQNREFNNCYLDTSIQYYCGELPAPKAVGYNSAGAPWDLSLENTIERQHLEASVTQNKFDITFTHARSSLNNATGFDGDLYELQGVYTQLNKHSTDITSQVISNIYFDTGRLLIGASHYSLDKFNQTNNAFDFGGPISVMVGAAQSVYIDNTSLFASVDKELGNDIKLSVDVRYSKDEIAYSSLDNGETYSDANVWHSVSPRVNVSKLFNVAPLNSQWLAYISMAKGRKPGGFNDNLESLAFENDTERARILGFKTFEEETLISYDIGLKGELIANKVFFSTNIFYYDWQQLQLTQSLSYVNDSAQNVRVTTIANGGKSHNMGAELELEAALTSAFSTRLNMGVTQTELKNTATTAHLDLTGNSDVSGNHIPNAPQLDAYVGLYYQRALASNLHLSLSSTLAYESKRYVAEHNFATIGDFYRLNLMASIERDNWGVSLWGKNLNNDTTPESAARFGDAATFFQTRAFGISLAEERQVGLGVSLSFH

SEQ ID NO: 20800 - protein, 813 aa, Bacteroides thetaiotaomicron
MHFSLRSRHLRPSLLASSLLLAVSAQGQEKLDVDLPAAPLGQAINALAQQSSVQILFAGDLGAGRQAPALKGRFTPEEALRQLLRDSGLKAQARDEHTFIVVPASEAAVPATQARSEPLDMEQMEITASRTSSDLVSATRQSTVIEHAQLEELRQGSDSLATVLAKAVPGMSDSSRTITEYGQTLRGRSMLVMVDGVPLNTNRDSSRNLANIDPALIERIEVIRGSSAIYGSGATGGIISITTRPAGGENRAETRLSATSPLTRLGSDGLGGQFQQYFAGSLGALDYSFDFGTRHVGASYDAHGDRIAPEPSQGDLFDSNVYNIGGKLGLRIDENQRVQLALSHYDARQDTDYATDPRVARLPPGSVPANAIKGLELDEQNRIRNTLANLEYENLDILGSRLSAQLYYRDYFTRFTPFDARAVSTRGGNVDQIMQNSEVFGSRLTLRTPLGESGNTELVWGGDYNQERSDMPLDVFDPAAYDASGGLVFDKIGKLTYMPPLRTRSAGAFAQLQHRFDEHWSIDGGLRYEYSTAEFDDFVPLSESKAASPVTVKGGDLDYDAVLSNLGIVYSPVAGQEIYASFSQGFQLPDVGIQLRNARRGFDIGSSNLEPVKTNNYELGWRGAIGGNTLGSLALFYTTSKLGDVQSFNNGLILTRTKERIYGVEASADWLSDDEVWGAGGSATWMRGREKPDGKDWQDMTGYRVPPLKLTAYLQYKPDADWNNRLQATFFDSKDYRLDGVESFGRRQVSTYTTVDLVSQYRITPDDQLSLGIQNLFNRDYYPLYSQLLRNNNNTSHLPAPGTVLTASYTHNW

SEQ ID NO: 20801 - protein, 380 aa, Bacteroides thetaiotaomicron
MENKIILSCALALCTLNAHAQSSVTLYGVIDNGLFYSTNQGGKHAVQFLSSPTETSVWGLRGSEDLGGGNKVIFKLGSAFSMANGTAWPSGRIFGDYAWIGLSSTSAGTLKLGRMLDSVGDYLGDFAATGSWGGALYAHPYDNDNLWATYMVNNAVKYQSIELAGVTFGGMYAFSNKAGAASGSGSGFADNRLWAAGLAYEIGRLKLAAVYEQLDHPGDDAPGSLGAVDVLDANFTAARQRIFGLGAHYAFDRFEIGSNVTRTVLEMPTGEWQNPAFTGASGLSFNNYELNATFHATAAVDVKGAYTYTTASVDGKHPHWNQFGLLAEYALSKRTQVYLDAVYQRVHGDDTPFSQAQINTLSPASGNTQALVGLGIRHRF

SEQ ID NO: 20802 - protein, 346 aa, Bacteroides thetaiotaomicron
MKTKTLVSGALMLACAGAHAQSKIWLSGYVDLNIEHLISSGSGGNVTRMSSGGLNNSRFNLSGVEDLGGGNKAVFTIEPMFSANTGVQSAQFRQSFVGLKGNWGEITMGRQFTPSYWIAGYADPSWAADFSMVNNMEFFYASYRVDNAIQYKTPTFYGFTGRIMATTGVGDSTRAGRFLSTSIDYRHGPIFIGAVSELQYTRDIFRSSQIHSSRDNYFSAVYKFGGFEPTVIYHTYNGYYAFPPYVAFNSQGWDAQIGARWNIDGRNRVYLSVVHRHDDNNTSISSATGGVIGYIYGLSKRTDLYATFAHVKHQHDVPVPYPVTFQVYPNSGQNPSGFQFGIRHAF

SEQ ID NO: 20803 - protein, 954 aa, Bacteroides thetaiotaomicron
MFTLSLTAFAQQTVVQGKAVDGVTNENVPDVTVTIENSNIETQTDGLGEFSFDASRVIGEQVIVLYKQGYTTKRFPITINEGETLNLDVLSMDIDINEEQLQIGTISLSDNELDQDNENTAFNISGLLQASRDIFLNAAAYDFSATFFRPRGLDNQFGEVLINGLNMNKQFSGRPQWGNWGGLNDVQRNQEFSMGLSANEYSFGGPAGTTNIIMRASKYREGGRVSYATANRSYTGRVMGSYSSGLQSNGWAYTVLASRRFGDEGYIDGTFYDANSVFLAVEKKINDNHSLNLAAWYTPNRRGRSTAITEEVHNLKGREYNPLWGYQDGEIRNTRVRNIQEPIIMLNHYWDLSENTTLNTNVSYQFGEIANSRVENGGTTLVTTPDGQSTYLGGARNPDPSYYQNLPSYQLRFPNPSPADFQNAYLAQQEFINDGQFDFNALYEANRLSAATGGNSIYAIQEDVIDDTQIQANTILSSTLTDNITLNAGLNYRNLNSANYARISDLLGGTGYLDIDNFTEITANENTNSTDAAQSDLNNPNRIVGEGDRYKYNYEIDANVVGGFAQAQFKYNKVDFFVSTKLSQTSYQRNGLYRNGNFADTSFGESEKLDFSNYGAKAGLTYKITGRHLIDANGGYITNAPTIRSAFSNARQNNNTVTGLESEKITSADLSYIYRSPMIKARLTGFYTGFEDGTDIAFYFTEDVNNGEGAFVQEVLTNIERRNIGAELGIEAQVTPTIKLKAAASFGQYTFNNNPDVYYTSDDFNRVNTDDDPSNDNPNINSVGELRFGDGTAKLKDYHVASGPEQAYQIGFEYRDPNFWWFGVTTNYFDNAYIDVSTITRSDAFTTDIDGQPFNDYDPTEARALLQQEDFGDYILVNAVGGKSWKIDDYFVGFFITINNIFDEEYKTGGFEQSRTSNFRSLQEDVNRENGRVFGPRYFYGNGTTYYANVYVRF

SEQ ID NO: 20804 - protein, 424 aa, Bacteroides thetaiotaomicron
MSKRLLKTGLAVAITATSSHGLASGFALNEQSISGMGTSFAGRSSSADDASTVFGNPAGMARLKRDEIYVGAAVIHAKSDIRNASANAGPLQLSGSNDGDMVPSTGVPMGYYVKPLDDKVAFGLGVYVPFGLMTDYERGFQGRYHADKSYVRVITVQPTLSYRFNDKLSVGFGPTFNHIEGELSSSILNPLSPGSNDGKVKVKGDDTAVGFNVGVLYEFTPGTRAGITYHSRVKYELEGDTRVSGSGILAGVAGKYDANLDLTTPESVDMSITHELNDAWTLYLGSTWTRWSRFKEIRVENDAATLPANLATIVEEQNWHDTWAHAIGLSYKLNPQWTLRTGMAIDQSPINNVDRSPRVPSGDRTIFSVGAGWSPNQDMTIDLAYSYLQEESVDVNHASDTRGTYRARYKNRAHGLGASLSYRF

SEQ ID NO: 20805 - protein, 746 aa, Bacteroides thetaiotaomicron
MEKIKPFIVFSLLKNNIIFYFFLSFLSLETFFFPVRVFSQEHSKQFKKESSETKDLKTEELNKDEKQSEGIFVKGYTGKGLTGMKQNVRLKDIPATVNIIDYKELKARAADQWLSAISYVPGIFVIQNYGGFNTLTIRGLDSRNTLLLKDGARDDTFLIQNSSPMSNLTNVERIEILKGPNSVLYGQGAMAGVIHIITKKPQKKAGYEFSFTKGNFGSKRAYVGATGPIGTESLRYRIDAATSEYQGFRKNSYNLNNISTSFEWDISVKHTLSILSGKNFDFIKPDAGLPKSKKPNIDLIAPGVYLNNNYNTKEDYLKNESGNFKIQLDSKFSNKLSMKSFISYLPQTYYYFSAEDLTISSRDENTIERDHFHFETKRSPLQGTVELQCIFQTGFKHKLLSGYEYHWMVSRHRQRYFPIGSTNINVLYPQIDLTQSLPVNFKDRKILYQQMHSLYFQDLMELSKIIKFVLGGRYDSWVRENVTEKLSDWNDRYVSKPEDRTIHRFDAKVFTYRLGLVYQPLHYYTAYVGYSTAFIPVTFINIKGNQLKPEMGEQIELGQRLEFAKGKIQLTSALFAAKKYDVAVRINSKPALYNQAGELRTNGYEFDIDLRLTQRWSLKSGYAHTIAEWESFRFVNSKGNEIDYKGNRPINVPRNTANLWTTYTFASGLGFGLGGRYIDSIAGDNANSFSIPPYGLYDASLYYQYKHFRFQINCNNISNKKYFISSTPNPTPGPPRQFLFTASAKF

SEQ ID NO: 20806 - protein, 714 aa, Bacteroides thetaiotaomicron
MNKINMFMLSTFMRSMFMRSTLIPSTFILSTLLPPAVVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFVAWKMPLSGNQLKWQLNVKNLFDKTYYPSSANNLRIAIGEPRQVVLQGSIDF

SEQ ID NO: 20807 - protein, 413 aa, Bacteroides thetaiotaomicron
MRNAFVFLLLGSALVAGGYKIPETSLNSVALGAANVAHANGADAAYYNPANMAFMKDEAVIEGNLIYIGLSDVNFQGSYTSSLGTTSGYNIDSKRENFIIPSLHYVSQDISGVRLGVSLVSPAGLSKRWQDAPAVYSSEEFTLKTVELNPSVAFKVSENIGVALGLRAIYTDGIVKSTSPIASRDMSGDSIDFGYNLALSYKPTSELEFALTYRSKVDLTSKGSATLFYRDIANSFGGGVGATYSSSSSASVSVPVPALLNIAAAYTFLSKTTLEFVYERNYWSAYKELDFNYGSGVNPVTNIVFGTSIAKNFKDCDVFRFGVTQELNALKLMGGLVIDKSPVPNSTISFELPDSDSLSFSMGARYQINDKLNIGLAALYSVRENRRVSNASIDGEFSDANVLIVSSAIEYKF

SEQ ID NO: 20808 - protein, 175 aa, Bacteroides thetaiotaomicron
MKRTLVASVVAVGLSVFAFAANAGESTISGGYAQSHVKFNGEKIDGNPKGKGFNLKYRYELDNNFGVISSLTYTHKGFDKFDVNYYSLMAGPAYRFNDYVSAYGMIGAARGEFEVPVLNGSYTEGKSSVSYGLGLQFNPVPNWTIDTSYEYAKFNDARLGDLKVGTWVVGVGYRF

SEQ ID NO: 20809 - protein, 712 aa, Bacteroides thetaiotaomicron
MKTNPNSARLRRATLPAMCALLLHTASVLAADAAPPTTLDTVRVVDTRSGELSSTSSAGSALGLSVLQTPASLTVISREQLEQRGDTNLNDAISRAGAISAMPHPGNGLSALSSRGFTDGASVMRLYDGLRQYGGVGITFPFDTWSIERIEVLRGPASVIHGDGAIGGVISIVPKKPTRGAIENEISATVGSEDTARLGFGSGGALTPELAYRLDVSGNYSGGWVDRGRSSDATFSGALLWQPRADLQLSLTHAEGYQQPMRYFGTPLVDGRQLEALRHRNYNVEDSDIRYRDRWTQLDALWTPNASVEWRTRLYQIDSQRDWRNAEAYVYNRATGLIDRSGNTEITHDQDQTGLTSTLRVQGNIAGLANSFAVGLDANRAHFKHTNNTYAGSSGPVDPFDPVPGQFTSDAPNLPRYRNRAEQYALFVEDRLALSERWSMLGGLRHDRARIDRTDLISGQNAFSKTYRSTGWRAGTVFALRPTLSLYAQYSQAADPVSGLLMISPANGAFDLAKGRQIEVGLKQAFDGGEWTLAAYRIRKTGLLSRDPLVPDRRVQVGAQTSRGIEASLNWNFAPRWSLDANATVLKAEFEDFLETTGSPAVLVSRDGNVPPNVAERLANVWLSWQFAPDWSAAGGVRYVGKRYADNANTLELPGYSTTDLALTWQAAQRTRLSARLFNVFDKAYYATAYYTSTQWLLGADRRVEFTVDHRF

SEQ ID NO: 20810 - protein, 376 aa, Bacteroides thetaiotaomicron
MKVKVLSLLVPALQVAGAAYAAEIYNKDGNKLDLYGKIDGLHYFSSDDSVDGDQTYMRIGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEDQTNNGRGYQKQNGEGFGTSVTYDIWDGISAGFAYSSSKRTDEQNSVNTRYTDSNGVSRRVLGEGDHAETYTGGLKYDANNIYLATQYTQTYNATRTGIIGFANKAQNFEVVAQYQFDFGLRPSVAYLQSKGKDMGRYGDQDILKYVDLGATYYFNKNVSTYVDYKINLLDDNCFTKDASISTDNVVALGLVYQF

SEQ ID NO: 20811 - protein, 1106 aa, Bacteroides thetaiotaomicron
MKITLFLLFFVAFQAYSENGYSQSTKISIPRSSLKVSELLSKIESQTAYLFVYNKKNVDTRRWVNVQADNKAVSEVLDQAFKGTNIKYVMEGNNIVLTRNNDNAITAQQDRVTVKGVVTDQNGDPIIGANVLEKGTTNGCITDMEGNFTLNVPSNATLAITYIGYQPQNIQVNGRQSFNVKLQEEAMALEQVVVTAMGIKKKEASLTYSTQQVGGDELTRAKDPNMINALAGKTAGVQITKSSSGLGGSAKVSIRGSRSISGNNQPLYVIDGVPMLNSSNEQASTAIGGTADAGNRDGGDGISNLNPDDIESMSILKGASAAALYGSQAANGVILITTKKGKAGIQKITFSSNLTVDHAICLPEFQNNYAMDPEAKNSWGKNQTLKDYNNADNFFQNGVTAINSVSFMNGSEKMQTYFSYANTTAKGIVEKNKMQKHNLNFRETANFFNDYLKLDANVNLMTQTIKNRPTSGGYYMNPLVGLYGFPRGEDLSEYKNNFEVFDPARNMNVQNWYTSYQDMEQNPYWITNRINSNDKRTRAIASLTANVKITDWLNIQARGTADYTHDQYQQRMYASTAPALAGQNGRYIDLNHTETLYYGDVMAMVNKKWNDFSLNGAIGGSINSTNVNSLRLDSKTASLYYPNVFTVANIKMTQAAYIDEQMNQKRVLQSLFGTAQLGWKESLYLDVTARNDWSSTLAYTKHSSFFYPSVGLSWVLNNTVKLPEWISFGKIRGSWSKVGNDLPLFISNTIPGSNDIIGAGGAIVTYSKAPFNDLKPEMSTSYEIGTEWRFFNYRLDFDITYYRTNTKNQLFTLPSSAGADYKYYMVNAGNIQNEGVEITLGATPVMNDAFRWKTQFNFSTNKNKIIKLHPDLKTFVYGDESFSSSYSMRLVEGGSFGDIYGKAFERDENGRVAFTTDKDGDKIPNVIGGGNTEKVGNCNPDFMLGWSNTFTYKGFSLYFLIDGRFGGDVLSQTQAELDQRGVSLNSGKARDAGYINIDGTQVKPRKFYTAVSGRDGCTEYYMYDATNIRLRELSLGYSLPQSWLAKAGGAFKDVQLSFVARNLFFISKKAPFDPDAVLSTGNDNQGIDVFGMPTTRSLGFNIKFTF

SEQ ID NO: 20812 - protein, 87 aa, Bacteroides thetaiotaomicron
MKIKNSYLVIASLLYPISFISTAASLTVEQRLAALENDLQETKQELQRYKEQEKKNKAITLVRVNSAADADNKSNAFNVAKTATPIA

SEQ ID NO: 20813 - protein, 843 aa, Bacteroides thetaiotaomicron
MKNSLYGFLIFSSFTASIAFHSHVNADNLASSESFDGSTGAGQFTSKQSTDAGGTTYTLTGDVTITHVKTTSPANTSCFKNSGGNLTFTGANHSLIFEDIISTAQGAAISANTDAKTLKMSGFNTLAFVAAPQATTGNAAVYAIGTTTIKENKKLIFGKNHSTAAGGAIHCAKTGATEAVLTLQQNASMLFRNNSSATTGGAIHAEKFILKAGGTTLFENNHATQKGGAISIAGSGEISLSADDGSIIFKGNTITDAGNKVSNGIHVGTNGKFAKLEAKESQSILFYDPVVAEGTADSNLEINKADGGTSYTGSIIFSGRYIESPHKRMKHVSTFTQPLTLSSGSLVLEKGAHLKAKSLTQTAGSKVILDQTSSIETKENIDIKELWLRLDDFNTPTATCISTSGNAHTITIKGPLGVFTDQETFYDNHALAYSIDQEFLQLADKDITKISLVDIPQAVRKNLDSHSGYQGKWSIDWKTVPGSTNAGVTTLGTKTATVHWRPTGYIPFGGSQEITTPLVVNTLWGNFSDIRNLERTVESLAVNSLCSEGFWAAGIKNYLYSNSPAENYVFQHHNAGYAIGMNKHTLSENVFSAAFSQLFGKDRDHANGHVDHQTLSGSFYAHHVGSLPMLRFLCGGSKNCPPELQASPSIPVIVNAQLSYSHSNNHLTIHHEDTTKTTGMWSNYSLAAELGSTFVYTLSKCPSILKNVSPFVKLQGVYSEQRKFSEEGLRRCLFSSTYLANLALPLGIKIHGVCPRELFAYDLSAMYVHDVFRIDPETMTLFLIGGLAPWTTHANNLATKAIVVQGSGRFAVRSNIEVFAEGNCELRSSSHSYNYDFGAKIHF

SEQ ID NO: 20814 - protein, 375 aa, Bacteroides thetaiotaomicron
MIALQKNVWRCQLNTRKTFVKSLIGASAMLFAAASYAQSSVTLYGIVDGGLLYLSKTRNAAGGNGGKFFGFTDSGQMPSLFGLTGDEDLGGGLHAEFKLESGINIANGGLNDSNGNLFGRQAWVGVRGNFGTARAGLQYSPFFNSVFALDPRNMSQLGSSLVPFIDTTVVTAIFSANALTYTSPVLGGLQGSVMYAPGGVAGSFQTGRSYSANLSYNWNDLGLYAAYYNGIEGPATAPLPDRLGMVGRVIGATYKFGTLTAKASFTDFKMAGSGIDYDIWSGGFDYQARPALNLNAGVWYTVNRNDTHSKSLVGAVGATYNLSKRTGVYTQVGVVNNKGNQNFGLEIGNGGNTPSSLYAPTGTTVGVDIGIHHTF

SEQ ID NO: 20815 - protein, 297 aa, Bacteroides thetaiotaomicron
MKTLVVALGGNALLQRGEALTAENQYRNIASAVPALARLARSYRLAIVHGNGPQVGLLALQNLAWKEVEPYPLDVLVAESQGMIGYMLAQSLSAQPQMPPVTTVLTRIEVSPDDPAFLQPEKFIGPVYQPEEQEALEAAYGWQMKRDGKYLRRVVASPQPRKILDSEAIELLLKEGHVVICSGGGGVPVTDDGAGSEAVIDKDLAAALLAEQINADGLVILTDADAVYENWGTPQQRAIRHATPDELAPFAKADGSMGPNVTAVSGYVRSRGKPAWIGALSRIEETLAGEAGTCISL

SEQ ID NO: 20816 - protein, 382 aa, Bacteroides thetaiotaomicron
MKKMMAAVSAASAMGFGLTAHAQSTVTLYGLIDEGVNFTSNAGGSKAYQMVSGDTVGSNWGLKGTEDLGGGLRALFQLENGFNASTGALGVTSRMFGRQAYVGLDSDRFGTLTFGRQYDPTLDMWSPFTATGNWLGDFGAHPYDNDNADWDYRIQNSVKYVSPTYGGFKGEVLYGLANQAGGFARNRVYSAAVQYQAGAFSAAVAYLKANNGGAIAGGALSSDDTVFSGRSQQNIDAGASYKFSDKLTLSAAYSHVDVTNPESNLYFTNQPAAGSQNAWKFDNFEVNGQYFFRPDLWLGAAYTYTHAHVATAAGDASPSWHQLSMMLDYDLSKRTSTYIQGAYQHATGNTGTDFDYAHVLGTAGQSSGRNQLALRVGMMHRF

SEQ ID NO: 20817 - protein, 98 aa, Bacteroides thetaiotaomicron [sequence omitted]

SEQ ID NO: 20818 - protein, 1028 aa, Bacteroides thetaiotaomicron
MKSFSDKTNIGENNPLKTVYRMNFYLLFLLIGSLSILGSTRAYCQQSRTISGIVKNSQGETIIGANIVEKGTSNGTITNVDGLFTLRIAPNAVLKVSYMGYTEQEVNTRNKNKLEIILTEDARLIDEVVVVGYGSVKKRDLTGAVTSVKSAEVLAAPTNNVMEALQGKIPGMDITKTSGQVGGDVTILLRGSRSIYGSNEPLFIIDGIPGSYSQVSPSDIESVDVLKDASSTAIYGSAGANGVVIITTKRGKEGKATVNFDAYYGFSGSPNYRHGMTRDEWVTYQQEAYKYKNGDYPTDMSALLGKQDFIDAYNDGKWIDWIDEVSGNTATTQKYSLSVSSGTEKTKLFASTSYNREEGLLNNENLNRYSLRLNLDQQIFSWAKVGFTSNLVYRDLNSGVKNTFTKSLSAIPLGDAYTEKGEINHEYITGQYSPMSDFIENQYVDNTRSTYLNMSGYVELTPIKDLTFTSRVNGTLNHSRRGQYWGEKCNANRPSYAGSPHASITNNNAWNYTWENILAYNTTIAKDHNLGGSLITSWNKNQSESSMAAASGQMVDQWSFWRLTSGTSQHVESDFAQTQKMSFAFRLNYSYKGKYLFNFSTRWDGVSQFSTGHKWDAFPAGALAWRISDEAFMEKTRSWLDNLKLRVSYGITGNSGGTTAYSTTTQAYVYTASGISINGKIVPFTQYSGTYGSSDLGWEKSYNWNVGLDFGILNGRIDGSIEWFKTTTKGLLFKRTLPITSGLTGWGSPLAIWQNIAQTSNQGVEATITSHNIRHKDFTWNTTLSITWNKEQIDDLPDGDLIAENLFVGEPIKAIYGYKYTGIWGTDTPQETLDAYGVKPGFIKIETLDQKGDGGVHKYSTEDRQILGHSNPDWIIGFSNSFTYKNFDLSVFAMARYGQTINSDLLGYYTAEQSVTKNQLAGVDYWTEDNQGAYFPRPGTGDEQKTVYPSLRVRDGSFIKIKNITLGYTLPVNISRKVLMEKCRIYATAYNPFIFVKDKQLKDTDPETNGSDAFPTYRQFVFGVNLTF

SEQ ID NO: 20819 - protein, 678 aa, Bacteroides thetaiotaomicron
MLLKYRIIIKIYCIIIYYIKYIYLLENKYKKYSLIYKNTYQYYNIYYNKKYLTLVIYCLFLFIFLRDIHAMNRENEEFNLYHRTLGNTEQHSEEETPCTVVDIKGVSISADVYEDYIKKHSLVVIDEANKSINDYCPCCKTCCKNKQTYAVAAAQGGCCGAISIAVGYGVGKLIELCTPTVAPTEMIFTVPTPLATAMTSGHTLTTVASSIEGITQTTAITMGCCGLTCCLLGSIFGYLTNKVEEKNERIHTAQQRLEYMVLNRQFLSDEDEGYELVDFSHRQQVVTNQPQRINSPVNNNSEQGEGSSRRSSEGTVYEEIFFLPGYNRGGQISSLLSMQYILAGPSAQVSSTLKMLALKAHRIPSDAAASLQLGKKSQKLQGPNRVLKADLQFQNNPQGISICRMFAFTDKYECNLEKKIRSGRAGLVAELFPGMTAGLAYTRHNEGRKSFEGIQLGTGSGSVTSKTESEALSAVIALNSEGGGVTGHIASYHGWGKMKTSRSFIHAGSKISAKGKPNIYLNGGLIQVGYNISLSKTTILTPYIEGMMSMVNWDAYTERSGLLPCKISRSEEYVAERSVGLCHHWKPTSGFQIQSWIACISGERRTDGVSCRPLVMPIKKYESYISVQERKYVHIEFGASYSMSVTDTLQLGIDGMIHLDKVHKIKEKSMSLSLMYLH

SEQ ID NO: 20820 - protein, 932 aa, Bacteroides thetaiotaomicron
MQTQEVAIKPNLKVVLKPDTEVLDEVVVTGYGTFKKSSFTGSASNVTTEKLQDLPSISVQDRLAGSVAGVQITSTSGQPGSVASVRIRGMGSINASNEPLYVIDGVPMLNGNVSEFTYADSGNSLMATLNSNDIESMTVIKDAAAASLYGSRAANGVIVITTKKGSAGKTKIGVRADWGMSNMAIDYRPILDGKQRREILHLGFENYAKYTLGYDAEQAAALANKNIDEYAAEPWSGYTDWKDVLFRNGSHQNYEINAQGGNEKTRFYTSFAYTKQEGITNVSGYERFTGRANVTHQTDKVLLEANAMYTNSTQNVNNEGTSFASPIMCYAMTASPSTYPYNEDGSFSSNFPALNGANPIQTETYNYNRATINRFLGSMAATWTIWDNLKLKEAISYDFNQNNERIWWDPRSNDGRSSNGVYQRVMGNRGQLNTQTQLSYNKSFGLHNLDALVGFETEDYKYDYLYANGNQYPSYLPEIENAGDSRASSHVERYRMTSFLGRINYDYNNKYYFSASYRRDGSSRLSRESRWGDFWSISGSWRLSEEAFMQDIKHVLTDAKLRVSYGVNGTQPTDLYGYLGVYEFGYNYAGNGGSAEARFDNPNMKWEKNYATNVGLDVTLWNRLSITAEWYNRDTKDLLMSKNISAVPGVINSSGGATMLMNVGSMRNRGVEFEIKSTNIQNKDWYWSTSLNFGHNKNTLLKLDGEQNEMIDGIAIHRIGEAYQSFYAYEYAGVDPETGSEMFYINGEDGSRETTIHSNEANKVIIGSPDPKLTGGLTNFVSWKFIDLNFTLTYSLGGHAYDAATWLQSNGGTYNYVGNVPAYYKIEDTWKQPGDNAKLPLFAYGNKNTVSSRWMMPTDHLRLKNLTIGFTLPSNLSKKAGISKLRAYISGNNLLTWKSKDLYVDPETPVDGLCYFETPALRTITFGIELGF

SEQ ID NO: 20821 - protein, 1007 aa, Bacteroides thetaiotaomicron
MQTQEVTIKPHVRVVMQSDTELLDEVVVVAYGTATKRSFTGSATEIKGDRIANKNPSELSKALTGEVAGVQVISTSGQPGSNASIRIRGLGSVNSSRAPLYVVDGIPFGSDLSGIDPSDIESTTVLKDATATALYGSRAANGVILLTTKRGKKGKTQVEANVKYGINTRIIPLYDTMENPERFLELTWEGIKNKYMYRANNPKDEATAKQYASEDLFDADYGIAPVYNMWKAEGKNLIDPVTGRMKAGVIRKFTPEKWEDYIFRTGEKVEANVKISGGSDKLSHYTSFGYLKDEGYYIGSDFERFNARSNLSQDITSWLKSNVNMAYSYMELNKPGQGDNMNNGFQFINFMPSIFPVFQRDADGNKIKDNVVGGYLYDYGMAEGYGRPYASGVNPAGAIQLDKNEYQSHSFNGNAMFEATFLKDFKGTVNFGLQYLGTKNNELTNPYYGDAEGLGRIFKNMSTFFSFTSNQILSWKKSFGVHNLDAFVAHESTFYKSSDNYGQKSKIVRPNNTEWSNAVIMDYMDSQTYGFDMESYFGQIRYDYNDKYFFHGTLRRDGSSRFAKGQKWGTFGSIGAAWAITNENFMKDVSWLKNLKYKLSWGVLGNQDFITNPTIAGYYPYNDLYTIGNLNDEISFSFKYKGNPDLTWERSETWNTGIEFNIADILEGEVEYYNKTTKDMLFLKQVSPSLGYAQYPVNDGKMVNKGLEFSLVAHLVKTNDISLDLRVNGGHYKNKMTQMPMDDTTGKEKPLEIQGAYGWSKGHSLYDFYIREYAGVDPETGMALYNSYYNVKADGSKDLITDMVTYQQNNKIERLEVEKTSDYNNATKKYVGKSGIPTLQGGFGFDLAVKGFELNTTFSYSLGGYAYDGVYATLMSNNTPGSGNWHNDIENRWQKPGDITDVPRLTSGYDEYTNASSTRFITSRSYLNLSNVRLSYTFPKKWMNRMNIGSLSVYVSGDNLMFISARKGFVSMAGNTVSTDPNEDSGGSDRSQYAPLSTIMGGIKIQF

SEQ ID NO: 20822 - protein, 1184 aa, Bacteroides thetaiotaomicron
MKNNSQTRNKSKYLTNIGFRFLLLCILLTSHLPKISAEDGFMLLQSTDVTLNLTNVSLETLFKTLEKKSNYVFFFKEDVLQKNEKVTVKAQNESVVSILNRILPPKQLTYTVKGRQVIIVRLPQKEEKKAEVPVEIKEYTVKGTVVDASGQPLPGVNITVQGTTNGVTTDLSGGFTLRIRDGKRVLLVASYIGFSTRKVWVSGETNSLKIMLEESSASLNEVVVVGYGTQKKLNLTGAVTTASGEILENRPIANIAQGLQGMVPNLNITFNSGQPNEAAKINIRGNTSLNGGNALILVDGVEISDLSLINPQDVESVSVLKDASAAAVYGARAAFGVMLVTTKKGNRNQKTRVTYNNNLSWSSPARLPEMPRSDVWARMWNKAYEYDTPGGYYFNEKFMEKLDAHIADPEHNPAILVDTEGIQNPNYSPSNPGWAYVGNTDWLSEFYQKSAFMQQHNVSLSGGTERNNYYASIGFKDQSGIFRYGNDFYKRFNLAFNFDTKLTSWLDVSFATRMSNIKNDEPYMDNGGSSSQTWYYEVYRMFPTLSIFLPNGDFAGMYLNSGNYNVIGKMALAGRNKKETWDQWYIGRFDLHPLKGLSIKGDYSWNRYSTVQKFHRKEIKQTFPEGGPEWIVETPNYVKNYNSNNIYHAINVWAEYKTSFNDVHNISVMGGYNQEEKTYANTSYTMTDLYDNELPISDLAINYKENAEGADIWRVQGAFFRLNYDYRSKYLLEVNGRYDGSSKYAKDDRWAFFPSASIGWRISEEKFFEPLSKVVDNLKLRASVGALGNQITNGYHDYMSILSGKVLTNYMMDGKMVNALNIPSLPSVVTWEKVVTKDLGLDWSLFNNRLMGTFDFYVRDTKDMVRSVTLPAVLGTSGGKENIADMRTTGWELELTWKDRIKNVLGSPMDYSLTVGLSDYQAEITKYDNPNGSLASGMYYEGQKLGEIWGYVTDGYIMDDFEAAKMNYVQKYISSKWYPGDIRYKDLNGDGMIDQGNRTLANPGDQKVIGNSTPRYRFNLQGGIGWRGFDIRAIFEGVGKRDMWTSSDIFWGFSRGIYNSCVTQYHIDNIWTYENPTAYYPRLNANGNKRSKQIQTKYLQNAAYIRLKDITLSYTLPKSWLTKMKMEQVRIYVSGMNLWEKTGLPPFMTPDIVDQITDNSLSSENSGKEYAFMRSYSFGINITF

SEQ ID NO: 20823 - protein, 275 aa, Bacteroides thetaiotaomicron
MKKIFRGVAAALLSGTPVYAADVYQPPVEAPFVEQPVEVVQSSGWYLRGDVGYAWNDLRGAHYFQGSNSNLVDFDRADVDDSYVLGGGVGYQINNYLRADLTLDYLGESDFNGSTTGGCGVAVNCVSNDVASMSAWSLLANAYVDIGTYGAFTPYVGAGIGGTRVKWGTLRNTSCDVTDPSNCDPTVEHKGESDWRFTYALMAGTAVDLTCNLKADVGYRFRHINGGDMFGYNLNSGPAYDKDIYVHEARAGLRYSFGNNCEAAYVPPAEPIVYK

SEQ ID NO: 20824 - protein, 792 aa, Bacteroides thetaiotaomicron
MRTIARFPRVSLLALLIAPTLDALAEAPQGDTGEARSSDARTLDQVQVIGQATSYAKTSVRAETLNRQTVMSSVNDALNEVPGVVVSEADATGSSVWGTQISMRGFVTNRDTQQIGTTIDGLPNGGSGYGGGSLANRYIDTLDLETVEVSQGTADISSRSNEALGGTLNFLTSDPLQDSRLRFVVGAGDNDARKYYVRYDTGLLGGHTRAWISASSSKVHDWIDGTGHASNDHIAGKFITELDRWTLTGYLSYNDADEPEYTSVSPKGFATNPDRDNLVGTLTGIPYLDQNYRSGSRALRENTFGYLRAAFDGGNGFKASVAAYGHRMQGRGDWLPPYLAQVSDEGAGRPESEYLGGKTVYGGSNRGQIFFVNPDGSAAQRLASCTPRLGFTAEYDPNCYAGNVLGAQSYRHTHYDNDRMGVTADVEWRQTFGAIDNTIRGGLWVEKLDRSARRDWHRLLNVGQDIAFDHQPYWVQFEDKYKVDEQMYYVEDVARFGPFSARLGVKQFFVDQSRRRVIGASEHVKSDSRSDPLLSTGFTWAPGVEGMELFAGFSQNFAAIPSGVLGETDPQRFRNVEPETADNIEVGMRISRWPLTASVTLYNIKFDNRIVYLPAGFVSGIDYLGETDGVYENFGGVESNGLEAAFGYGWDNGWRINAAYTYNRSKYLGSGNAARDTQLGIVDGAKVIGQPENTLVLSADWQGANWNFGLSGRYLGTRYLDAANVNKLPSATVFNANIGFDLQGLSPRLKGMGANLVVSNLTDKRYLAGVDGRDNAFIGAPRTVGISFRVDL

SEQ ID NO: 20825 - protein, 804 aa, Bacteroides thetaiotaomicron
MKKLLALLVLSAPQANAVTYIDTLGNEYNSDKNLFGWLYVGQDSPYGTPKPSSLNITNGATVSVNRDPADSSYLTGTGSVSIESSNLTVEGNGSALNVEDILYVRNSQLKIDNKAILTAGFQVVSQLDNSHIIVSGNSKLNTGTLVLNANTNSTMLISGGSEVIANTFFMSSADDYKSSYIKIDGADSRLNVSDAYLGYIGNASLVVSNGGEVNVRNEIELAERAGQNATITIGGLDESAPEAPGYVNASEIVFKSGVGEIRFNHTSDNYDFSTPISGTGDLTFINGTTNLTGDNKSMSGNVNVGGGSILNVLNDNALGDSSVTIASSGQLALLTANDFKFNNDLVNNGTITLSDQNTYGKLVTVSGNYSSNNGALVFNGALADDNTVIDKLLIKGNYDGTTNVAVNNIGGIGAETLNGIDIISINGNVNGTFKQAGRIVAGAYDYSLVRGEGANENHWYLTSQKQPIPGPDPVPTPKPSLNILRPEAGSYVANNYFSNTMFLNDFQDRSGEVKYFDPISGTYKFSSLWMRQEGGHNRFNDSTGQLKTQSNRYVLQLGGDLFKWAGSDDESIRIGIMGGYGNNHSRTHSSITDYSSKASVNGYSAGLYATWIKGYDDKSWSYVDVWGQYSWFDNSVKGEQISEESYSSKGFTGSIEGGYAYKVGESGRTSYWLQPVAQLALMDVRTKNLNEKNGTNVSFNGSGNIMSRLGVRAYANGHNKIDDNSGRTFEPYVEVNYIHNTKDFSVKMNNETVSQSGARDAFEAKMGVNGQLSENTNVWVNVSQLVGSNSFSDTQATLGIKYAF

SEQ ID NO: 20826 - protein, 668 aa, Bacteroides thetaiotaomicron
MSGQLLRAYKWAEGWANPSDHWPAITGLLGAVLLASTPASASTAELDSVVVTATRSPHPLSEVPVETRLLDREAIDRSQARNLPQLLGTLPGVSASNLDDTLGADNLRLTLRGLQLNEGYGLILVDGRRIHGGLGAHGDYGVSLNQIPLSMIDRVEVVRGAGSALYGADAMAGVINIITRRPEREPTGRAGLGAGFYETLDRDDRDATGSHRRDVDAHALYSGPFGEGSTFLVGGHHQQDEGTDQTAATTRKDTAMGHWQTDLNDHWSATLHGYFARARRDHHGPEARHDRAYDDASLTAGLDYEQGRHSLSMGGYHFDQDFETGYPGFAHGFRDGRVGYREADVRYTYFGERHWLTMGAQHQRQTLDYRFRNYADGALEDTVHVDERIDVNSVYVQDEIWLLGQRLILVPGARYEDHDTFGSELNPKLAARLQTGDTTWRASIGRAFKSPTLRQLYYQGLYRHGDYYLASNPDLSPERAISANLSVERTWPGSRVWTALGVYRTELKDRVTRADTGETTSQGDPIQSYINIDRSRIEGIEAEMRVGDRTGWSMDAALGLTHARDRRSGDWLPYVPRHTASLTPRYVTASGQTGIQGRINAYGRQYRDAANTRRISAHQVVDLGLWHDLTPASTLRLDINNVFNSDRGESAFAFRQGRRLGARIDVEF

SEQ ID NO: 20827 - protein, 172 aa, Bacteroides thetaiotaomicron
MINKRPWLGALSAISLSLCSFAASADFYAGALVSYANAEYQHSSTSPAAEGNPFLLQAQAGYFFNDYLALEARYGTSVQRASGLSVDSLASGFVKLNMPVSGRFALYGLAGYSSAQIDQQSVGSNRDQGFSFGLGMHYALDKHNAVVFEFVDSTSEDQVRLNAMTLGFQHRF

SEQ ID NO: 20828 - protein, 86 aa, Bacteroides thetaiotaomicron
MGISKDVALVHFAGIYTGIGLGAYIKSKSRDDMRVNSAFTFGEKAFLGWNFGAFSTEAYIRHFSNGSLTDKNSGHNFVGASISYNF

SEQ ID NO: 20829 - protein, 383 aa, Bacteroides thetaiotaomicron
MKKGAIAGPVLALMCSASAFAQSGVTLYGIVDEGINYTNNVGGHSLTELASGFAQGSRWGLKGTEDLGGGLKALFQLENGFNASNGKAAQGGLMFGRQAYVGLSDNQWGSVTLGRQYDSVIDYLAPTTVAGNWGGTMFGHPYDNDNLIYSFRVNNTVKYTSPSFGGFQFGGTYSFSNDTSFANNRQYGAGMQYASGGLLLAAAYLQADNPSATSGGAINNGGDQNFLAKRLRIFGAGINYTFGAATAGFAYSNSNLNEPLSTSYISGSILPANGTLNSLRFQNLEVNFKYQFTPAFYAGGAYTLTLEHFNASSGDAKPKVHSFGLMADYSFSKRTDVYIQGAYQRVAGGKTGTALDMADLPGAANASSTSSQFQVRAAIRHKF

SEQ ID NO: 20830 - protein, 790 aa, Bacteroides thetaiotaomicron
MNYRHAKMILLSGCAIALCSGLQPAAAQVEEEGARSGGLEDIVVTARRRAESVQTTPLSVSAFDSRSLQDRGLQNIADVSRAVPNVQLDPVANESGVASTQISIRGIGQTDYVLTVEPGVAVYLDGVYVGKSLGSLLDTVDVERVEILRGPQGTLFGKNTIGGAIQVITKRPTADNQAEMELTTGRYDRLDARGAMSGPITDWLRFRLSASYQSRDGFMKRILRSGERTGEVQGDMNRLGGRLVFEADVAPNLLATLAFDGTRIREKSPATYLRRVTEDAGFPRLFNLAVPGGVCAPAAGASRFSNPYCFNDQYSLPTDTRVTYNAGGNTADTDVRGVALTLDWKPGDINVKSITSFRKVDVFVDQNLGGSAYYNSQVGQDIDFKSFSQEYQLSGNLLDKRLSYVLGAYYQREWGRQLFPVQTALAQFLSGGDIKNDSYAAFGQLTYEITSRLSLTGGFRYTYETRRFNPGLQHVIGYDDLSVIKIPGFVNPVANAFGTPGTPLFPAGWYKRNSKAGTPMISLSYKPVDDVMLYATYSKGFKGGGFTMRFFPPVKPAAGVDPDTLIPYAKPEKATSYEAGIKSEWLGGKLRLNVAGFITDYNNIQVTYTIDPDGPGPIGRFLPVLANSGSARIKGIEVESAAVPTDWLRIDGSLGYIDAKYRKFTAAAIGAYPAALGFDLPNTPKWTYNVGTTVTFFDNESGNVFLRADWAYRSSQFKEFSNNPSLFQKGYGILNAGLTYRSADRNWDVTLGGTNLTDKAYIVSGVASSDRAQAVRSRPREWYLTLRHKI

SEQ ID NO: 20831 - protein, 996 aa, Bacteroides thetaiotaomicron
MKKLYIIIPFLMMGLFPPAPCHANEILEIGLFQVELLAPGESASTANGMSITGTTVWTEEQKTALISSLDILNLSLANSAARPVRIAMAWSDNLPQQILGNSGSSHFLYPTSGELKTTAEAAWRDGDPTDYAPGTADIAINYNSAFDFHYGKGLPGYFVDFRSAVTHEIIHGLGITSGYSQSSGFYGVTRWSSLIEDSDGNRAEYRTLGTPNPLTVLGPQGTLLWLGDYANATHGGPVPIQTFVDEFLPGSSMVHPAPMGELMSWTGNFGEKSRAPNKLLLDMFRDLGWEINMDFYNSFGPTSYLNNTTLESAEVFLSDYDYSYAFYVNGDNNEIVQSGVLESRGDFSDTLRLAGRNNTLEVIGSLTAKGDYSTALYAVGEQNHIQVSGNITAQGEDSVGIYLPQWYYSYNTLILSGATIQAETAVYSPYANPLFILNDCRINGDIITDTFSGVAFGGIWDFNTDEVISLVPDFSFRFDDDIIGNWIGHLGTGELSLNGNAEFSSLTIHEPATLKGTGTIYGPVINYGTIAPGNSIGTLSIDGNYTQLAGSVLEIEAGGGTADLLQVSGTAIIQGGNLMVIPEGYLTSGNYTILEANALQGTFDDLLSPAVFSVAFDDTAINSLTLDIARNSYASLAATADQISLSQTLDAIRPNASGDTAEILNTIDGLTLPALHGALDDLLPRFHNSVTGASLDAIHQHSALLAQQIDSELSPQLQRHVWLRLVADNARYEETAHSPAFRAKTNGLMMGIEQQIASGLRIGMAGAYSNADLHELDFASTADHLSWDGYLYARWDDEVKNGGWFAQTILNSGTDSYDTKRTIAFLGRQAKSEHDAGHGSLSGHGGYRFTVDSWSIIPSFGLEYLWLQENAFSEHEAEGASLHVSSKDSQRFCSQTGLKIEHSSTFEEIRLVSQLAALWNHAFDDETEHTQAQLIDSEEHFSIQGRDSAQDSVELILALHAIFVNGITTRLGYQRTLQKHGGYRSSQVNFGLEWAL

SEQ ID NO: 20832 - protein, 1042 aa, Bacteroides thetaiotaomicron
MEKLVSRSLMLILIGMATAQNIQAGERMSMPTSFKKQTTGLSHVSQQTISVKGNVRDQSGEPMAGVNVIVEGTTIGTMTDSNGNFTLNVPSTSIKIKFSYIGYEDQIVLIKNNRNLNITLNENSEMLDEVQIIGYGTQKKITVTGAVSSVGTKDILKSPVPNVAQALTGKVPGLSTIQYSGQPGADDPAIFVRGIGSLDAKRAAPLVMVDGVERSFFRLDPNEIENITVLKDASATAVFGVRGANGVILVTTKRGEEGKAQISVSTSASLQKPIRLYEYANSYDYAVAFNEKLTNDGASPVFGEKILDAFKNHTDPLLYPDMDWMELILKPTSFQSQHNLSISGGTDRVRYFTSVGILTQNGLFRSFDAGYNSNFTYNRYNYRANLDIDVTRSTLLKINLGGRLEDTKEPNTKSNLFTFLTRVTPFGGAGLYDGKWIHTSPDNIGWDKGALENADPFECFFGKGYNQRIYNEINLDLSLQQKLDFLTKGLSLNIKGSYNSGYTHRKNRYKEIPYYTAHRDPETNELFFRKFREESQLYFEESTDRGRNWYLEGSLNYDRKFGKHQVGALILYNQWRDQYPDPAQFDYVSIPRGYVGLVGRATYNFDNRYMVDFNVGYNGSENFAPGHRYGIFPAFSAGWILSEEKFMKNQSFINYLKIRGSYGIVGNDLMNTKSRFFYLPDAYNPYGTSYNFGVDVSGNRDGATELQMGNPLVSWEKAGKQNYGLDFSILDEHLSGSFDYFIEKRHDILTTRNTAPNFIAITMPVVNIGKVDNKGFELVLKWNHSIGDFKYWINGNLSYAKNKIVYKDEIPHKYPWLYETGQSVGQPFGFIFDGFVTEADLESGKLPDHKLDLKPGDAKYKDLNGDNIIDDNDQCPIGNPIYPQLTAGITAGFEYKGFDFSMLWAGSGKVSRFISAGLRVPFGGGNYGLLQYMIDDHWTPETAETAKTPRFSGAANANNYTRNSTLWLKDASYIRLKNVQIGYTFKGEWMKKIHLKNMRIYASGENLLTFDHLKIADPEATDDKQFQYPLQMIFNIGLNLNF

SEQ ID NO: 20833 - protein, 1513 aa, Bacteroides thetaiotaomicron
MPGDPPRPGHRPSPCLPSQDRQEPLCPGKATNSPSLQIFFRQQPSPCDTIFMTGSTIIPSISIKTGCSFACRKPAIRRTMKDVERRGRRKVYAAKSALAGLLALSMGTTNVWAGVTIGEGGSGYWNNPYFYALANGETATNTTPIKHGESTGPIIDKLMADKGYLSGIMVGSGSLNNEGEIHLYFKNETGDVRLYGIEGDTSRNGADIELRAEVGTATSTPAKASAFAYGIQGEVGSNEGKMIIKVEGGTASSASTYAHAYAYAYAYAYGIRGEVGDNIGHMTIKAEGGKVTSNATGTAYATAYAKAYGIWGNVTNNSGAMEIRAQGSKATSKATDNAFADTSAVAYAIRGTVGSNEGKMSITAQGGEDEATSTAQAYAQAYDQAYGIWSGVKSNIGKMGIKAQGGTATSNATNIAYAYTPASAYGIKGGVGNNSGEMEISAQGGTATSTTVTAKAKSFAHAYAKTYGIEGEVGDNRGKMEIGAEGGTASAYSWTDAEANAIVSAHGIEGKVGKNSGEMKIRAQGGRATAEATVKALATASADALGIRGQVGKNSKEMKVKATGGTAKTTTNATTASASANAYARASASAHGIFGGMGGNSGNMTIRSLGGKATAYDTAFANAMVDAIAYGIRGQVRSNEGKMEIETQGGTAEATAAKATTSANAWAYGIEGEVGDNDGKLEIRAQSGEANANATGTGTADAWADAYGIRGTVGSNGGKMTITAQSDTATATTAAKAKTSAYAQAYGIEGRIGDNIGHMVIKAQGGKATSKTTGTAWAWAWADAYGIDGGVGSNEGKMTIRAQGGEAEATAADANAYTIAAAHGIEGKVEKNSGEMEIRAQGGTTNATTTTNAKASADASARAFGIEGQVGSNEGNMNIGAQGGEAEATAAETTAYGNADARAKAYATASAYGIIGGVGSNEGKMTITATGGKANGHSYISSYAFASGIEGDVGKNSGEMEIRAEGGTATTTGTGTTKAYARAIGIGSSADLYNEGQLEVMARAGRYSTDGGTTYQSDSARAVGISFSGEAELDSRALISVSALPAQDEAGKAIALGTGKTLHAYQVYSGEDLSIKGYAMKFNNQAQVTADYKGTIGVAEGKRVTFAPDAQVYAFTDNDFGKVPNYSIPMLVEGETRRYNQFSAAQLVVSSPDYSISLLDSNGGTLQRLAIKYTPEVSTPLVSAQVNQKMLASGTTIVTNNSLSPMLAMMDRSNPQTSAYDGVLLASTSPVLAVPDMEILPQKRGWAFAMPYYSNVSNNASPMGYDADIYGATAGYNHWIDSDLILGFHAGYGSGDINYTGKGYEQKKENLKAGSLGVQSLYRFADDWLLQSIASFYYSSNDYSDNNPLNREQGDYHGYGVNANLDLDYVFSFTNNRLVPSVGLRYLWQHVDSYTAYNLDNADIHYGDMDENQLYANLGLDWYGDYQTESNWQIVPSLGLGIEQALTDNKFGNSMGVGSIIIPVTNSMDKTSVSARASIEFVKDSYALSAGYAGAYSNDTKNSSFYLQMKYFF

SEQ ID NO: 20834 - protein, 1038 aa, Bacteroides thetaiotaomicron
MRELVFLINGNLNQKNVFMKNTNSYFKPLVLLFLLSVIPSWGFAQSIRVQGVVNDNASESIIGANVTEKGTTNGVITDLDGKFSLSVQKGATLVISYIGYVTQEIPVENETELKVILKEDSKALEEVVVIGYGTARKSDVTGSIASVGGDKLREVPAADVSYALQNRIAGVDMSQTSSRPGATMQIRIRGTRSLSATNDPLIVLDGIPFMGSLTDINPSDIKSMDILKDASSTAIYGSRGANGVILITTHKGVTGAPAKVSYNGYVGLKKVFSKYPMMNGEKFAEMRKYAGKFENSMDESDDVNTDWQDLMYRNGFVTSHDVNISGGTQGGNYSFGGAYYKDQGVIPTQNYTRYSLRGSFDQGVGKYFRFGLTTNSNYNVTKGNNIGLYGVLSVSPIANPYNEDGTLKRTVKYNSQDEAFVMTRDVVENLEEKWLNESKGFGTYNNLFAEVQCPWIKGLKYRMNLGLNYRSTKQGEFTGYGINNTAPDAPSTAALAHSETTNWAVENLLTYDRTIGKHQFNIIGMYSAEQTVYTRSHVAGRDIPAEYFQYYNIGRAEGTITVNPSNWNYQKTGLMSWMGRAMYTYDNRYMLMATVRSDASSRLAKGHQWHTYPAVSAGWNIRNEAFMDGIEWLDILKLRVGYGETSNQAVDPYKTLGRLNTRPYNFGPTNFATGYYVSEMPNAMLGWEYSSTWNVGLDFTLFNGRLSGTFEYYIQKTHDLLQNVNLPSTSGVGSYMANVGKTENKGFELTLNGTILDNHNGWTWDASLNLSANRNKLVELASKKDRDEGNGWFVGYPIDAIFDYEYVGLWQEGDPYLDILEPGGNVGMIKVKYTGDYNADGTPVRAIGPEDRQIMSLESKFQGGFSTRVAYKNFDLNVITAFKCGGKLLSTLHHSSGYLNMLSGRRGQVDVDYWTEENTNAKYPKPGGIQSGDNPKYGSTLGYFDASYWKVRTITLGYNMDNQRWLKQLGVQGLRAYVTIQNPFVICSPFHKETGLDPETNSYGDENVAVVGFQRRFLTVGTNSPSTRNYLFGINLTF

SEQ ID NO: 20835 - protein, 471 aa, Bacteroides thetaiotaomicron
MRKTLFLAFFPCALAFGENLPPWFPQFLGMRATFVGQYSTNFNSPYEGPMTFGNPYKNNGGGRSEELTQSYGLYTGAQITKDIQAYLDIQLFKGNGIGGGQGIGGYPNSLYIRAGSSNLGKNPYIARAYIIYTKALSQSLEYEGRAPDQLPGYYPKEYFYVKIGKFSIADDFDNNRYANSPRTQFLNYDFNYNVAWDYGADTRGYTVGIESGVVKKHYSFKIALGAEPTKANGNTYDQSGAYSLNTQLSLRPNDIGTVIRLLGMLNYGRMGSYTEAMDNFSYYYSPNSPCYYTEFGPNGALAGYDYPVICTESKDHKRYKWGFFLNLEQPIADDDKTGLFLRAGFNNGQTEDLAYTDVDRDIAGGISINGVHWKRPKDQLGIGLGINGLSNTHKRYLESGTINEPSSSFFVGSGQDGQFNYSYEEIMEAYYKYQLNKYISISPDAQYIRHPGYDKNRGPLWVYGLRVNAQF

SEQ ID NO: 20836 - protein, 1119 aa, Bacteroides thetaiotaomicron
MEKKKFVKKQGRVVLFLILLLLFPLGALAQQKMIKGQVVDDSGEAIIGATVMVKGNTGGTITDIDGNFSIQGKVGSILSITYVGYASMQVKVTKLEGNKYVMKEDAKVLDEVVVVGMDTQKRNTITAAVATLKDDAIVNRPVTDVTSALQGNIAGLNFATDAVGGGVGGETGADIKFSIRGIGSINGGEPYVLVDGVEQSMQNVNPADIASISVLKDASASAVYGARAAYGVVLVTTKSGKKERASVTYRGTVGFSSPINMPKMMNSLEYAMYNNQQYDNGGASSGLQRIPDKTIEKIKGFMQNPYSAEFPGIEANTSGDDWAGAYYNQYGNTDWFDYYFKDKSIRHSHNLSVQGGSDKVNYYIGMGYTYQEGLLDQVQDDLSKYNLNTKLQMKTNNWLRFNLNNNITLQMIKRPMANQTILYNKIGSHRPTQVTQLPVDSEYNLPSWNEMLYLKNSHYQRNRISDALSLSATVTPLEGWDITGEMKIRFDIENNDLIMENNQKYETPVGTFKPGDATNQRQGFAYPGISWKNMYFGSYTRGSMFNYYLSPNVSSSYTHQWGDHFFKAMAGYQMELKEDSQEYMYKDGMLSNDIYSFDNASGNVIAGEARSHWSTMGFYARLNWNYNNIYFLEFSGRYDGSSRFAAGHRWGFFPSFSAGYDIARTPYFQKMALPVSQLKVRVSYGRLGNQNGAGLYDYIAQMPLDAQGTNAWLLPGISSSTASKGTIAQTPKMISPYITWEKVDNANLGFDLMLFKNRLSITADLYQRTTRDMIGPAESIPSISGIASEDRAKVNNATLRNRGWELSVSWNDKLKCGFSYGVGFNVFNYKAVVTKYNNPEGIIYNNHTGLAANKGYYEGMDLGEIWGYRADDLFLSNREIDDYLRKVDLTAFKSNDLWRRGDLKYIDTNGDGRVDGGKGTLSDHGDLQVIGNTTPKYSFGINLNLGYKGFEVSTLLQGVAKRDFPIAGSNYMFGGNNYNFKEHLDYFSTENPNGYLPRLTGWKDDKDFLVNTGYNTTRYLLNAAYMRMKNLTVAYTFNKKQLKHIGISNLKVYVTCDNLFTITKLPKQFDPETLNQVNMSAGGDAKNTAPGLTSPMKQNGNGMVYPMNRNFVFGLDFTF

SEQ ID NO: 20837 - protein, 1140 aa, Bacteroides thetaiotaomicron
MKFVTITMLLLATLVPALAQDRGTIEGTVTDVSGSVIPDAAVRIVQVGTNASWKLVANEVGRYYAPNLPLGTYLVTVQKEGFATATSEAIQIRAQTNARVDVKLQVGTVAEKIEVGAQAALVDTATATVSASLGTKQLNELPLISIGQKADIANYLQYLPGSESTPAIAGAPAGSSVTPVMNGSQSLSTEVFVDGAPASDGVFRGSLWENGGAVAHYGEFNVVANSFSAEYGRTGTWFYSVTTKSGNNDLHGSAYDYFVNTALNARDFFQATRQIYHQNNGGVTLGGPVYIPKIYNGRNKTFFFIGVDLFYSVGAQQGNLLTVPTAAMRQGDFSGYVNSAGVQIPIFDPLSANAAGVRTQFPGNIIPAAQISQVSKNIVALMPFPDTPDAAANWHNRTGANPLFNNFTETARVDHSISDKEKFFFTFNDEYRPRKISGVGWGATSPLEGLQDQPLHARTGRFSADSILRTALINHVTLGYDYYLNPAFASTAGQGWLDKLGIKGLPFDIGSFPVVSFSGGTNPPLNMGSQQWSHLGTSRWSLSDSLSWVKGHHFLKFGGSYWYEVRNDRAMANGSGSWTFTNTVTSQPSSPSYGQWGSSFASFLLGQVGTSTTKGPTYLATRLPYQALFVQDEWHVSSKLSLSLGLRWENNSPPFDKYNRFANFDPNTPNPGAGNIPGALLFAGNGPGTINAQTTVKPWHKGFSPRTGYVYQFTPKLVMRASFGIFYPPPLLNALTLQWYETASTVQSPDGYTPAYAWDNARPAYPTDKVLDPSFINGQAAAFYAPDYVRSGPILNWTAGFQYELSRSMVLDVTYLGRHATGQQVNTMGNTNQLDPKYLALGSLLTQNISSPAAVAAGIKAPWPTFSSFALPTVGQALRPFPQYSDVTNQLAKLGVARYNSLQIKMTRRYAAGLTVMGSFTWSKNLTNAPASSPGGVQGPFERNLIVSPSEYTLPADFKVSLAYDLPFGKGKRFLNSAPSPVNAVLGGWQLVFFLERASGNALTVTTTSTLAAYGFPTKRGNVNSGVPLTLNTDASNFNPAVDRYINPAAFSSPATYALGNTPRTMDWLRGFPFATESGSIKKSFHLYERLVMNLSGDFQNPFNLVRWGNPVTNLSASNFGMVTTSSPGRRVQLTAELKF

SEQ ID NO: 20838 - protein, 396 aa, Bacteroides thetaiotaomicron
MRKMVVCLLLLCLSTPAMAADNLKEMFANGTFKGEIQLLQFTRHFDRTTTDRQDRALGGSFYYRTDSFKGINLGVAFASTNNLDSDDDKGTYGLLAAGHDSVTRLQEYYVQFHYFDTTVKVGAQEVYTPFLFPHPFRMMPRSFRGVSAVNQSFDNLKLMAFYLKSAVDWDDETFGDISKAINPQIDSEDVYIIGASYNVPVEGMKVNVQGWGFSMTDVFNQTYFSAAASKKMDNNMVLHGGAKFFTQNSQGDERNGDLDTYQYGVNAGLAAFGFDLTAFYSKTGDDGIVDRWGYNKAIIQQVWHTGILADEDAYAAKLSYDFADVGAKGLSAYVFHTEYDTHDSNLNDKAETDLSVQYAFSGDYKGLGLRARYAMINTKGGGEDFTDTRFYITYKF

SEQ ID NO: 20839 - protein, 193 aa, Bacteroides thetaiotaomicron
MRYLATLLLSLAVLITAGCGWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 20840 - protein, 944 aa, Bacteroides thetaiotaomicron
MNKKHGFSLTLTALAIAAAFPSYAANPETAASDAAQSQSLKEITVRAAKVGRRSKEATGLGKIVKTSETLNKEQVLGIRDLTRYDPGVAVVEQGNGASGGYSIRGVDKNRVAVSVDGVAQIQAFTVQGSLSGYGGRGGSGAINEIEYENISTVEIDKGAGSSDHGSGALGGAVAFRTKEAADLISDGKSWGIQAKTAYGSKNRQFMKSLGAGFSKDGWEGLLIRTERQGRETRPHGDIADGVEYGIDRLDAFRQTYDIQKQNKKAEYFLAEGEREPKPVAKLAGNGNYLKNQLNRWVEERKKNNQPLNAEEEAMVREAQARHENLSAQSYTGGGRILPDPMDYRSGSWLAKLGYRFGGRHYVGGVFEDTKQRYDIRDMTEKQYYGTDEAKKFSNKSGVYDGNDFRDGLYFVPNIEEWKGDTNLVKGIGLKYSRTKFIDEHHRRRRMGLLYRYENEAYSDNWADKAVLSFDKQGVATDNNTLKLNCAVYPAVDKSCRASADKPYSYDSSDRFHYREQHNVLNASFEKSLKNKWTKHHLTLGFGYDASKAISRPEQLSHNAARISESTGFDDNNQDKYLLGKPEVVEGSVCGYIETLRSRKCVPRKINGSNIHISLNDRFSIGKYFDFSLGGRYDRQNFTTSEELVRSGRYVDRSWNSGIVFKPNRHFSVSYRASSGFRTPSFQELFGIDIYHDYPKGWQRPALKSEKAANREIGLQWKGDFGFLEISSFRNRYTDMIAVADHKTQLPDSTGRLTEIDIRDYYNAQNMSLQGVNILGKIDWNGVYGKLPEGLYTTLAYNRIKPKSVSNRPDLSLRSYALDAVQPSRYVLGFGYDQPEGKWGANIMLTYSKGKNPDELAYLAGDQKRYSTKRASSSWSTADVSAYLNLKKRLTLRAAIYNIGNYRYVTWESLRQTAESTANRHGGDSNYGRYAAPGRNFSLALEMKF

SEQ ID NO: 20841 - protein, 621 aa, Bacteroides thetaiotaomicron
MRRNFVTKLLFPCALLSAVLAAAPALGSGQEELIGSFGLSDPPPELARFPRPASRIAENITVVTAQDIARINAHTVAEVLNTLPGVQMDQLQTPGSMNFFGVLGASSRHVLVQIDGVAQNLIGSENIAQVGLIPVQMIERIEVVKGAASAAWGSALGGVINIVTKSPAADRAAGMVSGSTGKSATRDLRAEATGSGERFGYYLTAGKLSSDGLLAGNDTDMNHGFGKLSYDFPNGGDLSLSLDARHSMAGTEESRRYDFHNTGAATHATGNLVLNYPLAERLALEANAHTGRREVQNRRAVLTTGVPFADFKGQETFRGADAALSWGDASRALKAGVSLEETEVEMHEPVRRYPQANYDLALRRESAYLNGTYTMGRLSILPGVRLDRLSLMEDPVSFTLGATLRLTDNTLLRGYAAYGYSMPIISNLGIQNGQVQRDLQHVRTVQAGVESADLPFVWVKTTFFYAEVWNIQDFDQPTPQLSQQVKQGAELELKSSPWCGFALNGSYNFTDARDQKTGKVLSVLDAGPRQALKVGVRYDSEPAGLSATLLGDWAKLHNPGRFAKDKGEFWDLHLTQKLSPSSDNSPELFLSWHNIFDSKRYFYDFRANAPRWLEAGARWFF

SEQ ID NO: 20842 - protein, 1042 aa, Bacteroides thetaiotaomicron
MRIYLRLLAVFLLLFAGNILYAEAQQEKRVTGTVISEGEPLPGVSVQLKGASSGTITDIDGNYSIEAPGSGTLVFRFVGMRTVEQPVNNRSVINITLEAESKELDEVMVVAYATAKKYSFTGAASTMKAGEIEKLQTSSVSRVLEGTVSGVQASAASGQPGTDAEIRIRGIGSINASSAPLYVVDGVPFDGSVNAINPDDIASMTVLKDAASAALYGSRGANGVIIITTKQGEQNSKATVKVKASLGGSNRAVRDYDRVSTNQYFELYWEALRNRYAGSPDYTPATAAAQASKDLVTKLMGGGPNPYGPQYAQPVGTDGKLVEGARPLWNSDWSDAMEQQALRTELNLSVSGGGKANQYFFSAGYLNDKGIALESGYQRFNIRSNVTSEMTSWLKGGVNLSFAHSMQNYPVSSDSKVSNVITAGRTMPGFYPIYEMNTDGSYKLDENGDRIYDFGSYRPSGSMANWNLPATLPLDKSERMKDEISGRTFLEATIIEGLKFKTSFNFDLINYNTLDYTNPKIGPAKENGGSVSRMNTRTFSWTWNNIATYDKTIGEHHFNVLAGIEAYSYRYDELTASRSKMAQPDMPELVVGSQLTGGSGYRIDYALVGYLTQLLYDYRNKYFFSASYRRDGSSRFAPETRWGNFWSLGTSWRVDREEFMASTSDWLSALTLKMSYGAQGNDNLGTYYASKGLYSIVSNLGENALVSDRMATPNLKWETNLNFNLGMDFSLFNNRFSGSFDFFTRRSKDLLYSRPIAPSLGYGFIDENVGALKNTGIELVLNGTVINQNGWVWKLGMNLTHYKNKVTELPLKDMPQSGVNKLQVGRSVYDFYMKEWAGVDPDNGKPLWYADELDADDNPTGKRVTTSDYASADYYYVNKSSLPKVYGGFNTSLSWKGFDLSAIFAYSIGGYIYNRDITMILHNGSLEGRAWSTEILRRWTPDNRYTDVPALSTTSNNWNSASTRFLQNNSYMRLKNLTLSYNLPKPWVSKLALSSVQVYVQGDNLFTIHKNQGLDPEQGITGITYYRYPAMRTISGGINIAF

SEQ ID NO: 20843 - protein, 719 aa, Bacteroides thetaiotaomicron
MRIGIIPGVLGVLCTTLSAHAQESDSVRNVALPEVVVAETYQQLQNKKIALTLEVADRDFLRKHFTGNFMQAMENIPGVQAMDIGSGFSKPMIRGMGFNRVAVLENGIKQEGQQWGADHGLELDAFNVDAVSVMKGPASLLYGSDAMGGVIDISPVQVPAENMLFGDVTLLGKSVNETFGASLMLGIKKNAWYTKLRYSEQRFGDYRIPVDTIIYLTQKMPVYGRRLKNTAGWERNINFFTQYQKKGYKSVYAVSNVFQKTGFFPGAHGIPDVSRLEDDGDSRNIELPYSKVNHLKVTTHQQYVWEKFILSGDMGYQNNHREEWSAFHTHYGSQPLPQTNPDKELGFNLNTFSFSAIGRLIGSSFWEHRMGWDSQFQRNTISGYSFLLPEYERFTTGVSWLTTYRPDNVLAVSGGIRYDYGRIYVFAHDDPYLATYLQEQGYSDEQVESYRWNSRRVNRSFGDYSLSLGVVWTPSVLHQLKVNVGRSFRLPGANELASNGVHHGTFRHEQGDATLSSEQGWQMDASYQLKYGRLSLYVSPFVNWFSNYIFLRPTGEWSVLPHTGQIYRYTQTEALFAGTEAGAEVRISSAFSYRISGEYVYTYNCDEHIPLSFSPPATLHNTLTWQKKRYMLYAEWQNIARQNRVDRNEDRTPGTNLFHIGGSLDLPVAGNKVEITLTVRNIFNTRYYNHLSFYRKVEIPEPGRNFQLLIKVPFKKRFK

SEQ ID NO: 20844 - protein, 3699 aa, Bacteroides thetaiotaomicron
MLQHAYKMIHAFKHIMTRFCHSYLKMFIVGSFFAMTSLYASAQNRSFDFTTGDTVTLTNAGSALTNRTTFTLEFWAKFTNVSGTINLVDFTGGADAGGLILNSSKLTVDLECDFGCLTESNVLSLSTGTWYHIAVVFDNGTWDFYVDGIAQGINVLDQGARSSVPNYTGFGVTNLVFGLQNHGAVDDFVGSIDDIRMWSSARTQVQIQNNRSIELVGNESGLLGYWKLNEASGTTVNDSQTNSSMLTGTSSGIGYNATGAFVTDSVAPTVSSITASTANGTYKVGDVISVEVNFDEAVLVTGTPQLTLETGTTDRTINYASGSNSSTLTFNYTVQSGDTSADLDYVATNSLMLNSGTIRDAASNNATLTLPSPGTANSLGANRNIIIDGVAPTVSSVNASTADGTYKLGDIISIQVNFSEVVSVTGTPQLTLDTGTTDRTIDYASGSGSSALTFNYTIQSGDTSSDLDYAATNSLALNSGTIRDAATNNATLTLASPGAANSLGNNTALVVDGVVPSVTSTVPSGGAVSTDTSVDFTVNFSESVSNISTDDFALGTTGGATATIVSVSASSGSSVNVTVSGITGNGTIKLNLNASTNISDAAGNAGPAAYTSGSTHTVAIPTAPYAPTIGAATAGIGQASVAFSAPANNGGAAITGYTVTSNPDGISAGGNGFTTSPITVTGLTNGTAYTFTVTATNTIGTSPASGASNSVIPKVNQTITFANPGAQNFGTSPTLTATSDSSLIVSFSSSTPAVCTITSSGTLTFLSTGSCTIDTDQSGNASTNAASTVSQTFMVNAVVPSAPTIGTATAGNAQASVNFTASASNGGAAVTSYTVTSNPSGFTGTGVGSPISVIGLTNGVAYTFTVTATNSAGTGAASAASNSVTPASPQTITFADPGAQNFGTSPTLTATSDSGLTPTFTSSTTGVCTISSGGLLNFVSVGTCTINADQVGDSSYLAATTVSRSFSISAVVPGAPTAASATAGDTQASVTFSAPIFTGGAAITGYTATSNPGGFTGASASSPLTVTGLTNGVAYTFTVTATNSVGTGAASTATSSTTPKAIQTITFADPGAQSFGTAPMLIASASSGLTVTFTSSTTGVCTITAGGALTFGSTGTCTIDANQAGDGSYLAAAQVSRSFTVNAVVPGVPTIGTASAADSQASVSFTAPIFNGGSSITGYTVTSSPGGFNASGAASPITVTGLANGSPYTFSVVATNAIGSSSASGVSNSVTPNGAPVISGTPTLSVNQDVSYQFTPTASDSVGDVLSFSIANKPAWATFNTTTGTLSGTPSNQDVGVTNGIIISVSDGALSASLPAFNLSVVNINDAPTISSTAITAATQDAAYSYTFAASDTDVGDTLTLSAVTKPSWLSFNAATGVLSGTPSNADVGSHVVLLRVTDTDGLTADQSFSITVTNVNDAPTISSTAITAATQDAAYSYTFAASDTDVGDVLTFSAVTKPSWLSFNAATGLLSGTPSNADVGSHVVLLRVTDTDGLTADQSFSITVTNVNDAPTISSTAITAATQDAAYSYTFAAADTDVGDVLTFSAVTKPSWLSFNAATGLLSGTPSNADVGSHVVLLRVTDTDGLTADQSFSITVTNVNDAPTISSTAITAATQDVAYSYSFAAADTDVGDTLTLSAVTKPSWLSFNAATGLLSGTPSNADVGSHVVLLRVTDTDGLTAEQSFSITVTNVNDAPTISSTAITAATQDAAYSYTFAAADTDVGDVLTFSAVTKPSWLSFNAATGLLSGTPSNADVGSHVVLLRVTDTDGLTADQSFSITVTNVNDAPTISSTAIIAATQDAAYSYTFAASDTDVGDTLTLSAVTKPSWLSFNTATGVLSGTPGNADVGSHVVLLRVTDTDGLTADQSFSITVTNVNDAPTISSTAITAATQDAAYSYTFAASDTDVGDTLTLSAVTKPSWLSFNAATGLLSGTPSNADVGSHVVLLRVTDTDGLTADQSFSITVTNVNDAPTISSTAITAATQDVAYSYSFAAADTDVGDTLTLSAVTKPSWLSFNTATGVLSGTPINADVGAHPVLLRVTDTDGLTADQSFSITVTNVNDAPTISSTAITAATQDAAYSYTFAAADTDVGDVLTFSAVTKPSWLSFSAATGVLSGTPGNADVGAHPVLLRVTDTDGLTADQSFSITVTNVNDAPTISSTAIIAATQDAAYSYTFAAADTDVGDVLTFSAVTKPSWLSFNAATGVLSGTPSNADVGSHVVLLRVTDTDGLTADQSFSITVTNVNDAPTISSTAITAATQDAAYSYTFAASDTDVGDTLTLSAVTKPSWLSFNAATGLLSGTPSNADVGSHVVLLRVTDTDGLTADQSFSITVTNVNDAPTISSTAITAATQDAAYSYTFAAADTDVGDTLTLSAVTKPSWLSFNAATGLLSGTPSNADVGSHVVLLRVTDTDGLTANQSFSITVTNVNDAPTISSTAITAATQDAAYSYTFAASDTDVGDVLTFSAVTKPSWLSFNVATGLLSGTPSNADVGSHVVLLRVTDTDGLTAEQSFSITVTNVNDAPTISSTAITAAIQDAAYSYIFAASDTDVGDTLTLSAVTKPSWLSFNTATGLLSGTPGNADVGAHPVLLRVTDTDGLTADQSFSITVTNVNDAPVATSSTVTLEEDGSVTITLAAEDVDNDPLTYEVVSQPESGTLEQHGTVWLYTPEKDFNGTDLFSFIAKDAELSSEPATVTINVTPVNDDPQAVDDDYTLTSTANDVYALAVLANDVDVDGDTLTIDGAAADIGSVQITSEGLSFTAPEAYVGPVALRYTLSDGNKGRASAKVNVLIEGAESENQPVITLPDDVDMNATGLFTRVKLGFAKAVDRNGHPLPVSLVNKSLFFAPGSYLAYWQAVDRDGNKAIKAQKVKVHPLISLNKDQLVGEGNEVVVSVYLNGVAPVYPLSVPYTVSGSAGSSDHDLVDGVIEVTSGQQAEIRFRTFEDGEVEGDEDVLISLDPSLNLGSKQQTQVLITEANIAPKVTLDVTQAGAHQFIVAQNGGDVRINADISDANMQDSLTSTWASGSLNLQSDDAGMFFSPVSVLPGIYPVSVTVTDNGLPALSTTEKVYIVVRSSLPVLTGADTDGDLIPDVQEGFTDTDGDGIPDYLDAVNDCNIMPEGELQPVYFLAEGQAGVCLRLGNIALRQGQTGMQLLPTLVPEDSIAANVGGIFDFVATGLPQQGQSYSLVMPQRSPIPANAVYRKYQAQNGWKDFVIDARNSVASSEGERGFCPPPGDSRWTAGLTEGHWCVQLTLEDGGPNDDDGVANRTIVDPSGVSVILNGNHLPVANPDTASLPWNQSLDVDVLANDTDSDGDALTVTQVTSEFGTAVILANQQLSYTPATDFIGTDVLVYSITDGKGGTASTELTVVVSGNTAPTTVNDSAATDDRTSLLLDVLSNDSDPDGNVLTLVSATAQQGAVSVESNKLRYIPKAGFDGVDTVSYQISDGLGGEATGQVLITVKAYQEVVVDNKSGGGSLSLWVLGLLMTTGLIRRRKLHKVVLGAVLLAGTVSQANAADNWYVEGFVGQAQVDSSRRDLQPQTAAGVVTSVDDKDTAFGLSVGYQWTPMVAIELGYADFGNGSARIEGASLTPAQYHEQVKAVTPVLADGVMLGLRFTLLQHDAWRFEVPIGLFRWQADISSTMGNSRLTTELDGTDWYAGVRFSYQVSDAWSVGLGYQYVDIEPNDFLSYQLNLRYQF

SEQ ID NO: 20845 - protein, 1126 aa, Bacteroides thetaiotaomicron
MLKRMRSFLVLVMLFIAVTMSAQVTTATMSGKVTAQDEPIIGATVVAVHEPSGTRYGTVTNVSGQFNLQGMRTGGPYKVEISYVGYQTAIYKGINLSLGENYVLNVSLKESSELLDEIVVTASKNSNMKSDRAGAITNIGEEQMAMIPTVGRSMNDIMRLTPQGANTGNGFAVGGGNYRQSSVTVDGAAFSNSFGIGSNLPGGGSPISLDALEQIAVSVTPFDVRQSGFIGGAINAVTKSGTNDFYATAYTYLNNENLNGDKVGDLELIREKSQKYLYGASFGGAIIKNKLFFFVNGEYEDNVTAGPKSRARLSDSDDWGSNTANVNRPTVGKMDEIRNYFIDKYDYDPGRYQGYSIKTPAYKIMARLDWNINDNNKLNFRFTRAHSKDNSGPTSSVSPFYATDIYDGGTAASKGSGNVNHNAAMYFENSRYFKEYNFTSYASEWNSKWLDGSLNNVTRVTYSFQDEPRSYEGAADFPSIDILEDGAVYARIGPDIFSPGNLAQARTFVLTDEMSYTAGIHNLLAGFQFEYNKATNGFQQAGNGYYVYKSWDSFVNNEYPKAFAITHSNAADYSQFKAEMKTLQYSLYLQDQMNISENFKLTAGIRFEMPKYPSLKNNYNEDFARCEFGGVSYSTDQVPSAKISVSPRVGFNWDITGERKYVLRGGTGLYVGRLPFVWLVSAVGNSNVGQNQYYYTKVADAALKPHFQPSVSGVLNELYPNGRIADIKAPTDPTIIDKDLKMPSTWKTSLAFDAKLPGDIDFSIEGIFNKDINPAVISNKAIKPSEATITFNPNDTRDSYSKYSDASWTNAGGKQNVFYIENGGHKAYYYSITTQLAKSFDFGLYLSAAYTHSKAKAYSDGIGDQVTSAYRTNTYSVGGINEHETGYGTYVSPHRIVASAGYRLEYAKRFASSLSFIYEGMNMGYAGGYGYARYSYTFAGNIVGDGGANNLLYIPASREELNNWTFAEKTYNSVNRTYDDYKLDGQIYSADQQKDDFWAYINQDSYLKKHKGEYVDRGGVVMPWHHQLDLKFMQDFYLKVGGKRHTLQFGVDIKNFLNLLNSDWGLYKTVNNTNLLAYDKGNSTTGEGKGYTFQKNSGKRLTETYTKYKDFRSTYSVQFSLRYIFH

SEQ ID NO: 20846 - protein, 898 aa, Bacteroides thetaiotaomicron
MGRVSLCLVIMFFICSAQKIDAQVQNIREKQDTISATKSLEHIRPENIKKGPLNNALDVLSGQSAGVNVTTNGTDRLAMLNSIRVRGTTSIMGGNDPLVIIDGVTSDIATLSTIYPADIESFTILKNATETAMYGSRGASGVIEIKTKKGTGRGFEISYDGNYGFESMYKHLQMLNGPEYIATAEALGLDYNNGGYNTNFHDVITRTGLIHQHHLAFSGGSENSNYRASFGFMDHNTIVKVNDYRNLVVKLDATQKAFDGRLVGDFGVYGYSSKIHDIFDTRMLFYSAAAQNPTYPAGTDVNGNWVKNSAASHINHPGALLYEKNDSEERNFNTHLGLKFNILDNLILSAFGSYSYSSTGNAQFCPTWVWAQGNVYRGEFKGEDYFTNVSLSYNNAWGDSHLDAVVGAEYLKQVRTGLWVQAKGITTNDFSYNNIGATSSRPFGGTSSSYEDPSLASIMGSVTYSYKDRYSIAAALRGDGSSMVSDNNTFGFFPSVSLGWDVKKEGFLSDTDFITMLKLRTGYGRSGNLGGITSYTTLNTVKENGIVSINGAPTVTMGSIRNTNPDLKWETRSTFNIGFDLGIWDNRLMLTSELYYSKTTDMLYEYDVPVPTFAFDKLMANIGSMSNQGVELGISVVPIQRKDMEMNINFNMSYQKNKLLSLSGEYNGMHMTASDITPIGSLYGAGQNGGDNNVVYQIVGQPLGVFYLPHCKGLKENELGGYSYDIEDLNDDGEIDFSDGGDRYIAGQATPKVTIGSNISFRYKSFDIAMQINGAFGHKIFNGTGLAYTNMSIFPDYNVLKGAPEKNIIDQNVSDYWLEKGDYVNIEHITIGYNIPMKSKAVKSLRLSAGISNLATITGYSGLTPMINSYVVSNTLGIDDKRTYPLYRTYSLGLSIQF

SEQ ID NO: 20847 - protein, 338 aa, Bacteroides thetaiotaomicron
MYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYENGDRAEAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVALGLVYEF

SEQ ID NO: 20848 - protein, 1932 aa, Bacteroides thetaiotaomicron
MFFRLVQGTGRLLGVQMANTGGTILSGASGELSLRHRRTRALLLSSALVPALAVGALLVPTAAEAACNNAINLFGNATLNCNSANGVGVIGTAGNNLTVNLTNGANVGGFGIVGTADNNIIVNTSGTTTSAGLLNGMSYTATNGDVTITNFSSTTSGGVNGLVIVADDQIDLTGFKGKATGVLGDGISATAGGDITADNFTAPASGSAPYISGLVNGMKLESDLGDISVKNFASSAQGGVTGINVSTKVGNINLSGFTGTSTGLLYDGIQAQTKSGNITANNFGANAQVTGLVNGLDLSASVVGNIKVNNFQGTATGTLGAGILAQTAQGDIEVKNFSGSATGGVAGLALTTDNGDLTVTNFSGTAKGTLPLVSSGLYGSADEVITVSTTGNANLSGALAGLNLVQGGDDVNVTLGGATQATGGPLGFGVLINSDSAATGNVDVNTAGGTTVSGGLAGIAINKTSAGGNVTVNTNGIVSSASGVGIGVKSVIDQTTTTSITSAGTTSGGLGGIFASTESVFGNATSTIDTYGPVSGGAGVAITGLATAQGGGKNATSTVEQYGVINNSAAGILASADASNIATTSVKVDNTIDVTGFGVTALASGKTGSVKVETTTAGVINAGTFGILAGASGDDFIVDVTTNAGITAGSQGIIAGLAGDRGKVTVVTNDFINAGSQGIAAGILGDKGTLDVTTNAKITAGSQGIVAGIVGDGGTVTVTNKAEIDAGGSGIIAFNTGGDTTVNVDQKISADGLFGAAAFAGGTGSAVLNVNAVIDPPIIGGAAVTFGSGLAQANVNANVQALGIGILAGNLGTGAVDVNINAGGTIQSDGIGVATFKVGDSGATTIDVDAAIGGLSGAATGGDGIAASAIGTSASSVTPITITTTANGTINAGDDGISVFHLSGGNVDITTNAAITAGDEGIQVLSGTFSTSNVTVTNNAAIDATDNGIFILKGGNGDVAVNANANITSALGNGIEANALFGDGNVTVAQAASTTITADDIGIIASKSFGDGNVSVTTGESSAIKAGLGGIVALKVFGDSATAGGDAVTVTTGKNSSILTAGVGITAGQAFGDGNVVVTTGEGSTIGSNPFVDTTAPVFAGIVAGKAFGDGNLSVTTGLNSIIFAQTNGITSAHLFGTGDNSVTTGENSAILAGNDGINVTSLFTTGATNVTTGTNSLVQALDDGIVANKFGGSGDLTVTIGATSAVVAVDDGIRVSNRSFGAGDIYVNVLGGTSIQPTVISAGDDAIHAHGWDNVNVTTGSYVQIIGDADQNGAGNAIRISDADIATISIGENNIVSGSGKSWSNAVISVRSDDATNITVGANSTVASWSFFNGDLITAASDIVIDTDVGATTINNYGTIIGRVGLTGNDDIFNNFSSNTWVTVGNNYFGGGNDTVNNPGRIVTALQGAVAETTSFYSLETFNNGDAAYVGAGLLDLRDEAPGQIAWNGARDVTYVSGVFNGVGNSAVGLDTFVGAAGSTSDILQVGGRDVNGNDIVGLVTPGQTQLVIHDVNTGAGAWNLAGIKVVDVVDPTGVTYGKNTPGETASFVISSASTNYSSKFGGVIDKGLFFYDLVAIGNDQYLVGLPDQEVFELPKLVTGAQAIWQETTGVWLDRQADLRTYLQGTTTTLVTKEGIKTVNGAPASVTPGVWGKVIGSWGSRDASDNYAAYGRAYGFDTGYNQNIYGFMAGADFGKEGVFNSNDAVVFGVLGGYVASDLNFSGSPSTANYTGGTVGVYATYLNNNWFLDALFKADFLSMDYQAPTLVGAGYFGQSPDAKNYGFVVDTGYRFYKWGTSGFVDGLATLSYVNTNISNLSIVPGTLVDFGNNDSLRGAIGARVGATAYDAATYRIEASLTGRLWYEFLGDNAVTIYNPGVPFTTVDSFNGLFGEVGLGLNYFAKDSGWNGFTNADIKFGESYVAGSAKGGVRYQW

SEQ ID NO: 20849 - protein, 912 aa, Bacteroides thetaiotaomicron
MKEHTFHYSPIALAVIFSVSHSQLFANQHQMANDHSAVLDEVVVTESHYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSVQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINLSLRNHVYEGDNILDGLVFNTRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFMSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSMLPDGFYSSVAYNRVKVKERKLNDSRLDSVNDPILDAIQPARYVLGFGYDHPEEKWGIGITTTYSKAKNADEVVGTRHHGIYRVDLGGKLTGSWYTHDITGYINYKNYTLRGGIYNVTNRKYSTWESVRQSGVNAVNQDRGSNYSRFA

SEQ ID NO: 20850 - protein, 75 aa, Bacteroides thetaiotaomicron
MGEDLLLANWNEIELFRADDYATNNNGSTGLNGGLNLGWNITNNINTTIMYRYYHNKLGADGYGDILIYRLAYTF

SEQ ID NO: 20851 - protein, 446 aa, Bacteroides thetaiotaomicron
MAQPDTSAKPSANLNTSIADQLGPAGDPGGYRAFLKSKGIEYSLTYIGEVLGNATGGARRGAIVEGRLDLQLDIDLDRLAGWRGASLHANAYQIHGTGLSRSYAGNLITVSAIEALPSSRLYEAWFEQKLFDDQLALRIGQLAADTEFAVSQTGTLFINSTFGWPNIMAAILPSGGPIYPLATPGARIKYVPSRNLSFQAGIYNGDPAGPDRLGLVPDPQRRNHTGTSFRLTDPPLVIAEMSYAYNIEKGASGEPGTVTLGGWYHVGRFNSLSLDTAGRALADPEATGNGRRFRGNNGLYGIIDQTIYREPDDPNDGASMFLRLSGSPGDRNLLDVYVDAGIAYKGLFPGRSDDTLGVGFALSRFSPAARRADLAAIALAGVAQPRRSAEAVLEATYQAVLGPGVTLQPDFQYVFKPSGGVLNPRYPEFGRVKNAAVFGLRATIRY

SEQ ID NO: 20852 - protein, 212 aa, Bacteroides thetaiotaomicron
MKNIKLTVAVFCAMGAFAMAGGDIAPVEPVEEIPVVVSSDAGFYVGLAYAAVHNEVAISNGRYGDVDYHGYMLQAGYKFNPYIAVEARYWDTKDDKITTTHPTGGTRTLDAQFDAWGVYLKPMYPVTEALDVYVLLGWGHQDSQHGPYNPKDSSFSWGGGASYSLTENISVFADYVRIYDDTAIKGNVNPFGEIIDVDVESSSWNIGLSYKF

SEQ ID NO: 20853 - protein, 390 aa, Bacteroides thetaiotaomicron
MRLIFTGVLCLLTLNAQANVIQYFAGISYNNPADLFKVKNGILLVGGTGSYADLQFKGSALNFNTFQYDSGVNHSRTYIVWPYGRVAKRLNDKTVVAVDLTEPFNSNLDWGNDAFTRYAATQNYLTDVDLSPKISYAISKKLQIGGGINFNVLLKNEVNWAFPTGQSTYANLINRSSSFGVGYNLGINYAVNDTNFLGITYYSRIRQNTSGTSYLGLAANPDFQFGFYMPATTVASYVHIFNPKWLINLQVFQSEWNANQKVRLYNTAAPPPFTNFIFDMHFDASYAYLAAIRKQVSDKLGIALAGMIDDGPEEDGLRTIVFPSDTQYFLGLIGDYRFTEHASMELILGHVYSNPSIQNKAKVNNVPVPFTTGRVTINANVLDLKVKIEG

SEQ ID NO: 20854 - protein, 775 aa, Bacteroides thetaiotaomicron
MKRTVLARLIGREVQRNVMRASILSLFTVPLAMAEENTEDVNVELTPIVVEGTKLSRYEFDEAESATGFVTDIDDVPRTIQVIPEQLILDQNAKDLNDVLSNSAAVTRSDGFGGAETEVNIRGMGNEYLFLDGSPVSTRYNIDVANIESVEVVLGPASILHGQVSPGGLVNVVTKKPQEESAHSVQIDADEYGKQKLTLDSTGSLSETTQYRIVLSGEDTETYREVTTEDGTFNTERKSLTVSPSLTYTPDDQNTFTLRLNHSEQELPIDRGTVMVDDGSGDLSIADIPYERALGSEYDIRDTTDDLLQFDWDFELDNGWTNKFKVGYYEKELDDYQTRGVAGLSDGTSLTAGSSVTDILTNNSDINLSSVQSNNLLLRRTDSNEMELSDTFFSDSLTGDYELGGLDNTLYIGVNYHSQKVDETDGIALVDIGGGTYAINADIIDITDSVSASNSKLTTTDISNSDTTTDELGLSIQNLTYVTDRLNILAGARYDYYKIKGDYTSYYTTSNSLTYTEVSDPEAVEINSSNSHISGQLGATYEVSNDVSVYASYAESFKPNFPSVTEGVYSGDFDPETAKQVEVGLKSSMLDDKLRLSVSAYALERKNVATVDGSLNTVLNGETETSGVDVSGSMQFLEGLNVLASYSYMDAEIIESDDGDDNGNTPYNIPDHKMRLWGSYEIKGGDLAGLGFGMGSEYVSKRYGNDTNTFSLPSYTVYEASVWYYLPLADETQLRLNAGVKNLTDEVYYTASGSNTYRISQGDPRTIYATARIDF

SEQ ID NO: 20855 - protein, 779 aa, Bacteroides thetaiotaomicron
MKKYLLVLVGLCCVLSYALAERPDYPELKKSDANIIGHVLDKKTKEHLPYITIALKGTTIGTVTDATGHYFLKNLPEGNFILEVSSVGYKTVTRNVTLKKGKTLEEDFEIEEDAIALDGVVVSANRSETTRRMAPTLVNVVDLKLFETTNSSTLSQGLNFQPGVRVETNCQNCGFQQVRINGLDGPYTQILIDSRPVFSALSGVYGLEQIPASMIERVEVMRGGGSALFGSSAIAGTINIITKEPLRNSGQLSHTITSLGGSSSFDNNTSLNASLVTDDHRAGLYIFGQNRYRSGYDYDGDGFTELPKLKNQTVGFRSYLKTSTYSKLTFEYHHMQEFRRGGDMLNRPPHEAHIAEQLQHSIDGGSLKFDYFSPDEKNRLSVFASAANTDRDSYYGPGNDPLKAYGKTTDLTAMGGAQYVHTFDKCFFMPSDLTAGLEYNRDRLKDNMWGYNRHTDQTVNIYSAFLQNEWKNDRWGILIGGRLDKHNMVDNVIFSPRANLRFNPTQNINLRLSYSSGFRAPQAFDEDMHIENVGGTVAMIERAKDLKEEKSQSFSVSADMYHRFGAFQTNLLIEGFYTRLTDVFVLGKPYDRGDGILVKTRSNGPGAKVMGLTLEGKVAYLSILQIQAGLTLQRSRYDEPHKWHDDAPAEKKIFRTPDTYGYFTATCTPIKPLSIALSGTYTGRMLVQRMDITAENAELGKMPERKAEAIRTPRFFDLGVKLAYDFKLYKTVDLQLNGGVQNIFESYQKDFDRGANRDSGYIYGPSLPRSFFAGVKISY

SEQ ID NO: 20856 - protein, 807 aa, Bacteroides thetaiotaomicron
MKKYIFFVVGVMCTLLSHTVYAIDLNKSDANIIGHVLEKKTGEHLPYMTVALKGTTIGTMTDGTGHYFLKNLPEGEFTLSVSAVGYKPQERKVTLKRGKTLEENFELEEDMVALDGVVVTANRNETARRLAPTLVKVVTPKLFDMTNSHTLSQGLVFQPGVRVENDCQNCGYSQVRINGMDGKYTQILIDSRPIFSALAGVYGLEQIPANMIERVEVVRGGGSALFGSSAIAGTVNIITKEPLHNSGSFAHSISNFDGSSSFDNNTTLNLSLVSSDNKMGAYIYGQNRHRSAWDSNGDGFSELPKLKNQTVGINAYYRLNPYSKLNLEYHHMEEFRRGGNRFDLPPHIAEDANLNGSGKPGLVEQIEHSINTGGLKFSAFSKDQKHSFNAYASAQHIVRDSYYSAYGHTTDFTGVLGAQYIYHFDKLFFMPSDLTGGVEFNHDNLDDKATDMQKYRDAALAEDPTATGDRLQQLIDKYTPDPLKQIVNIASAYVQNEWKSEQWSFLIGGRLDKNSIMNKAIFSPRTNIRYNPTQDINIRFSYAEGFRAPQAFDEDLHISNVGGELISIVRAKELKEERSRSVNASMDWYRYFGDFQLNMLVEGFFTKLSDPFVLTAPVEDPNGSGYLIQTRVNGSGAKVYGGTLEGKIAWRDKIQLQAGLTVQRSLYDSPEEWSADKEHLSDKERYSDRILRTPDVYGYFTATFNPTKALSVALNGNYTGQMYVPHLMSEVDGTADLLVKSPDFFELGAKVAYDIDFSGMCLQFNVGVQNIFNSYQKDFDKGATRDSGYIYGPGAPRSYFAGVKLSF

SEQ ID NO: 20857 - protein, 388 aa, Bacteroides thetaiotaomicron
MKPTALSILSLAALATAASAAHAQTSVTLYGTIDTGITYVHNASGNNSLWSLGNTSAGNLSGTRWGLKGSEDLGAGMKAIFQLESGFDPNTGKMGQGSRLFGRQAFVGLSQDQYGSITLGRQYDPLIDLVQGITADNYFGSAFATAGDVDNYDNSFRVNNAVKYTSPVFAGLQFEAMYSFGGVAGSTGSEQSYSGAVAYNNGPIGLAAGYYYTTNSPASQGLRTTWNSTSDGTFDGPVNLGYQTAHSIGIARVAGQYTAGPFTFGLGYSNAQYRRDDSSVFGSNERYNTGQGFVNYQAAPAILLGVGYSYTHSNGDTSATYHQVSLGADYTLSKRTDLYMTAAYQHAGGQTRDATTNTVADAQASIGSYGYAGTSHQEMVNLGIRHKF

SEQ ID NO: 20858 - protein, 914 aa, Bacteroides thetaiotaomicron
MKQHRIICIPTLTFALLLMFTPSILQAQDKPVFPIDSLITVGYATGNKKNISGSVEKITELGMNKDQITNPLEAIRGRVPGLTIQKGTNGPAALDAVRLRGTTSLTSGNDPLIIVDGVFGDLSMLTSIYPTDIESFTILKDASETAQYGSRGASGVIEITTKKGIRGKTRVSYNGSFGISSVYKNLEMLSGNEFRNLARQQGVAILDKGNETDFLKEIEQTGLQQNHHVAFYGGTDASSYRVSLGFMDRQGIILNEDMKNFTSNMNMTQHVFDDFLVCELGMFGSIQKNHNLFDLQKTFYSAATFNPTYPNHRNPETDSWDQITNASQITNPLAWMEVKDHDATSHISTHARLTFNLFRELKLILFGSYTYNIVENSQYLPTAVWAHGQAYKGTRKMESLLGNLMLTYKKKWNKHYFDVLALAELQKETYSGFYTTVTNFNTDQFGYNNLQAGAIRLWEGTNSYFEQPRLASFLGRFNYTFADRYIFTVNARTDASSKFGANHKWGFFPSVSGAWVVSEEKFMKRIPLVDNLKLRIGYGLAGNQSGIDSYTTLNLVKPNGVVPVGSSQVVTLGNMRNTNPDLKWEVKRTFNAGVDLGMFGNRLLFSLNYYNSKTSDMLYLYNVSVPPFTYNTLLANIGSMRNSGTEIAVGLTPLKTQDMELNVNVNVTFQQNKLLSLSGMYGGENISAPEYKSLASLDGAGFHGGYNHIVYQMVGQPLGVFYLPHCKGLIADGNGGYTYDIADLNGGGVSLEDGEDRYVAGQAVPKTLLGSNISFRYKRFDLSVQVNGAFGHKIYNGTSLTYMNMNIFPDYNVMKKAPGRNIKDQTATDYWLEKGDYINFDYVTVGWNVPVAKWKKYVQSFRLAFTVNNLATITGYSGLSPMINSSTVNSTLGVDDKRAYPLARTYTLGLSINF

SEQ ID NO: 20859 - protein, 1074 aa, Bacteroides thetaiotaomicron
MTEFNSKIKKNSRILKIFMFSIYALFACAISSHAQSLVKGTVTDGIGEPLPGVSVVVKGTTNGTITDVNGKYSIQATAKDILSFSYVGMSDQEIKVAGQTTINVVMKDDVAALDEVIVVGYGTAKKQSLTGAVSAVKGDELLKAPATNVSSLLGGRLPGISSVQVSGEPGDDQATLRVRGSIYNVTYIVDGMPRSINDIDPNDIESVSVLKDGASAAVYGLKGAGGVIIITTKKGQEGKSKITYNGSIGASMNANFPQFMNGPQFAYYYNMADMMDKMANGSISNISQYNPVFTKANVEAMLNGDPTDGWDNVNYIDKVFGTGINQKHNVTIQGGSDKMRYFASVGYLGQKGNIDNFSYKRYNLRTNLETQLAKNFQLSLGIAGNVGKRETPGYASGGTDSNSELGEQGWLSVAHQTIMMHPYLPETYDGLYTATTQNNTSLPNSPLAAIYESGYKHTNSFDLQTNISLQYNVPWVKGLSVKVTGAYDYTTSHNKNLNTPYSTYIHKMPTSTADWTWSKADDPRGTANGINLGEGQYSSHQMVGQGSINYASSFGKHNVEAMVLAEIRDYKENSFSGYNKNMSFSELPELSFGQPADSPISGYSDANRSIGYVFRLKYDYDNKYLAEFTGRYDGSYKFAGNVSGKRWAFFPSASVAWRISKEDFMSSLTFLDDMKIRASVGLLGNDAVSPYAFLSTYNLMDGNKNAYQTILNGKVMQALRASVIANPTLTWENTLTYNAGFDFTMWNGLLGMEFDAFYNYTYDILTAMGGDYPPSMGGYYYTYANYNKVDSKGVEVTVSHRNKLNLAGKPFSYGASFNLTFARNRYLRYPDSPNTVEWRKRTGRSVDASVVWVADGLFRSEEEIDNSAWYGTRPNVGDIKYRDLNGDGKIDEDDRTRVGRGNRPELTYGLNLNCAWNGFDLSAQFTGGALFDVSLTGTYYNGYDDNTVWTQAFKEGANSPLYLVQNAYTVENPNGTFPRLTLGNQGHGGDNGLASTFWLRNGRYLRLKSAQLGYTFPKRWMSPVGIQNLRIYVEGSNLFTISGLPDGIDPESPGVNNGYYPQQRTIMGGITLTF

SEQ ID NO: 20860 - protein, 187 aa, Bacteroides thetaiotaomicron
MMSDFALNTSGSKRAKRGAGKLGVSLALAGALLFGSSAAVTAQAQGTKIGFVNTERILRESGPAKAAQSKIESEFKRRDDELQRLSSSLRSQAEKFDKDAPVLSESDRVKRQRELSNLDMDLQRKRREFQEDFNRRRNEEFSSIVTKANDAIKRIAEQENYDLIIQDAVTVNPRIDITDKVIQSLGR

SEQ ID NO: 20861 - protein, 191 aa, Bacteroides thetaiotaomicron
MKNFIKPLAISITSLGLVFTGASYANDVNEGISPYIGGSYGRIDVNNDDFGDDDDAAYSIYSGVKIGPIFAAQLGYVDFGGTNNDFFSTNTTGIELSGLAYVLNTEMVDVYLRGGLLFWDAELNSDSFNTDNDGNELFWGVGSDINLTENLSLRLEYARYNVEYEDDEFGPLADGTEYDLNHLNAGINFSF

SEQ ID NO: 20862 - protein, 788 aa, Bacteroides thetaiotaomicron
MNMPLSAHRASRLPDLPRLRRRAGLTLCFGSALASLSVPVWAQAETATPAAAASSAAPAGASPDADTVKLAPIVVVGTTPLLGIGTPLSQVPANVQTVHAQDLEQQHRSTLTDYFAKNLPSVDIADAQGNPYQVNLNYRGFTASPLLGTPQGLSVFVDGVRVNEPFGDVVNWDLLPQQAIDTIQLIPGSNPTYGLNTLGGALAITTKNGKTSPGGEAEVQVGSWGRKTAQIEQGGTIGQNLDYYVTGSMANDNGWAEQNASRVRQAFGKLRYTDADTTLSFSAGGADNDLHGTQTIPRSFLGNPKQPYTYPDQNLNTAAYATLSGDHYFNDHVELSGNVYYRHFRNDNVSSNTNSDFGSVDDDGNVDTTQATNEKSIVSTDSYGASLQLTLLGKLGGMENQFVAGVSADIANSRYTQSSQDAVFTASRATIGIGDFEQETAAKTHNGNYGIYLQDTLSLTKQWTLTLAGRYNWADATIGDSSGTQPQLDGHHTFSRFNPAVGINWNPTSAFTAYATYNEGMRSPTAIELACADPSAPCSLPNDFVSDPSLQPVISKTFEIGARGRIGQATTWSAAAYSTTLDNDIEFISTNGATSNQGFFQNVGRTRRQGVELSGHSQFGPLAVTASYSYVDATYRSSWTESSPSNSSADQNGNITVKPGDHIPSIPANTVKLQLDYAATAKWNVGTNLTWRGSVYAQGDENNQDVNGKIAGYLLIDLDTSYQVTKQLQVFASVTNLLDKRYASFGALGENFFNGANHTFDGANPINEQFVGPGAPRGFWVGLRYAWK

SEQ ID NO: 20863 - protein, 647 aa, Bacteroides thetaiotaomicron
MFKPLAVAVSLGCAALSSGANAYQYGEYAGETLERLITDYPGRYRGTASFAGATELMQSRLGFGYQTSRQDFTWAGNRSSQNVIASAPGSSGKVLVLGAHYDTYYGRPTLQGLDDNASGAAVLTEIARNLGGIALENGLEVVGFGAEEEGLRGSRAYVESLDASQRANLLGMINLDSLVTGDRMYAHAGSNSVANPALGAYREQILRIARELDIPLFTNPGLNAEYPAGTGCCSDGESFNGMDIPVLFIEATNWELGDLDGYEQTDNPAIPGGSTWHDPAEDNKEVLTGAFGQERIDQRMRDFSRLLTRLVLELTNADLLASTASGGALARQMEDQLQRQHQALTRLHDRRWLTLLGSSRPVGSFDGEVGAEGEVSPDSGFDMPGDPESRRAGVHLLGDYRYSEALTLGASLAFQRSRDKLDHGGRIEGDTWQLGLFGLYHDGGPQWLAGELNLGHTRYDSKRPVYLQAAGGPVLLDQRLSGDTSAWSWGARLEGGYDFSFGELRSGPLAGLDYMRYRIDDFREDEALRTALGYEKQDYDSLEASLGWRLRGELALGARMRLQPYASLRWVRELADGRLDDIDLTSRGDGRIRVADMGDVDKDFGRAQFGAQLAITEQLGIFAEANSRFAHSEGNQAGYSLGVNWQF

SEQ ID NO: 20864 - protein, 914 aa, Bacteroides thetaiotaomicron
MRNHYTFKIKPIAIAIGIAGGSSTTVLAQNNSLEEVVVTGIRASLQQAVDIKREANGVVDAISAEDIGKFPDTNLAESLQRITGVSIDRSGGEGRQVSVRGMGPSFNLVLLNGRQMPSKESGRAFNFDEVAAEMVSGVEVYKTSSAAVQSGGIGATINIKTARPLDIGDKMAGSVKLSSDLDAGGTTPQASGLFSKNLDDSFGILLAASYQQRESQEDQLRVTKWNVDPDVSGVANFDNSANTNNHIFVPQQSAFNRRQDTRTRINGNLVLQYAPSDTLTATADLQYSDFKIDRYAEELALWFSQNTAQSIVTDKNGTVVAYDQGASTIDFFTKAPTSRTVNTSASLNVDWAITDAAKLSVEHSASTSESNPDGEYNINQSDVQIAQNWGFAVSGDLAFPVFNSDATATPSVQDPSRLRTWVNELYSNNYKDEINQTRADFTFDDGGSTTLAAGVMFTDQTKTISNISNNLSWDDFAWDTASGYGQQDVNDADYTWVALDSGFMDQFSGSADLRALNLGNYSFDPNAVRAAWLADAGAPADHFEPTFQNSSFIINEKTTAAYFELTTATDFAGKDLTLVAGARYESTAIDSTGVEASLTLLTFTDPEENMTTTFSAEDFFTASAGYDVLLPNMSAKLALNDDMVVRVAASRSLTRPSLDKMTPVRTIATTRPGLLAGSAGSPDLKPFIADNFDLSLEWYLNEVDYISAGFFLKNVNNFIVDGVLTETINGVTDPSTGTDPEGPDAADQLAEFEITRPVNGEDAQLHGFELAGQHAFGDTGFGTIANLTLVYTDSDYNVDDVKQTFAVTGLSHSANLVGYYEKGPFQARIAYNWRDEFLQRFGQTSQATTEPTIVDAYSQIDLSASYDISDNVSVFMEGINITDQGNRSHGRYANQLVEATTSGPRYAVGVRAQF

SEQ ID NO: 20865 - protein, 731 aa, Bacteroides thetaiotaomicron
MVIIFKRSSLCLAMFCIYQQSSAEMTPISKKTSVEARSDTSITTSSINNKAETKVLSFTAAPIIVTAETLGDSSANQVKAFAGNRTVIDNDFIKKTVSNSIDGALQFIPGVKIDDETGTGVLPNISIRGLHASRSGQAQFLMDGIPLTLAPYGHTGQSIFPATLDNLERIDVVRGGAATQYGPNNVGGVINLITKPIAKETQTEIGTNLTVFEQNGKPLTSLYARHSRWLNDDFGVQLEANGIKGDSFRDHSDTEVTNLQAKALWYIDDNQKLEGFLQYYDADTEMPGALSPAAYEQDVGQSQRPLEAYQGKSTRWHAKYKNYLDIGDEAVLDLTTFGHHATRNFEWGFNSQANKQGVHWADPAIAADSLRTSPREFTVYGVEPKFSMKIGDSKNIKHHLISGVRYVNEDIDYKLTQTKLADGTTTMPRDWNLQTDAWAAYVSDEISFLDERLKVTPGIRYENAKMTFNDAGNNTQADNTITEWLPGLTTSYSLTKSDDKLWLIYANAQKSLRTPQIANIRGNGEEGSELAWNYEIGTRYTTDSLQANLGLYRIDFKDQLQWNSAEQSFDNVGRTLHQGLETAITYAPKTFKNLDVGLSYNYLDAMLKEGADEGNQLPYSSPHQLGWHASYKHQDYNATLSGVYYDKAYADNANTVAESKDGGIGETPAYQVWNLSLQKTLQDTKNEKLSVQFGINNLFDEQYYFRGVDTSPVGRYPAPGRSYKLGLNYQF

SEQ ID NO: 20866 - protein, 247 aa, Bacteroides thetaiotaomicron
MRKSILALSIFAAAAAVPAQAEYLYGWGDVSVNYLDWSNGTEDRNGGFKNDFMFLELEGGAGFTWGELYGFADFEFQDSTPAGDSAMAMSTKGSIAVKTGLEELRFYAQTYSTENQGFHARNTVAGLSYNFSGDNWYFNPWVGFHYTNTVDFADMNGGMAGWVAGYNFNLGEQKFSISNWHETEFARKDAYLATNGETDDLSYNGALAAWWHATSQISTGVQYRYAHNKLGQPQTDNAIIYTVKYNF

SEQ ID NO: 20867 - protein, 1147 aa, Bacteroides thetaiotaomicron
MNNLLICKGISKNSCSFLAFLLFTFILIAPAAAQTLKEHDITLRVQNEPVESVFNKISKQTNFKFLYDQETVNKAPRVSFDIKNASLKQILGEITSQAKLYFNRTDHTIAVSKQPLKKEETAQRARTIQGIVADDKGEPVIGASVQIKGEGSGTITDIDGRYSLMNVPESATLTISYIGYKTVNISAKDKNTAKITLVEDSKMIDEVVVVGYGVQRKRDVSTSISSVKAEQIADVSASDFRQALAGKMPGVQVTQPSGDPEGSVSIRVRGISTVNAGSDPLYIIDGVPVERGFANLNNNDVESVEVLKDASSAAIYGSRGSNGVIIITTKQGQSEKMKVQYDGYYGIQSVSKKLSMMNAYQFAEFAKDGHDNAYLDANPGGSPDDPNGMRPNSWERIPTELFPYLNGDKGLTDTDWQDAIFRTAATTSHNVSISGRGKTVGYFISANYYDKEGIIINSDFKKYSMRMNLDGKYKRLKFGLNFSPSYSTSNRVDASGSNGIVQSALMMPPVWPVYNADGSYNYQGNGYWRIGNDYQHNAVLNPVAMANLQSDVVDRMAIVGKVFAELELYKGLTYNISFGGDYYGSHNDQYRSSELPLLGQKYYDVKSNPTAYSSSGFYFNWLVENKINYNTTIKDAHSINVVLVQSAQKETYKGDNVTATDFPNDYIQTISGGTVTKGASDKTQWTIASYLARMQYSYKGKYMASAAIRADGSSRFGKNNRWGYFPSASLAWRISGEDFFMKAKCLSFVDDLKLRASYGVTGNFQIGNYDHLSLMASDNYILGTGNGQLVNGYKPSTIKNEDLSWEKNAMVNVGVDLQMFKGLLGLTVDYYNTNTSNMLLNVPVPHLTGYSTALMNIGKVNNRGWEVALTSQKNITKDFGYSFNANYATNTNEVKALGPGNAPIISTGSVDHAYYITKVGEPIGCYYLLVQDGIFSNEEELKKYPHFSNTQPGDFRFVDVDGDGVMDLDKDRTIVGNYMPDFTYGFGGKVWFKGFDLDFNFQGVYGNEILNLNRRYIDNLEGNTNGTTIALNRWKSPEDPGNGQVNRANRKSKGYNGRTSTWHLEDGSYLRLQNVTLGYTLPKNLTQCFFVEKLRVYVSGQNLWTSTNYSGYNPEVNARPSNSLSPGEDYGTYPLAKTFLFGLNITL

SEQ ID NO: 20868 - protein, 732 aa, Bacteroides thetaiotaomicron
MKRLLSIAIAAASANLPLSALAEDRPMEHVIVSVPIHKQEADTALPVTIITGDELRRQAAATIGETLSNRAGIANATYGPGVGRPVIRGQQGPRAITLQNNILSADVSSLSPDHAVTVEALLADSIEVLRGPSTLLFGGGSIGGVVNVIDNRIPRAPIDGVQGAVEYRYDDVSAMDNGTARLEGGDGRFAFHLSGTIRKTDNIDIPGFAIDEKALEQQEELLGHHDEEGHEEEGHEEEGHEEEELENTEGFIANTDSETDVITGGFSLQFGEGNWAGFSASHTESEYGLPPGTHEHNHEDEHGDGEHGEDEDDHEDEHEGEHEEHASEEEAEEFIRIDMKHTRYDAMLHLEQPAEWIDSIRGFMTYTNYEHKELEGIEVGTLYARETWETRAEVVYDALLGTEAVAGLQARADEFEATGVEGYVPKTDSSEIGLFLIEDFHRDSWTYETGLRVDLVERDPDTQAAGKENFSSVSVSGSALWQFSDSWQAGISLSRSARAPATEELFANIEAMDTEALVPHPATGAIEVGDADLGEEVSLNVDLVLKWYSERSWAEVSLFYNSFEDYIFLMNSGEEVDEVPVYRYEQEDAEFVGLELESNFHLTDLGSGALFLGIRGDIVSGEFDSSGDVPRLPPMRIGGKLSWTGDAFSTWVSVLNASDQQDPGNVETETDGYTRWDIGADYRFRVTDDSDLLVFMKWKNIGDEEIRLSTSFLRNYAPEVGESIEAGIRFTF

SEQ ID NO: 20869 - protein, 736 aa, Bacteroides thetaiotaomicron
MPQPPKTLLPLGAALMAGGLSISAFAAEGDDYPKKTPVLPTIKVEAGAEAEKDGYRATTTRVGKTLQDPHDIPQAVTTVTNQLMEDQQVSSLKDALRNVAGLTFNAAEGGRSGDNMMLRGFYTFGDIYLDGIRDTAQYNRETFYLEQIDVLRGAGAMMFGRGQAGGVINQVSKVPHLGDRGKITGSVGMYGYYEMTGDFNKQITDTIAFRFNGMKRFDGGWRKNPAANDRPTLERDGVAASLGIGLNTDNELILSHIYTTVDDKPDYGVNFDSTTRKPQEKFPVKYYWGTNSNFDKGTVNISTATFTHHFSPASEWRTQVRYADYERSYWARTPSLTIAPNAEGKVCNTPTSCNGGPTRTMNYKTITVQTDYNHRFHLFGMNHDFLLGGEYLNEDSFRHSLQNFSGTTSANPPLFRPYKANSAGIPVEFNSDTYAVYVQDTVEFIPKWKLTLGGRRDEMRATYSSATSPKLNYGQWSTRAALSYHFSDQSHLYMASSSSFSPTADLYQLTVQPLPPERSNVKEIGAKWLLFDGDLALRTALYHAEKKWERNTDLESTAAILTKKRRTNGIELELAGRITPNWEVFSGLALMDPEILEVAENVNATTGVLTSANPEYKGKRPRNTPPYTFNLWTTYRLPYGWKIGGGVEVKGKRYGYNPSGAGPIPTLPGETKFHPNTAPAYMRWDAMVAYEQPKWAMRLNVQNVFNTTYYDAIYDNGPFTIPGQRRRVIMTAEYKF

SEQ ID NO: 20870 - protein, 699 aa, Bacteroides thetaiotaomicron
MSALRRIAPQKSPMTPLPTRRHLLFVSLVAAFPAAAQEASLLDAIVVSEKRALYRPEKAAGATRTQTPVERIPQAIQVVPRSVIDEQQLTRLVDVVANVSNVQPGGTQGNRSETFVIRGFEASSYAVDGILLNPAQNFTETVRDLANVAQVEVLKGPAAVLYGRGEPGGVINLVTLRPDAVFGGNASVQVAEHGLRRVQSSITGPLSPTLSARLSAAVQQTGSFRDAQADGDRVFVSPSLAWRPNERLRADLDIEYTRQTSPGDRGLVAIDGVVRGPAQRSFGEPWSRNRGISRTARGRIEVDATDWLTLRQIVNHQDGDSGRGVADFTGFSADRAFLQRRAVRQDQQVRATTSQTEALARFDTGPLRHQVLAGAEYVDAHRHTDEARAPLARISVRTPVQGALPGTYVPAREIAVDARYAALYVQDQISLGERWDVLAGVRWDDVQQTTLDNGSRTREDGRRASPRLGVVWKAAPQLSLYANTSTSFRPRSASVFAGGSAPPETGRQYELGMKSALLDNRVLATVAAFQITKDNVATADPNNDGFVLVTGQQRVRGLELDVTGELTPNWRLILGAGYLDAQVTRDTVIATGNRLRGVPRVSASLWSTYHVASGPLYGLTLGAGAVHVGEREGDLANSYRIPGYTRFDASAAYRFGGRYQLALLLRNLGNRFYIEQPVTQTTNYPGAPRTLSATLSMEF

SEQ ID NO: 20871 - protein, 141 aa, Yersinia pestis
MEGLSMDQVVIFKQIFDKVRNDLNYQWFYSELKRHNVSHYIYYLATENVHIVLKNDNTVLLKGLKNIVSVKFSKDRHLIETTSNKLKSREITFQEYRRNLAKAGVFRWVTNIHEQKRYYYTFDNSLLFTESIQKTTQILPR

SEQ ID NO: 20872 - protein, 619 aa, Yersinia pestis
MILLLWTFAMLGYNPVPQDTLLLEEVAVYAPELDRFSQGQKVQAWDSETLKEFQGRTLSDLLQERSPVFVRQYGAGMIASPSFRGTSAGHTAVFWNGIPINSPSLGQSDLSIVPIVAIDKASLQFGNAGALFGNEAIGGSVHLGSASSFSKGVHSSLSQQFGSFGKANTYLKGSFSNEKLSLSTKLYREFSKNNFTFKDLGQIGTPERKEDHAQVQQWGLVQDLAWNLKGNQQLKASVWFNQADREIQPVMGSTSHDQQEDQSLKAVLDYSIFGNGSVLQFKTGMVKDELIFNGGLSKTSQYFLGGDWDKAFSDKWTFKGGLRYTRVVAELSSYDKKDDRLEGYLSLKYQAKENLAFSTNFREVMYQGDLMPLTPSIGMDWGFWERGEHSLLLKTSIGKGFKIPTLNDRFWEPGGNPELLPEESWSGELGIDWKVEGDIQWQNGLTYYRMSVDNWIIWLPKGSVWTPENLKHVSNQGVEYQGSILGNISDWKWGLDWSYTFSRAVTTEGISENDPAIGKQLPYTPQHQANAKLRLGKGGISTYLSTYYVGQRAITADNPRLMDPYQLFDLGISFQNLRWGKVTLPISIQINNLFNTDYQVLYLRAMPGRSFQFNLSINL

SEQ ID NO: 20873 - protein, 670 aa, Yersinia pestis
MSAFRSLPFLALVLTAPAFAQEADEESDDVIIVTGEGLPETPAEPAYSVREIARDQIVTTPSGRIEDALGAVAGFQQFRRSDSRSSNPSAQGVTLRALGGNATSRALVTLDGVPMQDPFFGYVPFAALVPEQIGSIRVTRGGGSGPFGAGALAGTIALSSADIGALGPVTASALVNDRGGTEVFGGAAVRLGEGFVTASGRWDRSQGFFTTPVDQRVPATARAAFDNVSGQIRAVAPLTETLELQARVLAFDDRRTLRFDGADSSASGQDASIRIVGRGDWEVDALAYVQARNFTNVVISSTRFVKVLDQSNTPTTGIGGKLEVRPPVGENHVLRIGVDYRRAEGELQEQPFSAFTGELRARRRTGGATSDLGFFIENDWTLGNLVLTGGLRADRTAITDGFFREVSAAGLTTVDNVFADQKDWTVTWRGGALFRAGESLSLRAAAYSGLRLPTLNELYRPFVVFPVVTEANAALDVERLEGFEAGLDWAPVDGVAFSLTAFDNRVENAVANVTLTPTLRQRQNLPAIDAQGLELGARVSRGAFSFDGTLAYTDAEVDGTGASMALDGNRPPQTPRWAAAATVSWKPLENGIISLTLRHVGAQFESDQETDVLPAATTLGAFVQVPLTGGFSLILRGENLTDETIVTRNSDGAIDLGVPRTVWGGVRYGF

SEQ ID NO: 20874 - protein, 1042 aa, Escherichia coli O6
MLMKRHLNTCYRLVWNHITGAFVVASELARAQGKRGGVAVALSLAAVTSLPVLAADIVVHPGETVNGGTLVNHDNQFVSGTADGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKGKLQVNAGGKASDVTQNTGGALVTSTAATVTGTNRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGALTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFIQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRVRGWGWLGSLETGLPFSITDNLMLEPQLQYTWQGLSLDDGQDNASYVKFGHGSAQHVRAGFRLGSHHDMNFGKGTSSRDTLRGSAKHSVRELPVNWWVQPSVIRTFSSRGDMSMGTAAAGSNMTFSPSQNGTSLDLQAGLEARVRENITLGVQASYAHSINGSSAEGYNSQATLNVTF

SEQ ID NO: 20875 - protein, 1457 aa, Escherichia coli O6
MINGTTISAGQGVQSTVQQGGYTVANATHNYGMTSNGGSGLYVNYTLSALELLADGANALLLATESGLTANRELNAELSGVGGLVVDAQNGALTLANGNNRYEGTTTVTAGELILGANGAFGQTSLLNIASGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALLVSFASNMANLTSNVLITANGSLGGYGQVTGNVENYGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTEADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNRVSGQDLATEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQVNSQLNLWGNIGQQVGNKGYSETSVVLGVKYNF

SEQ ID NO: 20876 - protein, 1254 aa, Escherichia coli O6
MNMRIISLRKEYLSLLPSMIASLFSANGAAAVIDSCQGYDIKANCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEISIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGNTSYNRSVIFTDPQQHSEMDVTTDVDTRSATTGQGRNIEMRADGEIHVEDGVDTQWGGLMADSTRQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAVSLQNGVAGNTLTVNGDYTGGGTLLLDSELNGDDSASDQLVLNGNTAGNTAVVINPITGIGEPTSTGIKVVDFAADPTQFQNNAQFSLAGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQGDSRSNMTGTRADNQNHGYAVGLTSSWYQHGNQKQGAWLDSWLQYAWFNNDVSEQDDGVDHYHSSGIIASLEAGYQWLPGHGVVIEPQTQVIYQGVQQDDFTAANHARVSQSQGDDIQTRLGLHSEWRTAVGVTPTLDLNYYHDPHATEIEEDGSTISDDAVKQRGEIKVGITGNISQRVSLRGSVAWQKGSDDFAQTAGFLSMTVKW

SEQ ID NO: 20877 - protein, 1758 aa, Escherichia coli O6
MCFFLGSRLAYAENIDGSSTISNRDISGSLNIGINKDANIDINGTVNIKDYFSVATCNGQSSTCPEGGLNASAKIDKSASVGASVTIVGDSSKGELNIDGGSTLYTQQLWVSGNDNDKTSNVSDDSNGSLSINNGSNVFVVSSQDDTPFKTNSVKWNQNIISQGNNITDGTVSSGDLVLGKTGNGIIDIDNNSKLDVKNDVVVSTGVDGIPNEKPSEINIKNESNFSVHGDMKGGISAAGKLNLNMDNSSNLHVDKNIAVGIGRESNITVSASRESSIFSDGNFTVATGNNSNANLKLDASNLSVNGVSTIGSGDGSITKFDIKNGSVVTSSSDMTLAKGKGTQANINISSSELNTGSLSVGEGDNADVKMTGSGASVSSKKTFTVAKGNNASATLNYTGSKIDIGSGYIGEGESAKTQLELNNSALTASGKVFIGQGNTTQTNLTLNDKSSVNVSGEMSVAQGSSASVDVTATNAVLSADSLSLGGGEAAKVTMTGSGATVSSKNTFTVAKGNNASATLDYTDSKIDIGSGYIGEGEAAKTQLELNNSALTASGKVFIGQGNTTQTNLTLNDKSSVNVSDEMSVAQGSSASVDVTITNAVLSADSLSLGGGEAAKVTMTGNRATISSGNTFTVAKGNNASATLDYSDSKINIGNGYIGGGEKAQTVLTLKDSALAATGDVIMGQGQETQTDLTLSPQSSIKVSGNMSIAQGNAASAKVIVDNADLSANSMSIGEGDTAAVTMTGNGATISSGNTFTVARGNNASATLDYSDSKINIGNGYIGGGEKAQTVLTLKDSALAATGDVIMGQGQETQTDLTLSPQSSIKVSGNMSIAQGNAASAKVIVDNADLSANSMSIGEGDTAAVTMTGNGATISSGNTFTVARGNNASATLDYSDSKINIGNGYIGVGEKSHTLLKLDNSTFHAAGNIDIGKGSSTIANVSVGAGSNMSIKGNASIGVGDQAKAKFSVKDSVLNIGSSLVLGQGNSTEAEMSVEHSQLYSGGLLLGTANNAVVSMSANNSEISVVGDYTVAKGDGSEATLIYKNSDINLGNGILGAGSGVKTDLSLDNSKFVASDGIIIGKGDNAITNLSISDHSVFKGERINIGNGSYSKNSISITGNSIFDFGSSQESTIGEGDYSQSLVTINDASVYGDGSLTLAKGNNSFAVLNLQDNAVTNANNISLATGLGSKAIVNVSNMNSGQFNPVSMGAGDGYAEVNFDGVNGYTLSTNFICMDSGSCADTVINVNRGTVSLSGTNDWKGQINVYDGTRLDARGNDAVDGILNVSKEAQVDFNGYSQHMTGIDNKGMIYLSDGSASSDVYLDKDYVAHDGSGVQFGIFGQKEADVMHVKGDTSGSSGIVVTTNSKNKIKKGGDILLVEVNGDSSGSFYLNSLIKNGKEYKVTGDYIDVGAWEYALNKKRKNWYLSVDMRPEPGAFINNSKSMLDMFALQRYDIPGQHRYPTLFENLYNNGMWIQFNNNSGSNSEVYDNLKTSYSLNTMMIGGDIYNWTDGYNYSHIGIMGGMGSAANKTTSTNNKRATGNVDGYTLGLYHVFQQNISDGLNESERQGLWTYSSIQYMDYDNSVSSTNNFKANYGVNGFRLTGEVGYLKNIGGIQPSDFYVEPKLYLSHTELSGGVVEDLQGGKITYPNSLTIIEPGVFFSYRKTHESTSNDEAMFKDYIKQSVVDAWFGGGYSFKTGNYSRTNFDSDMVEYNTSDNFALKSGVEFEFLKDARLLLTSSYSINNDRNLSFILGGNYYF

SEQ ID NO: 20878 - protein, 301 aa, Escherichia coli O6
MKKLLLCTALVMCAGMACAQAEEKNDWHFNIGAMYEIENVEGYGEDMDGLAEPSVYFNAANGPWRISLAYYQEGPVDYSAGKRGTWFDRPELEVHYQFLESDDFSFGLTGGFRNYGYHYVDEPGKDTANMQRWKIAPDWDVKLTDDLRFNGWLSMYKFANDLNTTGYADTRVETETGLQYTFNETLALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 20879 - protein, 238 aa, Escherichia coli O6
MICVGSFVTPMWVYSSRFYNHNDGADMKKLTVAALAVATLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTAKYKSGVTTVKDSVRLDPWVFMFSAGYRF

SEQ ID NO: 20880 - protein, 190 aa, Escherichia coli O6
MNIWKTALAGTMLIIGTTATACAATPYVSGSAGIAMLEDSDLGSGFTWPYDTGLALAVAAGLDMGNLRLEAEVGYQDNGIEESDDLEINITTFMANGYYDLELPLNPVKPYVTAGIGVADVNAKGFSFDDDSSLVLAGQIGVGAGFAVAPMVNLDARYRYLMTTDAEFDGDPDKIGIDSHNVMLGLRIGL

SEQ ID NO: 20881 - protein, 375 aa, Escherichia coli O6
MSRSPVKDLTVLSRWRYSWRILDDNEAQKMKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 20882 - protein, 317 aa, Escherichia coli O6
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVESSDNDEHYDPGKRITYRSKVKDQNYYSVAVNAGYYVTPNAKVYVEGAWNRVTNKKGNTSLYDHNNNTSDYSKNGAGIENYNFITTAGLKYTF

SEQ ID NO: 20883 - protein, 352 aa, Escherichia coli O6
MKMKKSTLALVVMGIVASASVQAAEVYNKNSNKLDVYGKVKAMHYISDDDSKDGDQTYIRFGFKGETQINDQLTGYGRWEAEFAGNKTESEGGQKTRLAFAGLKLNDFGSLDYGRNLGALYDVAAWTDMFPEFGGDGLAQTDNFMTKRASGLATYRNTDFFGVIDGLNLTLQYQGKNENRDVKKQNGDGFGTSLSYDFGGSDFAIIGAYANSDRTNEQNLQSRGQGKNAEGWATGLKYDANNIYLATIYSETRNMAPISGGFANKAQNFEAVAQYQFDFGLRPSLGYVQSKGKDIEGIGDEDIVKYIDVGATYYFNKNMSAFVDYKINQIDDDNKLGVSSDDIVAIGMTYQF

SEQ ID NO: 20884 - protein, 930 aa, Escherichia coli O6
MAPSGTRLDDPTARHYRIPAGPLGASLGAFASRSGLLLSFDPELTRGRNAPALDGRYTVLEGLQRVLSQTDLQVMAGSTGAYLLVAPRRSGEAPAELSPVVVSAAELADPQKDTYSAPRSSVHLSSEDIDRFGRVSVGDLLKGVPGVQVGDSRNGGALDVNIRGIQGQSRVAVRVDGAEQALDVYRGYAGTQQRSYIDPDLISSVTINKGPSNKSGAIGGTVDMQTLGVDDILVDGKDIGVRFTGDVWNNGVAPQRRSASSKDEDLGATPHDDRGSLFGSQAQSGSAAFAYRNERLDLVAAYAHRNQGNYFSGRKGQDRYRVYDHRGREENSVATVYEAGEEVLNSSSETESYLLKATWRIADEHRLDLGYRRYDGRNGEIMPSDIFRLGTAGIYQYPLSEVKIDTYTARYHYLPEGNPLLDLNAGLWLTEAKTDTLTSVLAPRSQAYRPDRNWTRQDNRRIGGDLNNVARLATDYGDFKLDLGGSFQFEDLQPQKSVVTTLHDINAQRTLRDGSRQEYSLNGKLEYKPVERLTLWGGGRYSHFRSKDNGISATARREDRDVRFITVSRPDYYGSMMWFPDQNGEYTDATDPRLHNGIVTDNTNNPFEGIPFDEIGPAEVTVHPSAVTNVVTGYDYAGKRSSSGGGFAPAFGINFELAPDTFVYASYTQGLRLPSLFETSRGTLQVEPGKDLKPERSRSWEIGVSALREGLLAERDSAALKLAYFNNTIRNYITRYYDPSPGLMGLMTFSNTDSYRTSGLELQSHYDAGRLFSDLSATYYLKTETCDAAFAARLRASANQYRHTENTPDCTPGSFMGSYTNTQNPPRFSANLLAGLRFFDETLTLGGRMTYTSGPTATVDKPWQTGATTPQIEYRSVQLFDLFLNYKLFEHTELNASLQNLTDRYYLDPLAQSFMPAPGRTLRVGMRAKF

SEQ ID NO: 20885 - protein, 725 aa, Escherichia coli O6
MRINKILWSLTVLLVGLNSQVSVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGIYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSANVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 20886 - protein, 814 aa, Yersinia pestis
MPYLPTTPRSRLSLAVRHTLFAGLLCSSPLLLALPATSAGASEQSRSYAIPAGGLDQALNRFASEAGILLSADAQLTAGKRSAGLNGSYDIDEGLAQLLAGTGLRALNSGGNYTVEVVADSGGALELSATNIISNQLGTVTEGTGSYTPGTIATATRLVLKPRETPQSISVVTRQHMDDFALNTVDAVMRHTPGITVSAYDTDRTNYYSRGFSINNFQYDGIPSAVRNVAYSAGNTLSDMAIYDRIEVLKGASGLLSGAGSLGGTINLVRKKPTADFQGHATLGAGSWDNYRSELDVSGPLTETGNVRGRAVAAYQDKHSFIDRYSSQNSVFYGILEFDLSPDTLLTVGADYQDNDPKGSTWSGSFPLLNSKGERNDAKRSFSNSTDWSSWQQYTRTVFATLEHDLGDGWVTKLQLDHKYNGYDAQMGAIQFDQPQPDGSAEINAQRYKGDTTSDSADLYVSGPFSMLGREHDLVLGGSISKAHWSGKGYWDETFSVPNRVDYNNWHGNLPKPDWGPVSQRTDDVIRQTGVYLTTRLNVTDDLKVLLGGRVVNYSLTGLTPTYTESGRFIPYAGAIYDLNENFSVYASYTDVFMPQENYNRDRDNKLIEPDEGENYEIGIKSEFFDGRLNASLAYFEVKESNRSVPDDAYNNQTPTPPNYAFKGSKATTKGYELEVSGELAPGWQVQGGYTHKVVRDSNDVKLSTFEPEDQLSLYTTYKLTGDLDKITVGGGARWQNKAWQQIWNSPKGVNEDVTQESYWVVDLMTRYQITPNLSATVNLNNIFDKYYYTNVGFYNSAIYGEPRNVMVTTRWDF

SEQ ID NO: 20887 - protein, 666 aa, Yersinia pestis
MGGLVHGGNGTAIGIHRLENVQTSATLELQSGYALEGVTQALVFTGSYAEINDAALDLANSHLVLGGTGDAVFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 20888 - protein, 3710 aa, Yersinia pestis
MLRLYMNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASDIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLSASNLIINVANTLGTALQITDGIDNTTTIGNEIQLNAENATAINFLGSSSKTLNNNGTIKGSVIFAGVADHIINNNGTLDGTLTTGAGNDTLVLDSSSQSNDVINLGDGNNSVTIQNGATVSSIITGNGNDTFTINGMSVGSTYLGSLDAGTGLNTLNFNASTDELAAATSLQGFTNINLVDSHITLVSDDNIGSGMVNIDSSSELLFGSTFDGILHATLGAGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDIDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTAGGASTVAGGLTGAGTLNINGGNLSVSAANSGLSGQTHIADVASVTLTDTGTLGTSAVEVLGTLNLNGANAAMTNVLSGDGTINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVSNAVTIDIADATLNLDDIALFNHVLTGNGLLNVAKNDASTAFDFGSTVGGAFSGIVNLTNTTFALSADNAAALARATLKLSDDSVTTVGATDRTLHGLDLNGGTLIFDGSPPQSQANGVVTVTDLALNSGTISITGAGNWENEHPVTPPNVSLLEQDRGDILLELINAANVTGNANNLDLLVDGTAITSGTQGVESAIQQGGSTVANAIHNYGLTSSNGNGGSGLYVNYTLSALELLANGANALLLATESGLTANRVLNAELFGVGGLVVDAQNGALTLANGNNRYEGTTTVTAGELILGANGAFGQTSLLNIASGASANINGYRQTVGAVTNSGAVTLGNGGVLTSGLLTNGGILDLTGGALNLAAGGSSTVAGGLTGAGTLNINGGDLAVSATNSGLSGQTHIADVASVTLTGTGTLGTSAVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNTVKVDIADATLNLNDIALFDHVLTGNGTLNVAKNLATTAFDFGSTVGGAFSGIVNLTNTTFALSADNAAALARATLKLSDDSVTTVGTTDRILHGLDLNGGTLIFDGSPPQSQANGVVTVTDLALNSGTISITGAGNWENEHPVTPPNVSLLEQDRGDILLQLIDADNVTGNANDLELMINGTTISAGQGVQSTVQQGGYTVANATHNYGMTSNGGSGLYVNYTLSALELLADGANALLLATESGLTANRELNAELSGVGGLVVDAQNGALTLANGNNRYEGTTTVTAGEFILGANGAFGQTSLLNIASGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALLVSFASNMANLTSNVLITANGSLGGYGQVTGNVENYGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTEADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNRVSGQDLATEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQVNSQLNLWGNIGQQVGNKGYSETSVVLGVKYNF

SEQ ID NO: 20889 - protein, 924 aa, Yersinia pestis
MPTDVSLGKGTFLTTGKVIPLIILACSGAASASAKKNADDTFTYVPSVAAADVVTRTNYNRPLFITSAATARAAGINGAGIKVGVADTGILTTHPALLGVVKGTLNYVDPSANNLSVGDVRGHGTMVAQTLAGRATGLFTGGTAPGATLISARIIPDVANTRQSLNFGQINYDLARAGAKIINNSWGIPDWNPTSTATTTYFVNAWKPFISSYNGLIVFASGNDGAANPVGVAKLPSLAPASGLDKGWLVATAVDTFNPSYIASYANRCGVMKNSCLAAPGSVYVQSTDSTGKPVLRLVSGTSFAAPQVSGVAAMVWQKYPYFTNDLVRQTVLGTATDIGAPGVDAVFGYGLLNAAKAINGPAKFNWGTVSVAFNSYTSTWSNAISGSGGLIKGGTGKLVLTQDASYTGTTQVLGGSLSSAKSLASAVNIGRAGTLDVRTVKGNVDNSGFVLLRDGKTRFMTNYTQRTTGGLAFMLGSTLDVAGRATLAGNLHLLGVPAGYITQARQPVVNAGAVSGKFSRFTQSAGVFLTGSLGYSTKQVWLNIKRLQVTQTKVASTSAATQSAAVRLEQAFTQLDKQVATGVAVRASSFASAAGELQHISNNTSARAALESLSGQLPAATAALTWQAINVNQRSSANHINALLDAPQSRSWSDTLSWNGSLGRSGYSPVSYSMKGWVTGQDRFIDEHTFIGTSLSRTDTFSALSSGGERNTGTLSEAALYGGKIYGGYYLTGRLASGYYDGQQRRMLWLGSRSERVSSRQSGSWMSLGSETGYRFNVDGLAVTPFIDTQYITLKQDAFSEKSGSGFGLRADNQTTTRWQAGAGLRAAYTFDLQTHGRLDLSFQTHLQRALSQDEGRYQASFTGVDQPVPLHGVTAPEKTLTSAVSLGWQVNPALNLNLTGEQETSDGRNSNRSVMAGVSLSF

SEQ ID NO: 20890 - protein, 860 aa, Yersinia pestis
MKRNHSHFSSGQGEGMAAGSHYGSLRSVALASAMACLTWSGLAVLPTAHAQSASSHTAMSTSHSLSVPAQPLGQALNALARTWGVSISVDAALVEGRTAPVLQGVQTLNEALAKALTGSGLEAVPAGAAITVRRHSSQTGMLGEVTVTAQAEREATEGSGSYAASYVSLGKGQDIRETPQSISVVTRQRIEDQAMSNVGEVMQQTTGVTVDYGGAGGLGGAATRFLSRGFEISNVQIDGASVDAFSQQLFDPNLAMYDSVQVVRGANGLFSGNGEPGGAINLVRKRPTAQKQILGSVGVGSWNRKQAELDVAGPLNEAGSLRGRAVLAHSDKNFFYRGADSQNSLLYGILEADVTSSTRVSLGASYDKLKATPWREGLPRAANGDDLKLSRKTALMAGWSHYDKSAKEIFAQLDQQLAGDWKLKAQVNYQKVDSDSRLASLSGAVDPATGLGANWTGFSNDFRSEKKSLDVHASGPFSLFGRKHRLLLGADWSKVRDDQDTYYSEMDTPLSLTNVYEFDPGRIPFAVRERMTRSYPGYGATQKGFYGRANLSLTDQLTAIVGGRYASYSYDTPYINYNADGSVRASGREYYSESGIFTPYVGLVYDLGKQWTAYGSVTEIHKSQANMLAGPVPGAALDPIKGRSFELGVKGELGEGKLNTAFALYRIERKGQAVRDPRYPEADIGNLGLSCCYVAQGKIISQGLDMEVTGQLAQGWQLFAGYTYNHNRNKTDPSQLVYSSITPKHLFKLWSSYQLQGQHSPWTVGGGVTLQSATYVSGTANRYNPASGQYDGDAVPFRFTQAGYAVWGASVQYRINRNWSAALNVHNLFDKTYYKTVGTSGSGNWYGEPRSVLLTLRGAF

SEQ ID NO: 20891 - protein, 1403 aa, Yersinia pestis
MAATSLDFSNNLPAGVTVATTPNASTTCTGGTLTATNGANSLAYTGGTVSAGASCTVSVDVTASTTGAKANTTGNLTSNLGNSGTASATLTVTQPSLSVDDPSVLEGDAGTATLTFTVTMAPASSQTITVDYATSDGTATAGSDYTAATGTLTFNPSVTTQTVSVTVTSDATIEPDETVILTLSKPSNATIGDATGTGTITTDDVAPTDFTAPTLDLVSRASPTDERTNVNALTWVLEFSEAVRRVDVTDFAVTGSTASVSAISGSGRVYQVTVSGGDLSDYDGVVGLELPNPTIVDLAGNDLDGGAPSSAETYLLDNTGPVATLSSDLTGDASEPFTVTVAFDEPATGLQLSDFVLTNASVNALRTVSETEFTVEITPGGRGELTVSLAAGAVTDALGNESLASDTLTFETDTSGPGLSGIQSGVGSVTALDIVYWNVTFSEEVTGVTRDVFSLSGGTNANLSVSGSGASYQVTASGGSLADFDGVIALSISDPDAILDLSGNAYEGGAPSGPDQSQIRIDNTAPVATLSSEKASVGAAVTVTVRFSEDVRRFGRTGVTLTNASLEELTEVSPSEYTLVLAAQSNSPVSVQVKAGSVIDAAGNANPASSTLTLAADGEAPVLRNVVAGTDLRTADDTLSWTVEFDEDVTGVDASGFTLAGASGVSLSVSGSGRTYAVTASGGNLADLDGEVQLQLVTPSSIVDVWGNAFAGEGPTNTDESRIELDNSGPAATLTALSDEVVGPFTLTIAFDEDVTDLALSDLAVTNGEASNLSRIDTRSFRVAIQPQTFGVITMTVAAGAVEDLLGNPSDAGELSVEAVSQQDEIDVEVNIDVTSPVGAQVQSSVSNPGVTDVRFSASADVGWLTVTPAQGVIPAGASVEFTVTVNDQAAALEAGDYTGTVTVVREGVFGGASAGRAGVQAVQETVLARIPVNLMLVSQKGSLQIVSTTPSGVSGDADFTYASSLSQFDGLTLTTVNGYAQSTSVELNSAQVSLQQTSPAGWRVESISCAGDLDGGSQVDLATGTIQIDLDPEENLVCTFENVRDEAAVQLATQRAIRNFMLRRADRLIDAAPDLSTRLSARESMGAGQYAANVDQGRYTMSLTASLAGARNQAKARHSDAPGMPSSMRDDVGRLDVWLSAELSGVSDNRAGERAESDFGVAQLGLDWAVSDALLVGAMVQMDWMDETAQEVFEEAGAITGARVDGEGWMAGPYVVWRVADSVILDGLALYGTSSNTVNPLGLYEDEFETDRWMLQANLTGEYGHGAFLVRPQATLTHFEETQDGYTDSLGFVIPSQSIALGRLAAGPELVWRQERASGARWELRSKLRAVWDYQPAELLSETGAFMNSESDLRADGELGVAATLSNGAVFELSVGVSGIGQEDFEANSARFQLRYPLSLGQ

SEQ ID NO: 20892 - protein, 173 aa, Yersinia pestis
MVMKKIACLSALAAVLAFTAGTSVAATSTVTGGYAQSDAQGQMNKMGGFNLKYRYEEDNSPLGVIGSFTYTEKSRTASSGDYNKNQYYGITAGPAYRINDWASIYGVVGVGYGKFQTTEYPTYKHDTSDYGFSYGAGLQFNPMENVALDFSYEQSRIRSVDVGTWIAGVGYRF

SEQ ID NO: 20893 - protein, 423 aa, Yersinia pestis
MVMNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNTGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKGQNVSITEKTPAPSNTTYEFNSKGSAMLYGVNFNYTF

SEQ ID NO: 20894 - protein, 1077 aa, Yersinia pestis
MVTSYICEVNQQSNNLFKMKKQLTLFLCLLLFIPMYGYAEDEVNHQIVQQTTKVKGTVTDEQGEPLIGASIAVKGTSQGVITDFNGQFSIDASRNATLIVSYVGYRSEEVQVKGQSNLKIVLKEDSKIIDEVVVTALGIKRERKALGYSIGEVKGEELEKAKETNVINSLAGKIPGLVISQTAGGPSGSSRVIVRGSTEMTGNNQPLYVVDGVPLDNSNYGSAGQYGGYDLGDGISSINPDDIESMSVLKGPAASALYGSRASHGVILITTKKASTKKKFAVELNSTTTFEKQLTKWDDVQYVYGQGTGGRINGTDDQYSSNKNWGPKIDPGLNLTYFDGVTRPYVVIPNNIDGFFRTGMTTTNTIVVSTVKDDTGIRATYTDMRNKDILPNTKMSRNTLNLRANTTINKKVDLDFKVTYTREDVKNRPALSDHRANPAKNLMSLATTYDQKWLRDNYKDADGNYYDWNGRDVWNLNPYWVLNEMTNESGKDKFMGSALVRYNVNEHLKIQVTGGADINFMNFQEYAAPTSPGFEQGQLQISDFRNRMYNVEALAIYNNSYKKFDYGVTIGGNLYKVDNKTQIVTAKEMVMRDVIALQSFTSKEITEGTYRKQINSLYGSINLAYGNFVYLDATLRGDHSSTLPSGNNTYLYPSVSGSFLFSEFFKINPTLLPYGKVRVSWAQVGSDTDPYQLGLSYELSPKNYSGYALSQIANTTIPNKDLKPTKTNSAEVGLELKFLKNRIGLDFTYYTQKSSNQIMRLNTTGTSGYNSMLINAGEIENKGVEIALNTRPIQTKDFSWDLNINFSKNSNKVKRLASGIKEFELESARWINVKVAAVEGENYGSILGKDFLRNDAGQIIVDASTGLPKVTEDLRVLGNATWKWTGGITTNLTYRDISLSAIFDIKVGADVYSMSARSSYMTGKDKATLAGRDGWYESEEQRLQAGVKESNWEATGGYVVEGVVEMPDGSFAENKKFVDPEVYWKHIADQTPVPFIYDNSYVKVREITLAYRLPKRWISKVFDAVSVSFVARNPFIIYKNVPNIDPDSNYNNGSGMGLEYGSLPSRRSYGFNVNVKF

SEQ ID NO: 20895 - protein, 1057 aa, Yersinia pestis
MLRTARYLLCAIALSAPMLAQTAGSVVGRVTDPSKAAMPLARLELVNQETGIAATSPVTSEGDYTFSRVTPGTYRLTVTAEGFKTFVRRDIPILVNQTARIDVELEVGAVANSVEVDARAPMIQTDSTSVGSVVDGEQIEAMPLNGRTDIYGLLALAPGVQGAGSNPAIAGSAYRGGAGATIDGVSNDDAIGERLLGQMPSLDSVAEFKVISNGAPAEFGKSAQIVVVSKGGSNAVHGGLFAFNRNAVGAARTHSVRNLAKPAYNRNEFGGQISGPIKKNKLFYTGSFEGLRLVQSTVSQLTAPKTSMKTGDLSLYLPTVIKDPLAGGTPFAGNIIPTSRISATSQAFFRFFPDPNSPGTGAQGLGTDFAANVPQHQPNDRYSTRVDYQLSDKDAIYGRYFWTNNGPYSTAGGGLPFGQWDGFGISTRNLSAQYTRVLSPTVANVFRLGLNYWTDYRMPQNHDFDPSQYVPGLTAPLSQLGGAPSIAISGFSTVSDQPGSDDHNHVRQFIDHVSWQHAKHSVKVGVEYSQVGVVNRQNSTPYRGSFTFDGRYTGNAWADFLLGDLSASSRATSNFVLDDVNTRIAGFAQDDWRVSRNLTLNLGLRYDFESPWNKRNDLAIWDRDLNALAVISGKVDPLWNGVVPIVDAKSIGKDSSNYMSFGKRNFSPRAGLAYRPFSRAPFVIRSAYGIFYNIMGEYDGSVDLRDLGLNPPFRASQNFLGSNNGIPNLTWADAFAGTGTSSTATPPNIYAVDKKFKLGYNQQWNVTMEWEPLRNTSLRASYVGSKATHFVQAVNLNDPLPSALPIQPRRQYQPWGNIYYYESNRNQLFNQLQLGAIRRFRSGLKFQAEYQFSRSLGGPYDGALPTTYTNLRLDRGNGTQYVKHYLVFNYNYDLPIGRGKSILGGVRGPLDKIISGWQLAGIATIATGNFLSVTFTSNKTGWNNGRADIIGDPSIANRNENQWFNTAAFAMPAAYTFGDSAPNLLQGPGRYNLDSGLFKSTKLTERVSLAIRAEAFNVFNHANLGNPGTNVSTPSTFGFATGRNGSRVTQLGARLSF

SEQ ID NO: 20896 - protein, 3089 aa, Yersinia pestis
MIIDESVDDRAVFYRDLKPGVVIHEMNLSSNGLEQLGDILKDYKNIEALHVISHGSDGEIKLGNSVINQQVLQNNPHLFNQLKQNLSPRADILFYGCNLASGEKGEALLAYISTALDADVAASNTPTGHAQFGGDWVLEVSTGAIEHRLPFSAPALANWQHVLPTFDGDGGSLSGANYIEADNGDGITMTATFNGDTADVADGGNGGGSSGNVFYGVGATATSVQVSFSSPVNISSFVYFEADGTASTGNYTFTVTSGSGSTIVKTQADFTLLSGLAGVTLTPVDWTSVSTFTITSDAINFSPGLDTLAYTMGNNAPVLTNLNGDSVAWAGVGNYVSLDAGTSLGVSDVELDALNGGNGNYAGASLTLQRVGTAITTDVFGFDTSGALFSVSGANLQSGGLTFATFTNTSGVLSINFNSSATTATKSLVQDVLQRIQYSNNTPAADAALRYSLSDGTASTTADVTVTSDSIYVTSTTDTATINLNNGVSFSEAVAIALADTTGSQTLILSSAFTSSMSLAGNLSIAENLTIDASAAGSSFAIAGSTLTLDSGFTLSLTHANQLQISSNINGAGNLSKAGAGSLRLTGTNSSRTGSTSVLGGTLDIDADTNLDGANTGVLTLDGGTLAMTVTGGSTFNPNIQTINNPITLGAAGGSFNPTGGGGRNIINLSGVISGSGTLTKIGASVLQLSGNNSYSGATTITVGGLLLSHNNGLGSTSGSTTVNAGSALRIAAGVVSPEPLFLNGTGRNIDAVDYGALGADAYSLGTSTVSGNIELSTGTNISVINGSNLILSGIVSGTATLTKTDTGSLTLAGTNTNSGATSVSEGTLVLDNGAAMADTTAVSIASGATLRLDASETIGVLSGAGTLAMNGAHLTLNQTSDSSFSGGITGSGSNLTKSGSSKLTLSGTSTYTGVTSISGGSLSLTGALSGTTGATIGSGGTLEGTGSLFATSSTNTLTVQSGGILSPGISGPGTITINGNLTIASGGALTAQITGTVLGSGYDSVAVNGTVDVSSATLNVNHSYTAGLGDSYRLLVNDGVDSITGNFSGLPQGGTVTAAGNSTVLTAYYAATDGGGYSGGNEFMLVAPVDITPPTVSSVNVPANATYVSGQNLDFTINFDENITVNTGGGTPQLALTIGATTRQANYQSGSGSSSLLFRYTIQSGDADSDGIAIGTLATNGGTLRDGAGNNANLTLNSVGPTSSVLVDAVAPTVSSVNVPANATYVSGQNLDFTINFDENITVNTGGGTPQLALTIGATGRQASYQSGSGTSSLLYRYTVQSGDADSDGIVISSLASNGGTLRDGAGNNANLTLNSVGSTASVLVDAVTPIVSSVNVPANTTYVSGQNLDFTINFDENITVNTGGGTPQLALIIGATTRQATYLSGSGTSSLLYRYTVQNGDTDSDGIAIGSLASNGGTLRDGAGNNANLTLNSVGSTASVLVDAAAPSISSVNVPANATYVSGQNLDFSINFDENITVNTAGGTPQLALTIGSTTRQAAYLSGSGTSSLMYRYTVQNGDLDSDGIAIGTLSSNGGTLRDAIGNNANLTLNSVGSTAAVLVDATAPTVTSVTSSTLDGSYKLGDVIALQVLFGEVVTVTGTPQLTLETGTIDRVVNYSSGTGSSTLIFNYTVQVGDVSSDLDYAVTTALALNGGSIKDAAGNDATLTLVTPGAVNSLGANKALVVDGVAPTMISSTPSDDGSAGYNDTLQLTFSEPVLAGIGSVRLYDASDDSLFETVDVANLVISGSSVTVDWVGNLIPTHSYYVQLTAGVIKDSAGNPFAGINDKTSLNFTVTHVAPVAMADSATTDEDSSIAIPVLSNDVSSGFALNPASVLIVTAPSNGSTSINNSTGVITYTPNANHNGADSFSYKVQDVNGGQSNAASVSITINAVNDAPVITGVPATSVNQGATYSFVPTASDVDANSVLSFSIVNKPSWAAFDTSTGALTGTPTRSDIGSTSGIGISVSDGILSAQLPAFSLEVLSTNSAPVATNASVSLDEDTSLSISFTATDAEDDVLSFEVVTQPASGKLVKHGSVWLYTPDADFNGDDSVRFIAKDAELSSTPGVVSIKVNPVNDEPKAVDDNISQSLSTDNSYTLAVLDNDTDVDGDTLTIDGAAADVGSVQIVSSQLKYQAPTGFVGPVALRYSISDGHKGRSNAKVQLLITGENSADAPVITVPADITANATGLFTQLKLGVATAVDASGKKLAVSLVNTKQLFAPGEHVAYWQATDSQGRSAIKSQKVTVKPLISISRNQVVSEGSEAKVSVFLNGPSPQYPVSVPYTVSGSSDGNDHDLVDGVVEITSGLSASFSVNVFDDGVTEADEELVISLDPSLNLSGQRETRLLITEANIAPQASIVVTQSNEQRTQVSKAEGKVYIKVKSRDVNSQDSLTEVWSTGALVLDTDADGSYFDPSTLDAGSYPISLVVTDDGTPQLSTKVQLTLLVKDSLPVLTGADSDGDLIPDNQEGFADTDGDGIADYLDAINECNVLQERASSQQTFLAESQSGVCLRLGNTAQLIGSQGIQVPDSALIKDALADNLGGLFDFELTAIPRLGASVAVVIPQARPVPTNAVYRKFVRGNWQDFVLNANNSVMSSAGNSGYCPPPGAAQWQAGLTEGHWCVQLSIEDGGPNDDDGIANGTIVDPGGVAVMLNSNSLPVAVADAVIVPVNQSAEIDVLANDTDADGDALTVRQVSSQFGTAVVLDNQQISYTPAADFIGTDVLVYSISDGKGGTASSELTVTVVANRAPVAVDDMASTDDKTVLLLNVLANDSDPDNQALSIIAASAEQGSVMIENNQLRYTPKTGFEGIDTVSYRISDGLDGEATANVMVSVKAYKAQVVDNQSGGSVHWLWSSMLLLSLVLRRKLNSLAKLKLALFKLAQHKNACFSALVLLLGVGSAQAKEENSPWYLDANLSVNETDKTQMELQQEVTAGTISGFDNSDTGVGLSLGYQVTPLLAFELGYLDLGEGSAQISGESLDAGQYHELMKLVSPVLPQGGTVGARFTLMEHQGWRFSVPVGVFIWESELHSDSQGQRLTTKLDDTDWYAGMRFDYALAQHWSMGLGINYYALAPNDVLSYQLSVRYQF

SEQ ID NO: 20897 - protein, 746 aa, Wigglesworthia glossinidia brevipalpis
MKFIKNFILILLFILPISNSFGAMVTHIQSATVSDGGANHIQGIQFNKNGTKMFTLNNTTDGETYTHINEYTLSTPFDISTRIYAGANERCELDHGGDNNGSYDLEFSSDGMKLFFAEGKSSDGADFDKVFRFDLTTAYDISTCLYANNATSNLDSDALQNGSNAGDVTSGKGKNRLQGLEINDDGTKLFLIFHGSSSTFAPNTRLLEYQLSTPYDLTTISLVTTAGIELEGETANPYSIRFSANGKRIFSVDHNLGSQDVTQISLTSAYDTSGFTIDGTVSLDSLKSTVTQPRGIAFSASGLKMYIGNDKTVGGSDTIHEFDLVCPFNIIEGNCPPVTENSVRTGIAIAQIEVATRTIEHSTDTALNRLKWIRRNKDSQNLTNLNLDFNFTNPMLASLTKAVKPSATTKKKDKQQDVFYWSEGSIAVGRVGDTSVSSFKKIKTDAITVGADKFTKNNGISGLAFRFSKNDIDVGSAGSNLDTNTYNLTHYTSSPIEDDTKFIDTVFGIGILNSDILSVLDGKRVTADRKGRQIYGTIKLKDEIKKNNLILIPSGQIDLGYTLLNDYQESGNAAMKFKKQGIQSRNARLSIAAIDELENDKYKIRKHGKLEYKANLHRSSNIKYSYVSDATSGEFDTKLNSGALHNLNGELGIDIILPDSFSIFLIYERNQALGTGHTDKIHLAIGYLPNRKTNYAFKLVGSENLGSEFKISKNINDFEFDFKLNNQDVLRPNTFDEATINLKKIF

SEQ ID NO: 20898 - protein, 711 aa, Vibrio vulnificus
MKLTPVSAAVLSVLAANFVHAENGHAVMEEVVVTANQIEQPLSEVAGSVSVISGKELEKKGQTELYDALRNEPGVSVTGGAGRPQNIAIRGMTGNRIMIVRDGVQSADGFGANDINDKVGRNSFDLVNVKSIEVVKGASSSIHGSGALGGTVVIESMQPGDYLKNDDFYADVATTYTGISDKTQLMSNLAFRSGNTDSLLTVAYWQGKETRNFNQDNYQRELEGASASYQLNHFVGDALMLSVAADAYREGQIRREGSSGIHADGKWDQNQYYEDSHVTDLGVSAGLEYQPMDAFWFDEAKAKLYWRDMADVEDINRLYGRLDQNGITEQKRSLENNEFLDQLVGFRADMTKAFATDQTEHQLAYGLKVNSNRYSRTSERQSLVSGGSSAFSKQPFTPAKALSVGIYGLEMMQYGRWTTTLGLRFDAHRLAPDGDGHSNGFAKKNIDSQEWSPSFSIARKVADAHQLYFSYNHGYRAPTYDKAYGYVSHEDIPFTPFIIIPNMDLKAETSDSFEVGHKFDNGTSRLYVALFYQQFDDFIDVKEVGMVGPVTLKQYQNLNGVETYGAELSAAHQINEQWLLATKAGYVDGKNDQGEYIRTLTPVEGNVELSYAKQNWSASLLWNWAASMDRVPVCVNEFNQEVSCAKTESWHSFDLFASYQWNKDLTLSASIVNLLDNEYIRYQDVAGISQAHTTYSTEPGRYFTANVKYQF

SEQ ID NO: 20899 - protein, 720 aa, Vibrio vulnificus
MPLSRIIEQRMRGRFLSGGVWNVVSEMNRRRALPAVLSLAVAQMVGATVAVADDRKETAQEVQVAGSGEVYQLQPVTVTAEKMTSTDQDTPVSMTVVTGEDLERSAAKDTIDIVRQVPNMYMTKAGQHASVAFLSMRGVTPFMEAEQPVGFFVDGVHYRNVDMELLDIDRVEVLRGPQSTLYGRNTEAGAVTIITRDPEPHQEGQVSVGIGNYNRKTISGITGGPLGSEDWSYRAAVQFLDSDGYFTREPDGADDVDDATNVNARFKVRWQPQQAWDVIATYDGARYREGSTNIAPLSALREDSHKVSSNYIGSNDSDVHGGNVRAVYEAPAVTVTSISAYGYENKDTTYDVDGSALDLMRLRTGVDYSRFTQELRLSSPEGASGPRWVGGVYYFDQTDHNDIDMTMTGMGMGVQSVRTTTDTRNMAAFGQVTWPLIDSLSLITGLRYDHERKDVESQQTWAAMGRDTGVDQDMTFHAWLPKVGLEYKPFPTLLTYATYSGGYKAGGFNNLADPGNEKYDAEYTRNYEIGVKHTALDNTLSTKLSLFWIDWTDQQVEELILSQSNISNAGQSVSRGVELELAWKATKALLLKAGAGWNDAHFTKYEDNGTDFSGKRPPNAPAYTYSLGADYSFENGLYAHADWLGTGEVYFNSANTQKERPYGLLNLKTGYQGESYEVALWVKNALDADYATRAFDLGGGTYGGIAGDPRTFGMTVTARW

SEQ ID NO: 20900 - protein, 726 aa, Vibrio vulnificus
MNTTTPFKTSSIALAIMATFTTPLVAAEQSSIENAQLETTQLERTQLETITVLGKVYRNTATKTALEPEETPQGVTIIDKELLDQRGVKSVNEALRYAPGVVTEQKGAAVTMYDNFSIRGFETNNQNYYDALILPYLAGWNLHPQIDPVAIQQIEVFKGPTSVLYGTMPPGGMVNIIAKSPQQEQSTSVGLATGSRHLVQASLDSAGQIGDSNLSYRLVAMARKQDSQVNGAEEERYLIAPSLDWQVTERTLINVNLYYQNDPAMGINSSMPVEVVKRQSPSVSMGDTNWSTFERDVLMLGYKLNHEFNDNWSFLQNARYTDASLYQENTYHLDTGFTAATGALSRNIYTTDESYKSVVIDNQLSGLVTMGNWQHNLLVGVDYQDLDGDSSYKEFAGNAAFYTFNAYQPNNNLLDKSQLNEVYSEHHDIGFEQLGVYFQDQIRHGQLILLAGGRYDLFKSHDDKTSTAPTYDGKETSDHNQFSYRVGVLYELGNGLSPFANYATSFEPAAGTDINGKSLKPQTGEQIEVGFKYMSADMANTLTASYFHITKFDSIAADPNDPTFRAKIQLGEVTSQGVELEGQAYLADNWDVLASYTYLDMEVKKATDATLVGTTPIYVPKHSANLWTNYYLTSGALSGARIGGGVRYVGEMEMDATNTQGKVPSYTVADLSLGYDLGSASDSLNGAQVNLVVNNLFNEQYYSCYNQTNCWFGADETVELNVNYGF

SEQ ID NO: 20901 - protein, 175 aa, Vibrio vulnificus
MKLHSLVIAAALAAAPIASFAQDWTGPYAGFQIGGSDIDVDGAAELTGDGPSYGIFAGYNVQNGAIVYGGEIDYDVTEYEIAGGAQEVDSTTRLKGRIGTELGGGLAYGTAGVVWATSPGLGDDNGYLVGVGYDLPVTQNMTVGAEILQHEFEDYNDTDLDVGVTTFKARVSFSF

SEQ ID NO: 20902 - protein, 295 aa, Vibrio vulnificus
MKKTLLLTLFFSFWLHAERNGFYLGLNFAEGSYIKGQGSIGKKASAENALNQAINNAKNSLFPEQNTKAIRDAQNALNKVKDSTKIANRFAGNGGSGGLFNELSFGYKYFLGKKRIIGFRHSLFFGYQLGGVGSVPGSGFIVFLPYGSNTDLLIIGPTDKRASQDYVERRVKGLSIFYKDMTARPLDANTLKKVSRHVFRKSSGLVIGMDIGASTWFASNNLTPFNQVKSHTIFQLQGKFGVRYNSDEYDIDRYGDEIYLGGSSVELGVKVPAFKVNYYSDNYGDKLDYKRVVSD

SEQ ID NO: 20903 - protein, 832 aa, Vibrio vulnificus
MEYDSSFLMGTGASTIDVKRYAQGNPTPPGLYNVRVFVNGQATSSLEIPFVDIGENSAAACLTHKNLAQLHIKQPEQPVTLLAREGEEEDCLDLAKSYEKADVCFDGSDQFLDLTIPQAYVLKSYGGYVDPSLWESGINAATLAYTLNAYHTSSDNDNSDSVYGAFNSGINLGAWHFRARGNYNWTTDNGSDFDFQDRYLQRDIPAIRSQIIMGDAYTTGETFDSVNVRGVRLYSDSRMLPSALASYAPTIRGVANSNAKVTVTQSGYKIYETTVPPGEFVIDDISPSGFGSELVVTIEEADGSKRTFTHPFSSVVQMQRPGVGRWDFSAGKVIDDSLRSEPNMGQASYYYGLNNLFTGYTGIQFTDNNYLAGLLGVGINTSIGAFAVDVTHSRAEIPDDKTYQGQSYRVTWNKLFQDTGTSFNLAAYRYSTQDYLGLHDALVLIDDAKHLSADEDKNTMQTYSRMKNQFTVSINQPLNIAYEDYGSLFISGSWTYYWAANNSRTEYNVGYSKSVSWGSFSVNLQRSWNEDGEKDDAMYVSVSVPIENILGGKRKSSGFRNLNTQLNTDFDGSHQLNVNSSGNTENNLVNYSVNAGYSLDKNAGDLASVGGYLNYESGLGGISASASATSDNSQQYSISTDGGFVLHSGGLTFTNNSFSSNDTLVLINALGAKGARINNSNNEIDRWGYAVTSSVSPYRENRVGLNIETLENDVELKSTSATTVPRSGSVVLTRFETDEGRSAVLNITAANGKSIPFAAEVYQGEVMIGSMGQGGQAFVRGINDSGELIVRWYENNQTIDCKLHYQFPAQPQTQGSTNTLLLNNLTCQVANH

SEQ ID NO: 20904 - protein, 844 aa, Vibrio vulnificus
MTARRRLLASLCLSPLMWGMAAPAFAEAAATPVADDGEILVTARRVEEKVRDVPATISVLTESAIRASGVTVATDFVQLVPGVTIVTGNVEAGDVQISVRGLNGTRDAESNVALIVDGILKTNTAALNQNAGTLSQIEVLKGPQGAIYGRNAAAGAVILSTRKPGDRLEGQATVSYAEYDHKRAAGYLSGPLGAGVGLLVSGDYEKGNGFYKNVFQGTPAFDAYKAAILSVTPGVDVPGFSRHSVDNFLRWNVNARLTADLGDRTSVDIKGKYGRVAGGTVVFGAAYAIPGLVPFVGPAAYLDVNDYDFTNAFQGNLKSRQVQITKEVSVKLTHDMDWASLQAWAAYSDIANSYTGEGTSGSNGYFFPQAQCRATTAALAGFPTPAPTFIGGTPETSFFAPYSPTTCDGYQFNKRNQTDFSAEFRIASLPGSDLSWLAGGYYLHIDRHICVNLATDTGQGAIRQCFTLDPRSRTEALSDDKFKTNVYAMFGSVQNKFSDSFTASLALRYDREERAVRNQIPTDVRTLFVNPQGNGQGGYYLNPGLDPVYNPSGVLPPRSKAFEQVEPKLSLTYKPSEQLTLFGNWGIGFKSGGFNSGGSAAIVNTFNGPPLNANITVRDDYKKEVSSAFEAGFKSALMGGRLSIEGALYYTDIKDMQFFEFYVGSFGLLRVVSNIDKARLYGGELSVSIRPVRGWTLFGSGNVTDSKIRKNSSRPDTVGNKVPYASDYTLNLGSQLDMPVSGGLRAIGRVDYRLTGPTWFHSVQAQTRPSLNGVADFSRSRRDAFGIVNLRAGIATDHWSLTAFANNLTDKKWINEVVPAPELGGSFVSPGTRQQFGLELSAKF

SEQ ID NO: 20905 - protein, 1016 aa, Vibrio vulnificus
MTNKRSGCLSIILSLLFAGVAFAQQKGSIRGIVYDKEFDAPLATVQVTIAETGDKIIATDEGIYLFDHVAPGSYTLIFSKSGYTRQVQANVVVSPGKMTEVEVSLSGEFTDMEEFIVEDIRTGDTEAGLMELRAESPALLDSISSEWLRQAGVTDAASALSLVSGATVQDGKFAVVRGLPDRYVSSQMNGVRLPTADPDKRAVQLDQFPTEVIESIQVSKTFTPDQQGDASGGAVNVVLKGIPDKNVIRFKTGYEYNTQAAGNDNFLTYKGGGVNFWGIDKKSRDIPSDGVFTGSMGVIGDEAPIDYSMSMAAGGRIELGKGISVGGLVSSYYKKDSSHFDNGIDDALWVDSKYRGDGLTPQYGNPDSPPDPPIPAVGEDFKTSLFDVTESSEEVQWGVLSAIGMEIKNHSLQALHMHTQVTEDKSILAEDTRGKAYYFPGYDPNDPKGLGNDPDNRFAAPYLRTETLKYTERETDTLQFTGDHTVPFSEAGINDFFTILSPKIDWTVAMSFSGLNEPDKRQFGSAWYAESYDEGSPVYGIDPEYKPAYYGPYTPAANFLLGNASRTWTDISEKSNQYFLNLKFPFEQWSGDKGYVKLGLFTDKVDRKYDQDSYGNYRLTGDSAIPTYEGSWDDYSYSDEFLDLGGPTMKDGPPFVDVDYEGEQKISAWYYMADLPLCSFLNVIGGARYETTKLNVINDPEKDAKWVTTDENGNRLYVDLLPGDADVAYCQDDVLPSLGFVLRPFSKITLRGSFSETVARPTFKELTPIQQQEFLGDDVFIGNNALQMSALKNYDLRLDYTPYNGGLVSVSWFHKDIEDPIEYVQDLVNAFSFTTPLNFPEGKLTGFEVETRQHLGYFWDVLKGISIGGNATFIDSEVTLPESERTRLADAGVETTSRNMMNAPEYLYNIYTMYDIERIGTQIGLFYTVKGDTLVAGAGNVNGNYVPDVYATEYGTLNFSASKNIGKHFNITFKAKNLLNPEIEEVYRPPGYLGNDEVRTSYTKGIDFSIYISGTW

SEQ ID NO: 20906 - protein, 687 aa, Vibrio vulnificus
MPSFAPSFRRSALSLALTSLLTPALAMAEDAPVAADGQTPPSSDTRHDASPSSGRHIKDLDKVVVTASPLRDAAGELSRPVEVLAGERLDEVRSSSLGETVASLPGVQSSNFGPGVGRPIIRGLDGPRVAVLRDGLSTQDVSTVSQDHSPAIEPFLANQIEVLKGPSTLLYGSGAIGGVVNVVDGRIAETPVDGFSGRAEVRMDGGDKDGNTDMFRVDAGNGSGLSIHADGVYRNQNDYDTPKGRQLNSWIDSKVGSIGASLSGDWGFVGLSASRFRDNYGNPGEPGDPSIGERGVSLKLQQDRYDLKGGLTDPWGEGSALRYSFGHTDYAHTEFEGAEVGTVFTKRANEGRVEASFTFGGGWQTAFGLQGSDSTFQAIGEESFVPKTDTRSLGAFAVARNSWERVTAEVGARVDKVKYKTDVGVDRDFTPTSFSASGGFRFNEQWRLTANLDHAERAPAEEELFANGPHIATLAFEIGDANLKTEKANQAELGLNFQNDWVDAKVAAYYNRYNDFVYIVDTGGQWFNEEDNDFLPIRQWTQADAIFQGFEGEATVHLANNENGAWDLRVFGDTVRARLNDGGNLPRIAPGRFGAQLRWDAQQWRASLGATRTMKQDKVAVNETPTNGYTFVDAHLAYHVDHGSTAWEVFLDGNNLTNQDARVHTSFLKDDVMLPGRSASFGVRLFF

SEQ ID NO: 20907 - protein, 687 aa, Vibrio vulnificus
MAALRPARTSVAEKKTFKLHALSAVVMGLCASGQAYAQTESTNSNKKEEMPVVVVIGEKTERTIYDTSSSVQVFDQETIDNTPGATEIDDLLQLIPNMVDSGQGNSMPTVRGIDGSGPSIGGLASFAGTSPRLNMSIDGRSLTYSEIAFGPRSLWDMQQVEVYLGPQSYIQGRNASAGAIVMKTNDPTHHFESAVKAGVGERNYSQTAAMISAPIIQDELAFRLSFDQQKRDSFVDLASYEPAGDAKKIEMNSVRGKLLYEPSALAGFKTTLGVSHMDSRGPQSESTNVVGNEAFRPVYETKSLSTAWDISWQLNEVLTFENNLVYSKFAFDRYTNPLQKGDYTAEGKEFHVEPLLRYLSLGGRVNALVGARYYKSSQDDEYVDATSANPMSGSTKTQSAFAELTYALTQSIDVTVAGRYEKERVKRKVSDPRFKLDHDDTLSVFLPKFDIAFKPDMAQTFGFKVAKGYNSGGAGLAFNPILGGGFSPYQFEEEYIWNYEFYTRHRLGNSVELMTNTFYNDFDSMQMTQTLSNGDVLIANLDNAKTYGAEIGTRWYATDSLELFANLGLLKTEYKEVNGTSKELERAPNMTGNLGGQYSFFDGFELSANAAYTGDYFSDRSNTEIVKIDAYWVANAQLAYVFENGRAALFATNLFDSDKTTLYARGSLNEPLKQQPRMIGASLQLNF

SEQ ID NO: 20908 - protein, 405 aa, Vibrio vulnificus
MKAGVAAVALLTAALMSQGAMAKTLEDVLKEKGVITEEDYKAVTKSKPLDYKLGKGFTFNSPDEKFQMSLGARLQSRYTFTDSDGGQNTSEFRVRRMKLFMNGYAYSKDLTYKLQVNFADSGKLLEDAWLNYRLMDEAQFLVGQEKVQFARQEITSSGSQQFVDRSNATDTFKMGRDTGLMVHGKIAKGIFNYNLGVYGGVGQNTQRKFTNNAFAARVAVNPFGDMAYSEGDLDNSQKPLLSIGAGYFMDTLAKTSATALESNNLTFAGSNGWLGKGLSKFGTEKIDTNSVGIDAAFKWMGFSAQGEYFLGHANGQDTDKTLRAHGFYAQAGYFIIPKHLEVAARYSFVDPDRDKANNIQTETAGAVSYYFNKHNLKLQADVTNIHKQPARSDDMQYRLQAQIIF

SEQ ID NO: 20909 - protein, 325 aa, Vibrio vulnificus
MKKAALATAILSAVVTGSSFAATVYKTDGTELKIGGRVEFRGDFIGTDKGVEIDGTMEDSTRARLNVKGTTDLGNDLQAFGFYEAEQKTGESSFKNRYMYAGVKTNAGAFSVGKQDMASVIVSDLTDITEFSGVQQFIDASSDKTDSTFAYRGSFDALQIEATYSASDADNSDLMGISGLYSLPIGLDLGLAYSTGDNGAGNGSQKQILVGAGYTLNDLYLGATFSTGDLDDKAKQEFTAYEFAVQYKISKPFSVAAMYTFAEEDDNGTKSDATKGLELVGYYKLNSNFRTYLSYYLNKLDDVKDVNGKVTSGEDTLRLGVRYDF

SEQ ID NO: 20910 - protein, 338 aa, Vibrio vulnificus
MNKNILALAVAAAAFSGAVSAAQVYSDDASTLNIGGRIEARGNGVVGHDNFNDDSRVRVNIAGQTQINDDLYGLGFFEREFKSDKSDDENRYIYAGIGSKTYGQLVYGKTDGSLGMITDFTDIMEYFGNEAGGKINAADRPEDSLAYLGQFGGLTVRANYVFDADGTDFSAPVDSSDNSGFSVGSVYNLNNGLAFGLGYGEQKQQEKNLTAKQGFASVSYTSGDFYVAGLYQNARNIGYQYGYDDAKHSNEYQGYELAAAYTINKLVLRSTYNYMENMDSNDKMANALAFDGSYFFTPNFRTYAGYKVNLLDKNDVKKMGEVKQAADDQFVLGARYDF

SEQ ID NO: 20911 - protein, 98 aa, Vibrio vulnificus
MEGKNKFNTYVVSFDYPSSYSSVFLRLRSLMYDMNFSSIVADEYGIPRQLNENSFAITTSLAASEIEDLIRLKCLDLPDIDFDLNIMTVDDYFRQFYK

SEQ ID NO: 20912 - protein, 410 aa, Vibrio vulnificus
MNKKMLTLTITTALILPITAQADIKFYGQLGAEIASVEYANGDENLIQGDIGKDQIFQATSDDMDRQTLTLDRFGNILNDGPNMMGFDFDFDKKPGNTLTPYARYRTTFHTTANDGMGPGLEAWAGLRTSTFSFRYGKLRSAYRDAKGLIDPWIYTSMQARGSGGGMTAGRYNEVHWAWNADGGRSVVANRITGKVGIHPGSSINTYGLVHNSDVNSMGELAIKLGPISTRIQITGDDAADRKGGSAELKYTSSSLTAWLIGSYLDQGKNQISPGGAKWNNEKFENWKVGAQYKVMPTLKLALQYEDGELGAFDNNPEGGKYIIGSIDYRVIQNLSIAGWVAGYLSDIKDQYKLIDVNGEALEEDVLSWSLGARYHFSKRSSIFVGYRQTDSDNDYRDENVFSGGILHKF

SEQ ID NO: 20913 - protein, 189 aa, Vibrio vulnificus
MKKAVALVLTGLFATSAFAGAADPGFYVGGGYGLVKSKLKNLDNDNSESLDAGHSLRVYGGYAFNRIVSLEGSYTKYGKTEEDHGYTWDPTTLALTANLGYTFDSGFRPFATVGLSYLDLNEAGDKKFTSDTGTAFRYGIGVEYMPAQVEGLGIRLAYEADAFKIENLQGHRSDTLNIGSLYLGASYKF

SEQ ID NO: 20914 - protein, 515 aa, Vibrio vulnificus
MTQNLTIHPKALALGNAVTADPPGLMAIHYNPAGLTKLDGRQLEVNLLSIYLDIDADFYADEDYEIFGISGLETDPLTGKQRDPIANSSSHTNNVALYVPGYGILRMPPGPAVAPSAGISIKPPGSKLTFANAFYLPMAAGFYRDKNDPGRYQPQAATLQRTTYLSPTVGYEINDEWSVGAGIHLSHFGFAADQYMRAPNLLMGVAEVLQDAFNCESGDEPLQPWLALCGGNVGPWDDIGAMSLNLQETISPTYALGVMWEPTDWFRWGASYTSEADMNLKGQFEIQYTDDWSGFWQSVNGSILGAISSAILSLPSGAPREAGNVSMDLVYPQHFQTGISVDVHPKLTVNADVGWTDFAQWDAFNFQFDRNLEFLNAARILSPDNATSDTLRLPLGFKSQWNWAFGVEFHASSRLDLRAGVEIRDSVIPDDQRSIMAPFGGANLYSIGMGYKWDKDTEIDMNLSYLQSIETIPADTSCNVNCDNITNIIYNPYADLTIKTSLRVVMAGLSFRTKF

SEQ ID NO: 20915 - protein, 432 aa, Vibrio vulnificus
MKTNKTLLSCAVAFGLASVSTFTQAAGFQLAEYSATGLGRAYAGEAAMADNASAQWRNPAMLTYLEGTQVSAGAIYVNPNVDVEGTVTHQQLGKTHASSNDFAHDAVIPNFYLSHQLNEQMALGFALGTNYGMETDLGTEFAASHFGNQASVISKEANLNIAYQILPQLSIGGGVRYVMGEGHFGATAPAKNLIRHPVTNNVMTLPKGTTLKYMEGEDNSWGWQVGSAWQINQDHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYGAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 20916 - protein, 266 aa, Vibrio vulnificus
MRKSLLTLGLLAATSAPVMAADYSDGDIHKNDYKWLQFNLMGAFDELPGESSHDYLEMEFGGRSGIFDLYGYVDVFNLTSDKGSDKVGDPKIFMKFAPRMSIDGLTGKDLSFGPVQELYVATLMEWDGTDYKTNPFSVNNQKIGLGSDVMVPWFGKVGVNLYGTYDGNRKDWNGYQISANWFKPFYFFENGSFISYQGYIDYQFGMKDEYASASNGGAMYNGIYWHSDQFAVGYGLKGYKDVYGIKDSDALKSSGFGHYVAVTYKF

SEQ ID NO: 20917 - protein, 866 aa, Vibrio vulnificus
MYKNTTALSVAISLALGTAAIAAPATALAEEQQVEKLQKMKVTGSRISTTDMEGPSPVTVINSKDIESKGFNSAQDVLNSLTQNTGGVMAQTDSFSFTPAAQSVNLRGLGASRTLILIDGRRLPQYPLAQDGTSNFQDIGQIPVAAIERVEVMTDSGSAIYGSDAIGGVVNFILKKDFDGVSVKVRAGDATDGGYQNGRLDVVAGKNFDDKRILFVGQFAGNEMLKQSDRDDWAGDDGSSRSQLSGYSSYGANFEGANGTLLTPADAGSSCKEVVGDAAIERADGKCGVNRSAYRTLKPENKQVDLLLRGEMDINDNVTAMAEARFGYKSTESEFEPNPYSVEVDATHFRGEGEYTRRMVEFGPRESNTEADSFGLTLGLNGLLADTYDWDLSAGYSEQSVETSNPAIFLTLDQAVQNGDVDLLGPISQDVVDKYSGTSSKEAYSKLYSVNGSLAGDLVELPAGMSGFAVYGEWNRTDYNETIDATTAAGGFSGLGGTSGGGDRDQIGLGVEALIPIIEDLEMTVAGRYDHYFDDSATGGAFTPKVALAYRPTDTLLLRGSYGLGFRAPDLKRLFGDQTRGFGSGFDPVLCANAGGSGPQDKDKYPECDTQYFDTLNGPNSELKEETSTNINLGLAWEPVDDLGVTVDWYHIKMEDVVTAPTYQDVINDPGKYPGTEVVRNPDGTIKSVSYGPVNQSYEERSGIDLAIKYAYDTNEFGSFNTRVAVTKILIAEYQENDSEPVTDERDFMPEYTATLNLGWAYEDVAINLFGKYRDRMCSSYANRYYFDDCDSAKKAGYKAEIASMTTWNLTASYQFNESGRVTLGAINMFDKVPPADPLSDTSPFYATGYDDPIGRQLYVEASYDF

SEQ ID NO: 20918 - protein, 373 aa, Vibrio vulnificus
MSYLKKSLLATAITGMMFSSSAFADGANSDAAKEYLTKDSFSYEVYGIIAMQAAYRDYDSGDAKQDDNLGGMQLNNESRIGFRGKKQFANFEPTFIWQIEGGYVDPSFGGEGAGLGERDTFVGFESASWGQVRLGRVLTPMYELVDWPASNPGLGDVYDWGGAIGGAKYQDRQSNTIRWDSPMFADKFSLDIAAGAGDKAGLGEGDDYWGGIAAHYKLGPLQLDAAYEGNRNIQSENEIWENNTYLVGVQGWFENGISFFAQYKYMEADASNGVSEKQDAMSSGLMYTTGDWQYKLAYAANFDLERDGKTIDNTADDVLSAQVMYFVDPSAVLYARARTLDFGDGAPRLDKPSEARGKSADFDEFSVGVEYYF

SEQ ID NO: 20919 - protein, 361 aa, Thermosynechococcus elongatus
MSRIALFVLGTILQIPLQANAQETEESDRLQQLEQRVKELEQQAKAAQTSPSMQSSLRNSHFSLYGSLRPTLEYQDKADDVWDIGDALSRLGVKADTEFAPNWHAIAQGEWKIRLDDNGRFGEARLAFAGIGSPFGQITFGRQRPVQYTLVAEYIDIFNNANSPFGYNQESPFFVNNALIYELKLKPVTVMASAIFDGNSGGSGADTINVGAGFDKNGLHLGAAYLQQDVYANANRTGKEQLTGAVISYEFSSGIYAAVGYQAKDYEFETAVNRTGSTFDSALAIPFANAYKLKLGYFWFKDGIEDASSQDYDGYNLTLEWQIAANVRTHLEYLQQNNDQREDDTIIALGIRYDFDLNWEF

SEQ ID NO: 20920 - protein, 205 aa, Thermosynechococcus elongatus
MAQLYFYYSAMNAGKSTALLQSSYNYQERGMRTVVYTAEIDDRFGAGKVSSRIGLSSPAKLFNQNSSLFDEIRAEHEQQAIHCVLVDECQFLTRQQVYELSEVVDQLDIPVLCYGLRTDFRGELFIGSQYLLAWSDKLVELKTICFCGRKASMVLRLDQAGRPYNEGEQVVIGGNERYVSVCRKHYKEALQVDSLTAIQERHRHD

SEQ ID NO: 20921 - protein, 999 aa, Thermosynechococcus elongatus
MEQSIKSKGFEHRLLLIMWGLLLSLSAFAQQITVKGHVVDATGEPVIGASVIEGKSTNGTITDIDGNFSLNVSANSALTISFVGYKTQTVSVNGKTALKVTLQEDTEVLDEVVVVGYGTMKKSDLTGAVSSVGVKDIKDSPVANIGQAMQGKVSGVQIIDAGKPGDNVTIKIRGLGTINNSNPLVVIDGIPTDLGLSSLNMADVERVDVLKDASATAIYGSRGANGVVMITSKRGAEGAGKVTVNANWAIQNATKVPDMLNAAQYAALSNDMLSNNDDNTNPYWADPSSLGKGTNWLDEMLRTGVKQSYSVSYSGGTEKAHYYVSGGFLDQSGIVKSVNYRRFNFQANSDAQVNKWLKFTTNLTFSTDVKEGGTYSIGDAMKALPTQPVKNDDGSWSGPGQEAQWYGSIRNPIGTLHMMTNETKGYNFLANITGEITFTKWLKLKSTFGYDAKFWFADNFTPAYDWKPNPVEESSRYKSDNKSFTYLWDNYFVFDHTFAKKHRVGVMAGSSAQWNNYDYLNAQKNIFMFDNIHEMDNGEKMYSLGGSQSDWALLSLMARLNYSYEDKYLLTATVRRDGSSRFGKNNRWGTFPSVSLAWRVSQEDWFPKDNFLMNDLKLRVGYGVTGNQEIGNYGFVASYNTGVYPFGNNNSTALVSTTLSNPNIHWEEVRQANFGVDMSLFDSRVSLSLDAYIKNTNDMLVKASIPITSGFEDTTETFTNAGKMRNKGVEMTLRTINLKGIFSWESALTATYNKNEILDLNSETPMFINQIGNSYVTMLKAGYPINVFYGYVTDGLFQNWGEVNRHATQPGAAPGDIRFRDLNNDGVINDEDRTILGNPNPNWFFSLSNNLSYKGWELSVFLQGVAGNKIYNANNVDNEGMAAAYNQTTAVLNRWTGEGTSYSMPRAIWGDPNQNCRVSDRFVENGSYLRLKNITLSYTLPKKWLQKIQLENARISFSCENVATITRYSGFDPEVDVNGIDSSRYPISRTFSMGLNFNF

SEQ ID NO: 20922 - protein, 696 aa, Thermosynechococcus elongatus
MRSNFARHPVVVAIHLMLGFIGAHAGAAELTETETAKETSPAVTLPTVHVTTDWLGAPDSSAAKKHPGARSVISEGDLANTGARTLDETLRQVPGVTVLDESGTGVLPNIGLRGLNPLRSEQVLLLQDGIPMTLAPYGQTGASLFPLTLNAVEAVDVARGGVAVHYGPNNVGGVINFVTKRIPVKPSFTLKETLSIAKNGRILSDSYARAGGFVSDRLGLQVQANVIDGQGERAHSDTSTRNLMLDADWFASDATEIKAGLQRYTTRNELPGALTPRAYAQDRTQSTRPQDRFDGETTRAYATYTHQFGDGTELSWNNFGHRSLRTFAFGNASNADTASTQRQSSPREFWVYGTEPRLSFDVNGPVKQKIMLGMRYMREEVDYKVDSTTLVSGAYSVTRDWRFENDAYATYVSDTFSLLNGKLKITPGVRHEDVRLSYRNNATGAQTRDTTKDWLPGLDVGYQASNDVFLFANAHKSLRPVQFTQITYGGDLAAERAKNLEAGARWAATPELDLALTGFRFQFDNKLEFVNATVGFRNLGQARHQGAELEMKWRPQAVRGLEFKTAYTQVDTEQQSGSFKGNELPYAPRHQLALDTTYRSQGWTWNLNGHYQSGMFSDGANTVAENASGSVGRIPSYWLWNAQVGYAFKWNGTRMKAGLALNNLFNRDYYFRGVDYSQGRMPQPGRAVLASLQMDL

SEQ ID NO: 20923 - protein, 287 aa, Shewanella oneidensis
MKYKKTFTVTALVLLTSFTHFIPFYSPARASTIHNFYISGKYMPTASHFGIFSAKEEQSFTKVLVGLDQRLSHNSINNNDTAKSLKVQNYSFKYKNNPFLGFAGAIGYSIGNSRIELEVSHEIFDTKNPGNNYLNDSHKYCALSHGSHICSDGNSGDWYTAKTDKFVLLKNEGLLDVSFMLNACYDITTEKMPFSPYICAGIGTDLISMFETTQNKISYQGKLGLNYTINSRVSVFAGGHFHKVIGNEFKGIPTLLPDGSNIKVQQSATVTLDVCHFGLEIGSRFFF

SEQ ID NO: 20924 - protein, 741 aa, Shewanella oneidensis
MAMPLNHPRPTLLALAVTALMIAPLAHADGTADPSARTLDTVQVTADGDIVDSYTVKRASTATKLGLSLRQTPQSMTVVTRQRLDDMGLFSLSDVMGQVTGVAVSVTDSERINYVSRGYNITNFQVDGMLNTFGGYIKTNTDSVIYDRIEVVRGATGLTTGAGDPSGTINFVRKRPTDSFQMSANLTLGRWGNQRLEADLGGPVALDGRIRARVVAAKQQSDSFRDVYKLDKDVFYGIVQADITDTTLLEAGYEYQSPRTTGVTWGVVPYWGSDGQPANLPRSTNPSARWSSWPIIEKSAFARLEQQLGNGWTAKAAYTRSKRETDGAVWYGASGYPNADGSGISAFVGSFGENGDMQVFDFNVGGPFLLFGREHELVLGFGQSVRKGEVPATDTAAYPDSYTRVPDWHRWNGDVAPLQVTRLGYLASEDELRQRAAYLATRLQLADPLTAVLGARYGSWETRTWNYTHDAAGRLTDTRRSGYKPDDSLTPYAGFIYDFNRYFSGYVSYTDIFQPQNYRDRDNNYLEPVVGDMWEAGVKAEFFDGLLNASAAVFKGQKDNVAELDDSVPENSLPGGVSAYRSTGKGNKVKGWEIEAQGSLGENWNLAAGFTHTVSRNAQGVRQNTVVPVDLFRLNASWRPGGAEGRFWLGGGATWQSGIWSLSNKPRADFLTSGKRDRVAIEQGDIYLLNLSAGYRFNENFTAQVNVNNLLDKKYYNRVGFYDGVFWGEPRNVTMTLRWKL

SEQ ID NO: 20925 - protein, 725 aa, Shewanella oneidensis
MGLAPSVVCLRADLPPPRPSSAGRGFLMTAYSFRAPALRCAPLSSHLTPCALACALLLAGPALAASDAVNNAAAAPEHTLRDVVVTAVHDHSPVQVVADPKQPRQPVPASDAADYLKTIPGFSAIRSGGSNGDPVFRGQFGSRLPLLTNGTQLLGACPGRMDAPSSYISPETYDTLTVVKGPQTVVWGPGTSAGVVRFDRERPDFTEPGVRLSASLLGASAGRNDQNVDFQAGNAQVYVRVTANHSHGQDYKDGDGRRVPSAWDKWNTDVALGFTPDADTLLELSAGTGDGEARYGGRGMDGTQFKRESWGLRFEKRHLTPWLAKLQAQVYGNRADHVMDNFTLRTFQPGGSMSMPMASNVRRTTEGARVAATLQWQPDWQLETGLDAQRSPHDKRSGTPSVPYDSKPWMRDAKFENLGAFAELSWQAQADTRWVGGLRLDRAEAWRYPAPSGMGGMAPAAGADHRTRSAMPSGFVRWERTLAPQGALVYAGLGHVQRFPDYWELISPGNSAASAGNAFATLRPEKTTQLDMGAQWKGADWQLWTSAYVGVVRDYILFDYTGMKSAVRNVDARTAGLELGASQRLGTAWTAQGTLAYSWGRNTSEGRPLPQMPPLEARLGLEYAQGPWSAGGLWRLVAAQHRHANGQGNVVGRDLGASAGFGVLSLHAGYRINAQLKLAAGVDNLLDKNYAEHLNLAGNAGFGYPGGVRINEPGRTLWLRADLQF

SEQ ID NO: 20926 - protein, 1039 aa, Shewanella oneidensis
MVMLLLFLPSMAIKAASQSLTVSGVVTSATDKMPLIGVSVLVKGTTNGTITDFDGNYSLGVEKGQTLVFSYIGFVTQEIVVADQKTLNVEMKEDTETLEEVVVVGYGVQKKKLVTGATVQVKGESLAKMNTNSPLQAMQGQTPGVNISSTSGQPGSDMKVSIRGLGTVGNASPLYLIDGVGGDISTLNPADIESIDVLKDAASAAIYGAQAANGVVLITTKSGKEGKAQIAFDAYYGVQNVARKADMLNAQEYMTIMDEQAVNSGNAPYDWSSFKSIYDANGNVYDTDWVDSMFKDNAQTQSYTLGVTGGSKTSTYAMSLGYMSQEGIVGGKDVSNYERYNFRINSEHKIFKDSDLLKVGEQVSFVYKLNNGVSVGNQYNNTLRGAFSTSPLSPIYSDNNIYDSPYNDTSNSDWYNGDGNPYGLMMTNTNNENKNAVFSGNVYAELQPVKNLKLRTVFGAVYGSSEYRSFTPMYQFSIYSYNNTRTSASQNMSHSLGMTWTNTATYDWKVKDHAFNALIGMEVYQYSGTYLSAGTGTLREGFDDWDHAYVANGTASSADDGMSVDGYPQDESRSVSYFGRFGWNWKETYMINATLRADGSSKFARGKRYGVFPSVSAGWTISNEKFMETTQNWLDFLKLRISWGQVGNQNIDNYQYTAPITSSNTHYIFGTNYGASAQSGYWGAYPSRLANSDVTWETSEQTNIGIDARFLRSRLSLTADFYIKTTKDWLVEAPILATAGTGAPYINGGDVKNTGIELALNWNAQIGSDFSYNVGINGAYNKNKVGNIPTEDGIIHGDVNMLYDNSPEFYRAENGHAIGYFWGYQTAGIFQNKEQIANWNADGKHGILQSDPQPGDVIYVDQNQDGIIDDNDKVDLGNGTPDFTYGFNLGFNYKNFDFSLVAYGAAGNQIVQSYRNHANSKANYTSAILDRWTGEGTSNRIPRVTNTNINWQFSDLYIQDGDYLRISNITLGYDFAKLINVKAISQARLYFQVQNAFTFTKYDGMDPEIGYGTSDWVSGIDLGYYPRPRTFLVGVNLKF

SEQ ID NO: 20927 - protein, 467 aa, Shewanella oneidensis
MKCGVSLCLALSTAPGAALADDSLGHRDNISTGLNQRQKAEMKVPPGFVEGSTLNGFIRNYYFARDNHDTPARRDQREWAQGFMLSFRSGYTDTPVGVGLDVHGFYGLRLDGGGGSGGSGVLPLDARGRPQDRFSAAGAALKLRGFDSLVKIGDQLLENPVIASGVSRMVPQSYRGVTLKNYHLQSLDFDAGFVEATRLRNQSGHSPLTTGYGNGTKGGIAADRESPHIAWLGANYSAPGGAVANLYSGRLADIWNQHYLGLSQPFRLSGRMTLTPWLHYYKTRDQGRSQLGRIDNDLYNAGLTLAGGGQSLSFSLQKVDGDTPFDFIAQNDRTFLYESNAMQYADFNGPGERSWKIQYQASLAFLAAPDWQFGAAYGRGEADLTRVDPHSAGYGYLYNPDGRNARHWERDLSLRYAFPAGPAKGLSVTLRWATHRPGEGYTAPGNTRGNSSSDEYRVVVDYPIRLL

SEQ ID NO: 20928 - protein, 914 aa, Shewanella oneidensis
MKKLSLFFLFCLTALSFSFAQTTVTGKIYDGDSNAPLLGANIMDVSSGNGTITDFDGNFSLSVGSTSGELKISYVGYITKTVAYNVSEGKTSIGSVTLAPDEATLSEVVITTSGVVDLAKDRKTPVAVSTIRASEIRQKLGSQEFVEILNTTPSIYATKQGGGYGDSRVNIRGFDTQNSAVLINGVPINDMENGIVYWSNWAGLSDVASAIQVQRGLGSSKLAVSSVGGTINVVTRSADRSEGGFVSTSVGNNDYIKTLASYSTGLSESGWSGSFLFSRTAGDGYIDGTKFEGFNYFASVGYQPNENHGLEFTVTGAPQWHHQRSRASSIDAYIQYGGGEEPRIKYNEDWGFRNGEEYSFRRNFYHKPILSLNWDWTISDATKLTTTAYASFGRGGGTGEIGEINGRRQFALPRTDNGLIRVDDIVAYNSGQLVPDFSAQPRAQVNGLYLNNSDLNDNENNTNGITRRASINSHNWYGVLANLNNKLSDELTLDFGIDLRQYKGFHYRRVNDLLGGDAYQQTDNRNNPVDDAALSNIFFETYDADQPWWVFADIDDEEKIDYYNTGLVNWAGAFGQLEYTKDNISAFVQGAVSNQGFAREEFFGTTPAEKTDYENILGGNIKGGINWNINDNHNVFGNAGYYSKQPLFDAVYINFSNQLNPDLVNEQVVGFELGYGYRSRNFRANVNLYRTSWADRFESVSATFNEDTPDEIRGTANILGITQVHMGIEADARYRINEFIGVNGMISIGDWQYKDDVVATYFDNNQEPVVIDGESQSVLLPLDGVKVGDAAQFTASLGADVKLYKSLQVDANYRFADNLYAAFDASDVSEDGALKLPSYGLLDAGMSFSIPSFLGEKMTFRLNINNVLDEVYISESDTNRFAQEGDATYDGIATSNRVYFGFGRTWNASLRFDF

SEQ ID NO: 20929 - protein, 448 aa, Shewanella oneidensis
MQKRLLTLAVTAALLSTTTQVHAAGFQLAEYSATGLGRAFAGEAAIADNASVQGRNPAMLTYLEGRQLSAGGIYVMPNVDVKGDVSLSSPLLGPNPIVMNGDAIDVADDALVPNFYYSNQLNDQWTWGLAVNSNYGLSTELPKTHAAAIFGNKTAVTTVEFNPNIAYRVNDAVSVGGGVRIVYGEGEIGASLPGWVDSIKPGLPAQVSAMLPPGGTELKSMKGDDIGYGWQLGTSWQINPTNRVGLAYHSGVKFELDGHASGVIYDGGQNLSIEGYIPLELPAFAELSSYHQLTDNWAMHASVNWTDWSVFDQLVAYFPGEVKPKGGLESDLVKEENFEDNWRFALGTTYQVNNEWLVRAGVALDKTAAADEWRTTTIPDSDRLWFSVGAGYQATKNLNVDFALTYIRATGDAPINEQQNLLNLATVSFNGEASGDVWLAGIQMSYKM

SEQ ID NO: 20930 - protein, 250 aa, Shewanella oneidensis
MKKTCLCLALMLSPQAFAGDLVQWWDFSATALYGEDYDLAPSDKQATVTLETAGAWKYGDWFAFQDFIYFKGDHTGMDSTTYGEISPRFSASKILGEKIAFGPITDLSLALTYEEGEGPVHSLLYGLGVDVAVPYFTYLNFNTYRRDAMSSGNISDGWQFTPVFRIDIPVGSANIVLDGFIDWVFATDNSGYEENFHFNPQLKYDLGKSLFGDHKANKLLVGIEYDLWTNKYGVKGVDQDTYSVIAQYHF

SEQ ID NO: 20931 - protein, 219 aa, Shewanella oneidensis
MAATALALTAPAAFAADAIVAQPATEIQAVPEALSPWQIRVRALGVIAENSGYVDGVAGSDLNYSKSITPELDITYYFTKNIAAELILGTTYANINGAGSLDGFGKIGKVWILPPTLTLQYHFTNFGAFKPYVGAGVNYTFFYNQDAGSVDYLKVKNTFGGALQIGFDYMLNEHWGVNFDVKKLFLEPKFDATLAGGAEVSGKAKLNPWLIGTGITYRF

SEQ ID NO: 20932 - protein, 881 aa, Shewanella oneidensis
MNALPIKPRHLLRASVCALFATNMSPALAQSGAGTHSTLPAPDDNAQTGVLREVVVVGVRASLASAQEIKRDKLEIVDSIVADDITKLPDFSVTDALQRVTGLQIARDRGDGTGISIRGLTQMETTLNGREVFTAGAGRNFDFADMASELVSGIDVYKTSSAEHIEGGVGGLIDLRTRRPFDFKGREIVGSTRLIYGDLADRNATQFSVLASNRWKTTSAGEFGVLVNLAYQDRAFREDQKGTGNPQARTDLMAGQTVIAPNGTSETISLGNRKRSTAHVVLQWRPAADLELYAEGSYTEFQTRQNSWQSNVLASPALVPGSAAVFPGTNDVSHITWMNAPVSILSFARDTLDRTKQAAVGGVWSGKALTLKSDVSYTQSSNTLFFSGLTLGGTAANFTQDLSTDVPSSSITGTNLLDPANLQYTGIAYRLRRFEGDQATVRLDGEYEVSDSLVNTLLAGVRYARRGASNASGLVVADAGVAGIPVAALPQYAMVNPYDFYAGTASIRNTLVGNLDTARDAVGLRNAFGITTPIPATASPLSLWDISEDTQAAYLMARFTATGLPLKGPLDGNIGLRVVSTHERVAGAQSVPATGAVVPVHVDSRYTDYLPSVNLRYLLSPGLYLRAAASRTLTRPNFDQLSPSLTLLPNAINPALNQGSAGNPELKPIRADNLDLAVEKYFNKSTAVHLTGFLKKVEGFVTTVSSPEVVDGVAYQVSRPQNSAAADIKGFELGYQQFYDFLPSWLSGLGLQANYTYVDSETLDRTLGEKVALQNLSRHSVNLIGMYEKGRLSARLAYNWRDKFLSGVTNIVGVGALPIYTRAYGWLDASLSYRFSEKISFVIAGTNLLGTRRSSYYGVETRPQSSWINDTQVSLAVTARF

SEQ ID NO: 20933 - protein, 730 aa, Shewanella oneidensis
MKFAKRRNGRVALGAHVLGSLTIGMAVSATPAIAAEQAQVAGKKVEHIEVNGEYLGYNTRKVQSGKFTDDLLNSAKTVTVINQDLIKDMGAQSFTDALRATPGITLGTGEGGNPYGDRPFIRGYDAQSSTFINGMRDVGSQSRETFNIEQIEVLKGPSSVYNGRGAVGGSINIVTKKAQAEDFINADVAIGTDALKRASLDVNHVIADEAAVRVNLMAHDANTPGRDEVSGNRWGIAPSVTFGLTTPTKVTLEYYHFENHDIPDYGIPYDQATGRPADVDPNNFYGLLSRDFRDNNDDTASVLISHDFSNDMQFTSTSVYSRNTNYYIVTNPDDTTGNVANGYVWRNTKSRHSVTKTLATQLQLAGEAKLAGFTNRFAIGTEFSNERTSNLSYTVDTGNGRNAGCNDALLANYNCTLLSKPNPHDPWVGSVTLGTDATVTETDTRSVYAFNTIELNESWMINGGVRWDDYSTAAQNSTSSLSNDDDFLNYQLSVLYKPAVNGSIYAAWGTSSNPPGTSNGDGSDRLGSNNEDLKPEDTESYELGTKWDFFSGRLSLNGSVFQIEKNNARVATSADRNSPQENVGEQKVKGFEIGFSGDITEHWHGFGGYTYLDASLESNGFNAAYDGNRFPNTAKNSISLFTTYDITEQLNVGTGAYYMGQVYGNTANTLSIPSYWRFDVVSSYKMNDFLTLRLNVQNLTDERYYDKAYTAHFANMAPGRLVMLSADMHF

SEQ ID NO: 20934 - protein, 356 aa, Shewanella oneidensis
MKKTFISASVASVLALASFGALAEGPSFYGRLELALTNTETGATLQSGTNGLEANYADENNAGTYLENNFSLLGVKGSEKIADGYDVVYQMEFQVENTSGTGDVFKARNTYLGLKTNAGTVLVGRNDTVFKQAEGAVDVFGNTNADIDRLISGQTRSADGIWYYSPKIAGLVTLNATYLIDDNEKVTSAEGKDSSNDYALSATLGDSKFKEQNYYLAVAYNKGISGIDAYRGVAQVKLGQFKLGGLFQNSESVADSSIDGNTYFVNVVYDLNGVNLKAEYGYDEAGFGKYYSTLGQAGADDISVNNFNVGADYRFSKSTMVYGQYSMYKGDYKDTTGAKIDLQDDNVFSVGVRYDF

SEQ ID NO: 20935 - protein, 491 aa, Shewanella oneidensis
MKIYNFLLLTLIFSSLPIKAGENFSGNFDVNNWSTVGSSGDGSLDTNNAPDSITITGPNDGSRGSAQKFFIEIPSGGSGTYSFDWAYTTNDTPFYDFPNLINGSSTTLFTGYQLHGDFNQSGSISTDVEAGDNFGFEIETNDGVGGRAFLTISSLVTPDPPDTGTEWVQPYTAMQNIGLASIKNNRDLVLAKAGQCNNYGWVIGDTDYCVYTNANNTTASVNGNSSYGGYDYTKFNTSLNVEKTINDRWKAGVAYGVGSSNLNNYNFSSTTASLSSTNTHYSIYGVKKVSDKFTLKGMIGGSDFDYKGNRNYSTTSATSAYDTDGYTAEINGIWDMKKNIKNMKTPIRLQPTVGVAYAAHTQDGFSESGSGDLITIDPNQAESLLFKTGISIDKQIPMEGGKWILVPSLALNYEMDPYSDDDHRSIKGGLTESSTAHTKVSSKTLGQHNGSVKVGADFICTKDFMFNLNAEYGLAEGGDEQSYGGGFRWQF

SEQ ID NO: 20936 - protein, 671 aa, Shewanella oneidensis
MKYLRTITGLALAPALCFSQEINEIIEVNAQQSGSEWRMTPGSVDLIDINQQLPSLNIDAGDTLRAIPGIQADTRYNYAQDTRLVVRGFGARAAFGVRGLQLNVDGVPLSMPDGQAQTSSIILDEAETVEVFRGPLAVLYGNTGGGVFEWNTRAPQRTTSEIAVAAGANDLTRAKGQFDWVNDAHKLRFIATDLYTAGPRPHNTAKRQQQGLRYYFDINDQQQLILRYDNNNAPLLEDPSALTPSAWRQNPDQTVSRAIDFNTRKSIHHRQGSLTWKLDADGYRARIAAWQGDRDVVQFLPFAGDAIGSSGAVIDLSRQFEGSSAYVEWQATAQTDIGFGLRYERQQDHRFGFVNDEGEKGDLRRSEFNYVRKQAVYTRLTHRFNEQWRITAGARHSRFDFSVDDQFIMPGDPDDSGQNELSDNSGAVGLTWAFAPRWSTYISLGSGFETPTLTELAYRNNGSGLNTELSPSQYRQTEWGLKFNSAGRFSSQLAMFDIQSEDDIVIDQSNDGRTTYRNAGETERQGIEWQLNVQLTEQLDSFVSYSYIDANYQGGLYNGNQLPGVADSQWFTRLTWHPTQATQVQLLGQYRGETYADDSNTVKAPSYVKWDLAITQQWQIAENEFEAWLRVDNLLDRNYVGAVVVNQGSGRSFEPGIGRSASIGISWHHLF

SEQ ID NO: 20937 - protein, 281 aa, Shewanella oneidensis
MNKKNVLLSLCVVAVSSPSLVQAADTVVVSRAVSKTQTAQNAMSVVDHSDLSWGGLYFGVQVGGISGNLSLNRKAVSGEDKSSSETLPKLSGFIGGFYLGSNVEFGGGLVVGVDTDVVWSNQKYKQLSDPIHVDEEVLKLHQALMSDYGHNSNSLKIGDKIAYNVTRKTNWIGATRIRFGLAGERMMPYVAGGIAYTQLQVTPWFEVTPTKGEVSSIDFMNDKKTMVGYTLGAGFEFLMTDDVILRTEYRHSDFGKKNFLKDTSKVSYKTNDVRIGVAYKF

SEQ ID NO: 20938 - protein, 191 aa, Shewanella oneidensis
MDLADSQITQGNEIIQSMGLTNVRLLEYFIYQVGSFTIQSLTQHIEENKEFANITENELYSAVLSLVILGYVYVYLTTYPIYSFEDNKTYIPKSFTQYVKTLVEGANQYIGAGNMYNGDVEDLNKLHLYIMSQMEKPTTKAELKSALQGYLIQNEYQDMNNNDKLIDETYDCTELFNALFDVLTRLGISSL

SEQ ID NO: 20939 - protein, 887 aa, Shewanella oneidensis
MRPSSFKKSVLATNIAILLGSAVSISAVAAEAEAAAAAAVPENIEKIEVRGIRASNKANINEKRFSNAVVDAVTAEDIGKFPDSDVGQALGRVPGVTVGRTFGQGSSVSIRGTDPLMTLTTLNGQNVASTGWYDQMNVDRSFNYSMLPSELIGGMEVYKSTQANLVEGGIGGTVIVKTRKPLDMDANSVFASVKGEYGSVNEDVAPELSGLYSWKNDDETFGVLVAGSYIDREYLRTGTEADLDWGGRSSVQPSSFLQEQERTALDATVQFRPTDNLEFGAHVLSLKLGADSIGANMYIETDTNWGEGASHCKQFNAAGVCTLSVTPESDPSNVFFQNWARKGEMTSDTFELNADYKGDGFAISGVAGKTKAEGGTQMSANFGYGWWGDKFGQVKWAGTVDATGKQIDINGRDMGFTQDQLDTTVGTSTWTGIKGPNSDEETYLQLDVDFDLDFGVINKFETGVRYTQHEFEKSEYRAIYDPAKKNEFKTSDLYSGTMKLGYDGWTIPKADLDAMINATESLVDQFAYSRSAYGLIEEDNFSMYGMFSFDGEGFRGNFGLRYIQTDVTSSGHIIDNSPADVLSVNQGWSEEIHSISDSYSDVLPSFNISFDLAPDLILRMSAGQAITRPNYDNLFLSTSTGYPDDRRGNEEITYGNPGLKPMKSSQADLSLEYYYGDGNLVSATYFIKDISNFIVATTQYNQQIGVVNNDLETPADNWTVNNYENAGGGEIDGIELQLNHAFDNGFGVNANYTYADGTAPAEVYTDNIGMFTESSKHSANLVGYWENDDFSARAAYNWRSEYMVREYGKYYGNRMHDAFGTLDVTLGWNVTEAIALRLEIVNLTAEDDVQYGAAGVGTEVKPALQDDFPTWSFKGETTYKLGASFVF

SEQ ID NO: 20940 - protein, 428 aa, Shewanella oneidensis
MKSFNKTLLAVAVALASSQTFASGFQLNSQSATGMGRAFAGDAVIADNASVLSRNPAAMALFDKDAISLGLTYADITVDVKDVNFGGGAYDLGSIDDAGSSKVIPNIFYIHPIDDKFAVGFAAFSNFGTGTDASSLSKNKPAAPFDLLGETEVTTVNFNASVSYRINDMFSIGAGLDAVYGEGRLTRNMGTTPLVDVDADGWAFGGIVGATVELNKDNRFGISYRFSPTVNVEGDINTVSMTTIPGVGAVPVTTSFDSLDVPLADIFQVAGFHQITPKFALHYTAQHTQWGNFDQITAKDGTATIAAVGVTQPVGDVALKEYQWKDSWLFSVGGTYTINEQFTVRAGYMHDQGVVDEISSISFPDSDRNWYTAGMSYHINPQNTVDLGIAYIKGEEVHLIENSAITGPVNAVTESKGMYYSVQYSYQF

SEQ ID NO: 20941 - protein, 389 aa, Shewanella oneidensis
MKKKLLAVMIPAVLLSGTTQAVELYNDQTNSVNMMGWLGFAALNDGHETSVIDNFSRVGFRFDRQEKNGWRSFAHTEWGINMVTSDDGLIYTQGQGGGQLSASKTSDFLFNRLGYVGMSHDKWGSLTFGKQWGAYYDVAYTTDVLNAFTGWSVGAYTFGDGGLTGAGRADAALQYRNTFGNLHIAVQYASKQNSDVALYDNLGNALNDGSELSFDPSYGASATYYFTDKFKVLAGFNRGDFTGNLAGKDVDNTNQIIGIGAQYGSFYQYAPGRDADGLYVGFNAHKSEQNELVGGDLYDSTGAEFIVAYHYDNGFVPSLLLTYQDLDTDENTVIQGKWTRQFAVLGLHYRYSRDTIMYAEAKIDFSDMDDKAYEDLQDNNYAVGIRYFF

SEQ ID NO: 20942 - protein, 298 aa, Shewanella oneidensis
MPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 20943 - protein, 900 aa, Shewanella oneidensis
MRANSTLAKAVRFALISGATTAVLSTSVAIAAEDGAKVERIEVTGSRIKRTDMETATPVTVLSADDMAKQGFTNVQDALQSLTSTTGAMTTQSVHGFTPAASSISLRNAGASRTLTLINGKRLNQYPKPAGGTDNFVDTANLPMEAVARIEILQSGGSAIYGADAVGGVVNIILKRDFDGVALKYRHGDTTEGGGGSDRIALSLGSSSERGNVSTFIELTDTERLAATDRAAFGLDTDKVPYSKYSQYSSYGAAISGGPKGNSVAGSIPQERCTAEGYLWYDGTCGFDRSKWRDLSPESTRFISSTNFNYELADSLSFVGRLDFAQAKSTTLIEPMGIDNYKVKVDGDKVTLGVNLDPTLSKTFDKTTGLGGDFKNAEDGNYTYIRRLHEFGNRGGETNTRNYFFTAGLEGVIADDYSWDTSVNYGRTNVDVYSSGFATVGGLFNYLAEGTNGRSLLAPISKDNVQDIAYTPFEKAQSTQKNVQANISGPAFELPAGSADFAFGAEYTIQDYASESDSESVKGNILSRGGSSGSGERSYWATYMELKLPIVDSLVVDTALRYDRYDDFGGNLSPQLTVEYRPIDELLVRGSIGKVFRAPDMHRVYGDATRAYSNVIDFKQCQALGGIPSQPNSDPTLNKICNELNIDITTGANKNLKAETGYTANIGTVYGGEGLNASLDIWEWKLDDMVSDISASKAAREYETYANMITRDASGTITHINATAQNLAYQKVRGIDLTAGYGWDIADFGELKLNFNGTYILLSEGQTDPTAAIDDDIDDGGLPQYKANIVLGWYVNDFETTLGAYHTARMHGVAYKSFKKAALDKGQPFNESANEIASQTKWNLTSAYNITDAIKVTGGVMNLFNAGPNFDPTDTGWPHYNRSSYDARGREWFIEGEVKF

SEQ ID NO: 20944 - protein, 281 aa, Shewanella oneidensis
MSNKKSFFTIGVSFIANLLLLSNAFSTENTSNYTYFKPRLYIGGQYRPAVSHFSEFSVKDTNFNTVRLVGLKKDISAVNSTNIASHTNFDFPYIAEFQDNAISFSGTIGYSYSKELRIEVEASHEEFDVKNPEGSVVDTYRYFALARAVTNNNPQTGKFTVMKNDGLSISSVMLNVCYDFEPDGILVTPYICAGIGGDFIEFFNDLHVKLAYQGKMGLSYSISPEVSLFLDGYYHKVIDSKFKNLHVQHVADLTDAPKFTSAVATLNIGYFGGEVGVRFTF

SEQ ID NO: 20945 - protein, 636 aa, Shewanella oneidensis
MQSALKPLAAAVLLTCVSSVATADSGPFSQFIVFGDSLSDAGNFPDLQSPTLGGNPTGGLRFTNRTGPTYGPGEYIGEVGTQRLAGMLGLQSLPSTPLLPALLTGNPDGTNYAVGGYRTDQILDSINGDSIVEVGGLSRTRPGYLRENPRVDSNALYYLNGGGNDIFQLNTNPVTMAQAASNLVAGVGALQAAGARYIIVSDLPDVGTTPLGAFTGQAATFNFLSDQFNAELASQLQAQGGNYVLVNNRLLLAEVRADLAAFGFDPNVAQTAVCFDASAGNCQADPVYSLGGSAPDPSRLLFNDAVHPTTAVHQISADYLYSILSAPWEVSLLPEMGRSALRAHLQQLDTELAALRGDWQPVGAWRTFVQGGYNRPEYDGYGGGDGHGLSLSLGVTHRLSEAWLAGVSLGLAENSLELGRNDSDYDMRSYLATAFARYEYQRLFADFSLSAGYLDYHDLKRTFALGITERTEKGDTEGTLWGAAVKTGFNLMQPGDRLQFGPFIGASYQKVDVDGYSEKGARSTTLSYDDQELDSLRLSLGLFGDYALTERTRLFGEVAREVEREDEDRRDLRMSLNSVPGNSFELPGAVPTGDQTRFSVGLTHRLTPGLALRANYHYRGNDNRDHGLGLSLALDL

SEQ ID NO: 20946 - protein, 890 aa, Shewanella oneidensis
MTTQTTVARAVRFSLLALVSASVTPQVFAADEAAVIDDKVERIEVTGSRIKRTDLENASPIVVVSAADIEKGGFNSVQDVLGNLSQNSGGSMTQQEVHGFTPAASAVNLRGVGAGRVLTLINGKRVPKYPFGAGGTDSFVDTANIPLGAIERIEILTTGASAIYGSDAMGGVINIILKKDVEQSTFKYRHSDTFDGGLQNSQFSFMTGVSSDKANLTFFAEYEDRQALKASDRPEWGTDIIPGNYYAGYSSYGANLVDSNGKLLKSLSAAECDARGYVMMSNGKCGFDRSAQRDFSPEQTRYSTMINLTKDLNDNHQLYSRLDYTHASTYTEIESATVGDDFMFNVSGDNVTIVDELNGLSQVFDKNTAFGGDFAGAADGDYYYTRRMSELGPRTSDFETNNFSFLLGSKGYLTDTIEYDTSWSIARQTVDSTTAGSPTYQSMWNYLTAGTNGNSLLDVISPDDAAMLDFQGGKKGQSTLSSFNAGISGDAFELPAGTVAYAVGVEYGKEWFYDKSDSFTSNGGVIGKGGSSAQGEREQYAGYAEVAVPVIENLTVTLAGRYDYYDDLSDVGGQFSPQVAVEYRPIDNLLLRGLYAETFRAPDMQRLFGEPTAAYSTVIDTPTCEAAGGTGPACEKIDSLPITIGANPELEAETGKNYNLGMVWDYNDLNLTLDYWIVEIDNLVNSPSAQYILDHSDAFADKIFRDASGKLIQVNTQAINMSSQETSGIDFSVGYRYETSGYGDVTARLEGTYLLKWEEQLTPDSEPLDLIDGDDSAPQIRGNLNLGWNYDDFATNLLIKYTDSMNGQRKEAFINNGLADKYAVTIDSHVEVNWAASYMLTDAIKFSGGINNIFDAGPEIDETQNSWPHYPRSYYNVVGREYYLAVEMNF

SEQ ID NO: 20947 - protein, 709 aa, Shewanella oneidensis
MIKRTKVASAINLAIVASITSGAFVTTSVFAAEEKAKVERIEVTGSRIQRQDMETASPVTVIDAAAIKAEGFTSVDQMLQVQTSMAGAAIGSTTNNGADGVAQVDLRGMGSQRTLVLLNGRRMVNSGSGANSSVDLNSIPVAMIARVEILKDGASAVYGSDAIAGVVNIITKKDFEGFQLDFNGSGTDKGDGRNGDVSALYGFNTDGGNYTIGAAFSDRRGVIQGDRDWTEPGASSFIPTGTLGGKVQDANGNWVARNTGYDFTQDSYYQTPSERRSLFANMTQELGNDVVLTADAIYTNRRSNQQMAAQPADIMLNVCGAAGVAAGAPCVTLDSAMLAAGIKADDKGLVNYRRRTNDVGPRIYTQDTDTWRLSGGLAGTLDVHTGMNWDLTYTYGKNQAKTAVDNSINASDMTASIYANPDAWFSGAPLTQQMINEIGYSEQANGGNEQQTLSAGLNGELFDLKAGAVGFAIGAEYRRESGFFNPDPVVVAGESTAAQQDPTDGNYNVISIFQEVSVPFTEKLTGEFALRLDDYSTFGKATTWKIGLTYTATDDLMIRGVAATGFRAPSVSELYGGNSGSFDYLDDPWGNAQDPQILVNRTSDPDLKPEESEPYTTGLVYSPSYVDGMSVTLDYWRFKVGVFQDSCHSLFKNQAAFITPSTGALSGLSVTAPTASQFLISVDQRIGFLSFAASSTFLRLAKIAPSCSA

SEQ ID NO: 20948 - protein, 963 aa, Shewanella oneidensis
MMRCCLFLSVALALHAGAAGAQTPPVAVDAIPAQPLARALNTLSRQTGLQFVYAASVGAEQQSRGTSAGAAPEQALQQLLQGTGLRYRYLTPTTVTIEPAETLSDAPAATPSAAATTATPAAAGAPVRELDSIQVLGSYAGSLSAALREKRYADSVVDVIAAEDIGKLPAQNVAEALQRVPGVSIVRDRGEGVYVRVRGLGPNFQVTTLNGQTMAVNENVRTSGQTGRQFRYDTLPAELVSGLDVIKSPTADLDEGAIGGIVNVRTFRPLELGKTLLNTSLESSQAQRTHANDPRVSGLFNWVNAEGTFGMLVSGAYAQRSLRQDRVNEVSWDYYPNGVPGAPGASYLPTGLRPTLELEQRERTGVAASLQWRPSAAWETNLDLLYAKQTVHYDEYSLGVGFDGVAKMSNLQVDHGGVTGFDYRNGQVQVSRETSGITDDNRSARLSSTWNGDLWTLGAVAFHSQAHSYDSDPIRRTRLRSASNLSMRVEMPQADDDNVPNWSFTNGFDPTNPASVSGRRLEWRQIDARDKEDALQLDAKRTLGDGWLRDIKFGAKYRERSRTYDRADLLLNRIAGVRFPGSYFTALPVSDMLVDGKGQLPRQWLAPIEAPFWGDWPTAADLSGTPNSADLQNSYEVREKIGSAYAMTDFGGALAGRDLRGNLGVRLVHTEQTTDGHADLDGAAQPVHFERSYTNALPSFNAAWDVREDMVLRTSAAKVITRPDLTDLSSKLTFNSSGEVLTASGGNPALRPFEAWQYDLTFEWYIDGTSALTGGVFYKDISSFIQTQLSYLDYQGQTYLLSSKTNGSQASVKGVELAYQQVFTGLPAPLDGLGMQLNYTFTDSQATYRDGTRRFTDSLEGVARNTYNAVLFYEKGPLMARASYSWSDNIVNAVGTANVATLNSDAFGSLDANVAWKVNDTLSVFVNAINLTGQVQRQYVGDHLFGGYTDYGRTWSLGLRARF

SEQ ID NO: 20949 - protein, 945 aa, Shewanella oneidensis
MLNTSYRLVWNHITGTLVVASELARSRGKRAGVAVVLSLAAVTSIPALAADTIEQAGETVNGGTLTNHDNQIVLGTANGMTISSGLEYGPDNEANTGGQWIQNGGIANNTTVTGGGLQRVNAGGSVSDTVISAGGGQSLQGQAVNTTLNGGEQWVHEGGIATGTVINEKGWQTVKSGAMATDTVVNTGAEGGPDAENGDTGQFVRGNAVRTTINENGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATGVTMTSGGALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNTSDQLVINGGQATGKTWLAFTNVGNSNLGVATSGQGIRVVDAQNGATTKEGAFALSRPLQAGAFNYTLNRDSDEDWYLRSENAYRAEVPLYTSMLTQAMDYDRILAGSRSHQTGVNGENNSVRLSIQDGHLGHDNNGGIARGATPESSGSYGFVRLEGDLLRTEVAGMSLTTGVYGAAGHSSVDVKNDDGSRAGTVRDDAGSLGGYLNLTHTSSGLWADIVAQGTRHSMKASSDNNDFRARGWGWLGSLETGLPFSITDNLMLEPQLHYTWQGLTLDDGQDNAGYVKFGHGSAQHVRAGFRLGSHNDMSFGEGTSSRDTLRDSTKHRVSELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 20950 - protein, 743 aa, Shewanella oneidensis
MGTEAQGRTGRDTGRPLNPLAGSSLLPGLTLPCSLACSLACSLACSLAFPPGARAQTVPPEAGEAVLAELSVTGSGERAGGPVVGYRATRSATATRTDTALRDTPQSIQVVPREVLVDQQSVRLTDALTNVSNVQPGGTIQGRSDTYILRGFRTQTYAIDGLVQSPANSFQPTQRDLANVERVEVLKGPASVLYGQGDPGGLINIVTRQPTLTPSADLTLQGGSFGFRRAQGSVSGAIPSVEGLAARFSFGTQNEDTFRDYGGPENSRHFFAPAFFWNPDPSTRVYLNAEFTHQHSQYDEGLIAFRGRVPLDNVRRYYGEPWSRYYGESNAITLLAEHDVNETLTLRQAINGQWGAFDVFATRATGVNAAGTTVTRRLTEVESIYHSIDSRTEALVRFEDPFGFRHTGLAGFEIVDGYRHPFTTQGAATSVSFLNPIRGSVPQVGTLSLQSDLRQKLNLFGLYLQDQIEFFPGLQLVLGVRFDTANQLYFQRTPTNAARPPEQNLTGVSPRVGIVWRPVEPLTLYGSYTTSFVPQSANILNVASPPPETGEQVEVGARFDLIPDRLTLSGAAFRILRANVAASDPVNTGFSIITGEQRAQGFEGDIAGEILPGWKIIGGIGYLDAEVTKDRFIPVGNRLPAAPVFSTSVWSTYQFQGGPLRGFGFGGGVTYVGERFGDITNTYKVGAYARLDATVFYEIDPTWRFAVNGRNLTDRRYIEQPFNTFNNLPGAPLTVLASLTARY

SEQ ID NO: 20951 - protein, 937 aa, Shewanella oneidensis
MHKNNFLAKSVRFALIGGVAATALNVPLVVAADEASAEKVERIEVTGSRIKRTDMEAASPVLVMNRDEIAATGLVSLGDILQTIPSAGAALNTAFNNGGNGSTNMDLRNLGAQRLLVLVNGRRWISSLGSTVDMNTIPTAAVERIEVLKDGASAVYGSDAIAGVVNIITRKDFEGVEVSVYGGENLSEGDGRQYTADLTFGVSGEKGGLLFNMSHVTQQPIWAGDRDISSVGTSSTTENTRLRVDPTTLNQANQDALAAAGYTIRSNGLYDLMSLPGTGADVGLDKFRNRAGDVYNYAPDNYLVTPQNRNAFYVQGYYDLADNLRLVSDFMMTNRKSSQELAPMPVTLGASFGAAASRVDIHADNIYNPFGETLYGDSARAVANGVVSDPLDYTPYALQRRMLEAGPRRYEQNDMTYRAMVGLEGNITDSWSWSAHYIYGQNSQDELTTGLLNLTRINQALGANCNASTACTPLNLFGGPGSITNDMIDYITFDSVGRSGLTMKDYAFNISGDLFDLPAGSLGVAIGLERREETGYDTPDPLTVTGESSGNQRDATAGGFRLDEAYVELSIPVLESLTITPATRFSDHDVYGNNTSSKVGAEFRPMDDLLLRATWAEGYRAPSISDLYAGNADSYPSWTDPCNTRDDEGNVLDISGKPGCSAVPDGYRQANTQIRITQVSSPDLKPETSESVTAGFVYNPSWLEGAELTLDYYNIKVKDAIGRYGYTRIATECAEGTNPSSCNAIDRDPLGNIVDLRNYLLNANNYDVSGIDMYTGYRFETGFGSFKTSLDMAYVIENNFNGYDQVGQQYGDGGYPRIKANFYIDWAMGDWDAHWKTRYVHSMMSNYYVDGVYDYYGIPESDYTKEFDAYMVHNISVGYSFAEYNTNVSLGINNLFAEKPESEYINNDLAMSTNNFSVTEYDVNMDRFVYLRATVKF

SEQ ID NO: 20952 - protein, 435 aa, Shewanella oneidensis
MNKTISLMTVLTTFAFAGGYKIPEQSGDSIATLASNVATSFGADAAYYNPANMIFLDPVHYLNLSSTCLHISSLKFKNESDKFPSKNYDTKSESANFYVPGMNFISPFLGDFRFGIALATPAGVGMNWEDPYPKSIAEKFYLRAIELAPSVAYKVNDNFSIGAGVRAAYAEGKVRNSVSGFAPSPIFPVSMDAGRDMKGDSVNFGYNLAATFKPNENLSFAATYRSKINLKLKGDAIVKSQIKGNKKDVDKFNALTQNAYSGFYDGDVKIDIPLPAVLTLATSFELDDFTFLFAYDRTFWSAFKELDFRYDERVPVSDMFDKPIEKNWHDTNTYRFGVAYKYNPKLRLMGGFAIDESAADSNKVRFELPETKAYIYSAGANYKVSENFGVTGAFFYQDRQKRHVNSADDVDFNNVVGTFERNHITFLNLSFDYNF

SEQ ID NO: 20953 - protein, 220 aa, Shewanella oneidensis
MNKTTVKILMGMALLSSLQAAEAELDEKSKKPKFADRNTFYLGVGYQLSAINTSFSTESVDKSYFMTGNGFGVVLGGKFVAKTQAVEHVGFRYGLFYDQTFSSHKSYISTYGLEFSGLWDAFNSPKMFLGLEFGLGIAGATYMPGGAMHGIIAQNLGKENSLFQLLVKVGFRFGFFHNEITFGLKFPVIPNKKTEIVDGLSATTLWHRLPVAYFNYIYNF

SEQ ID NO: 20954 - protein, 821 aa, Shewanella oneidensis
MGYMKIKRALVAGAFSTGVHAKRLPLLALCISSALAAPAIAQAQPAARVQFNIPAQPLDAALRRFSEQSRQQVLFSESAVAGRRAPALSGSYTPQEALVRLLEGSGVRVNATRPGVFTLAQEAATPARSKDAQTTLQTVNVTANAPSDGAYTARELSLGKLGQSIRQTPQSVSVITRQQLDDRNLTTLDEALAQTTGVTKTARNFGNHKFSIRSFTVDDSNYLVDGVAGIVYAPVGWLPIDTAVLERVEVLRGAGGMMLGAADPSGAINMVRKRPRDQAHLDLAATVGSWDNYRVEVDGGGPLNATGSVRGRLVAAYQDRDYFQRGTSSKTPVAYGVIDADLGTDTTLTFGLRHQASDTDGYWLFGLPRYTDGGALDIKRSTSLIQDWNRQEGSVDEAFAEAEHRFNERWKARLSVNRTESDLDQRVAVPLGGVDRATGIGSRFYDIYFNRSRVRSDGIDLHTTGNFEAFGRSHQLLLGAMWSRQRTRQSSADLAIDVPIDVYAPDHSAIAQPLQPAWDWSENARAQQSGVYSNLRLQLAEPLHLTLGGRLSWVKYQSSDGFTGAKSRDYEQKHEFTPYAGLVYDLGPQWSVYASYADTFQPQSSYVTASGSVLDPAIGANYELGVKGELNDGRLNVSAAVFSIRKTGNAVVDESDPGSCRGSLASSDCYRNGGKLRSKGFELEASGELAPGWQMMAGYTHVTSRDDEGATISAETPRHLLRLSTSYQLPGKWNAFSVGGGVSAQSSYSYPAYDDPDWRMGAAGRAVWDLRAGYRINPRWSVGVNVANLFDTRYYAMISQIRRGNFFGEPRNVMLTLRGSL

SEQ ID NO: 20955 - protein, 418 aa, Shewanella oneidensis
MNVFASPADFFKSYPNGSIKLDIKWENNELYYNSYFYNASYNEISPKQNWDDFKTNGLLDDIYNTLNKNYSNKNMTASILLNILEKNKLTITSKYYNSNNILLKEIIEDKFVIKIKNYDEYGNLLGETEKNEKKNTYHVKTYDKNLKYYAEMEVLFNKNEINFKGNKKNLDYNVSDSYVMESHYIFKNLNKNNLKKILSNLSSYNYEDVVNGYEKIYDNNKPFEYTEKIYKNGKLIDTKEYSTSSINTKNLKTTSKNEVQNNNNNFSNNSNKTKEVSLNKNGNSSENNSSWYYFIGALVIVIIILGIYRLLKAFPKTKYLSYGQQIRIFQILMKYNENDRYLFSARRINGIGTGYYRIRSMTVGYDKVYIYAKVFSILFMPTPIILGYLLCYDEKHILASFSEETFSKAKKEIEETVL

SEQ ID NO: 20956 - protein, 664 aa, Shewanella oneidensis
MPVRTSARTSGLLATLLLAAAPQAARAAELGFDDDANTIIVTARHAADEAERRADATPGGTDVVTYQDYADKALVSLRDTLAFSPGVYVQPRFGQEIRISIRGSGLSRGYHMRGLTLLQDGIPINLADDNGDFQELEPTLFDHLEVYRGANALRFGSGTLGGAINGVSPTGDLAHGLYARLDLGAYAMVRGLASIGVGDGDANGWFAISADRHAGDRGHARRHSLRFNGNTGFRLSDRIATRFYVSANAIDQQLPGALTRSVALARPRTGNFAGDQARDITSLRLQNRTTLDLGRATIDFGLFLNLKALFHPIYQLIDQGSTDRGLFARLDYGAGPFELTLGGESRWGTTHARRFVNVDGRRGVPTFDARQTARTSTLYAEARFRPLAGLQLIAGAIHADGYRRQVQSLPAPVVGKAAYDGFSPRFGLLWEPTRDVQLYANLSRSAEFPTFVELAQVAAFVPIRAQHAWTAEVGTRGRRGRLRWDLSLYRARLRGEMLQFTVGPDIPASTFNADRTVHQGIEAGLSLEPTGWLRLRQLWQYSDFRFRDDAQFGGNRLPVVPRHVLRTEIRFGTEALHVAPNLEWVPQGAWADYANRTRAPGYALVGLTAGAALAKGVDLFADIRNLTGRKAIGDISAVIAATPASEIFYPVERRSIYVGARARF

SEQ ID NO: 20957 - protein, 251 aa, Shewanella oneidensis
MNKSCFALLLLAATAPVQAEDLIHWWDVSGTFLYGDDYDLAPSANQTTLTLETAGGWKYGDWFTFQDLIIYNGDNFGVTSTTYGEISPRFSLGKMTGGEFKFGPVKDVLIALTYEEGEGPVQSFLYGVGLDLAIPGFTYFSLNTYKRDAISTGNISDGWQVTPAFRIDFPIGNANFVFDGFMDWVFSADNVGYDENIHFNPQLKFDLGKALFGDKRANKLYVGIEYDYWKSKYGVDGIDQNTYSVIAQYHF

SEQ ID NO: 20958 - protein, 1007 aa, Shewanella oneidensis
MKKKLLTLAIQASMFGIAPSVAWATDPIEVNTVNESANRIEIEVADKQEAIEKVTVTGSRIKRDSFSLSTPLQGLDAKDIADSGIGSLADILVDQIPALAEGVSSTNSQSSVQNTGLSTIDLRNLGTDRTLTLIDGRRVVSNSYSGNYISLSTIPAAMVDKVEIITGGASAVYGSDAIAGVVNIITQQNKTGFEINARGGETTEGGGRETTVDMGYGADFNGDKGYIFASATYDKQHGLFATDRERALYESSFAYDKKQMCNAMNTVDGDQCMRDITRDDWRERSNDIVGGRFKSNSWWYDGTELKTDFKEERDGYNGYTTGLLKVPEDTLAAAVKMNYDLSDDVRANVQVQFSRNTAFRRTDAEGQDYNDSELYIDPETGLPGSIAAGSISPNNPYVPAEIAATAGKSISWDRRFQEVGPVESDNERTTLRTWAGLQGYLFDTWTWDASIGYGKFEQRQRRSNEISIRRLKYALDAEYAADGTTIQCASEEARAEGCVPVNIFGEGSISKEGADYIRANPYINTDITQFNALGFISGELFELPAGGVQSAFGIEYRRDTQAVDTDKAMRGDAITFNDVPPFEGDVTVWETFGEANLPLLRDESFAHKLDLDLSLRLADYSQKNIDLMSSYRAGILWEPIANYALRANYSRSQRAPNITELISPPRGDYDSIRDICDGVTATSTGAGHDSCRLDPGIAAVIASTGSFEAESGSKYSPNAGNENLTEETADTYTLGFTMAPAFLEGFNLAVDYYDIKVADAIGSLSNEDILAECYNSSNPYGADNEYCQVITRDTEGQITQIIQQELNLNDIVTRGVDIAMAYEWQLDGYGELSLKTNWTHVLEFSSSYYGADGLVEDDYVGELDSGIFEDRGAISLTWRNDDWRVRWSAKYKSAMVDSHERVEEWNVLKAKNQAKLDAGDDTAVANPETPAFLFYSSYITHDLSVSYTMDVSKAELRLYGGVRNIFDNQGPWVADTGDLDETGNGNYNSAYGGGVGRYAYLGAELKF

SEQ ID NO: 20959 - protein, 301 aa, Shewanella oneidensis
MKNVKTLALAATAVAAISGNAFAADRSDIYATDYKWMQFNAMYSVDEHPIADGADAHHNYLEMEFGGRKGVVDLYGYVDVFNLGNESSGDKTDNASKIFMKFAPRFSLDAITGKDLSFGPVQEVYFSTLYNWGGGGITGVRQNDDPTKDPVAIAGDVNMSFWGVGADVMVPWLGKTGMNLYATYDLNTKDWNGYQFSANWFKPFYFFDNKSFLSFQGYVDWQFAMDEDVSGLNDFGRTNKSSEGGNAFFGLYWHSDNYAVGYGAKYYNKVYGLNNQAFATENWGGLDSTGWGHYFTATYKF

SEQ ID NO: 20960 - protein, 881 aa, Shewanella oneidensis
MAAWAMSSGAWAQGQSSQTVEEIVVTGQRAADRNAIAAKRDTVQVMDAISADDIGQMADFSVGDALKRIAGVSVYDYQGEPRFASIRGFNAHYITTTLDGLQIASPDSQNQTNGGGRQFYLETLPSNIASRMEVYKTSTPDMDGHSVGGSVNFKIPGAFDFRKDQTRFSAKLGYQIQDKSKGGERPVAQAEAFVTRRFGADEQFGLMLSASYWRREMWIPQLERGSSAYWYDASGKNTGQPYVGAGPTPVERRWYAYDNTRERRSLMGVLDWRASENLSVRTTGYYFGQNEKSLRNDMIASIGSSALVSNQTATSGVFSPRATSPGDVAQNVRSFKLLFDRKVYGLQSAADYQAGDWKLGLKLAASRATYNNPQISDNFSQNGLSFRYDVSDDEVAFTPVNQTAYNNLAAYVGGTGSSNPQHYDERYKTDGRNYEGRLKAAYNMDTRDTGLGFEFGGGGIRRQHGENYAKSYQTGMPYTLADVASTSRICALNCDAGQMFVIDQGKLIDMLDRYLATVPKIVDTASAYSRTFWIQEDVYAAYGMARWKADRWTVQGGLRLEATDVETTGFRGTTKSGKTTYDPVSASSDYSHWMPSAQAIYDLASDKKIRAAYSRTIGRPKLTDMALLGGSLNLADASLPKLTTGNPDLKPRVSDNFDVSLEWYLDEGKGMASLALFHKRIQNEIYSLGRTADIDVGGGVLVQGVLTTAVNADEAATTDGVEVNFIKYLTFLPGVWSNFGLNFNAIASKTDFPIKLADGTPKTLDSLPGQPKYVTNLSVFYEGDKLRARVAWNHTDWMTEERYISNGTTSAANFYRIRWVRPADKIDASLSYELNRIYTLRIDGSNLTGQGVNTNMGLDKEIPVARIRQPRAVMVGVSARF

SEQ ID NO: 20961 - protein, 188 aa, Shewanella oneidensis
MSSRYFRFSARCNICDNGYMYLNLPATAELASFHQVTDQLALHASFNWTDWSSFEKLEAHLETAGTHMVKVENWEDNYRFAVGATYQLQPKVALRTGIAYDTSAVSDKNRTITIPETDRTWLSIGATYDWTKDFSLDAGFTYIIAKDAPIVESRGYKSDDSAEVVGGQFVGETTGNVWLIGVQANYRF

SEQ ID NO: 20962 - protein, 467 aa, Shewanella oneidensis
MGTHGAQRKTLALAVAGALLGTGFAMAPEAKAAGFIDDSTMTGGVYYWQRERDRKDLNPTSDDYNKYTTNLSHSTANLSLDFASGYAWDMFGLDVGAFTAIELAESSASGHPNEIAFSSKNRTYDEDYSGDKGGISLYKAAGKFKYGPVWARAGYIQPSGQTLIAPHWSFMPGTYRGAEAGANFDYGDAGALSFSYMWTDKYKAPWHIEMDDFRQNDKTTGVSYLHSLGAKYDFKNDLVLEAAFGQAEGYVNQYFTKASYKFDLVGNPLTTSYQFYGTEDRISDKNDPNSIYDGLAWLQALTFGYTTGQFNWRLEGTMVKAEGNQGYFLQRMTPTYASSNGRLDVWWDNRSDFNANGEKAVYAGVMYDLSNWNLPGMAVGGSYVYAWDAKPSTNPMYDQSQRLKESAWSLDALYTIQEGRAKGTLLKLHYTQYDNHTNIPSWGGGYGNIFQDEKDVKFMVIAPFTIF

SEQ ID NO: 20963 - protein, 720 aa, Shewanella oneidensis
MKPTYLAILLAALLHPPLASADEVNQPELDKIERVSVVGVRQRLEQAGTLANTIMKTEVIDASVIENKNAVNLSEAIDNSPGVKVSNECSMCGVKRIMLNGMKGEQTTILVDGLPVHTMISGYYAVDAIPTTGVERIEVARGAGASLIAPEAIGGTINIVSYEPTENGAELDISAGENGYRKLGFLGKGVTQDGRTRATLVAQYDDRDQADADNNKVNEAPMQENRSLTARVSHDVTDTDNLVMRVANIQSEIFGGPMLGSTFADGVASSTGNVLSGYDGQSSEPQQLFEDGDVRKRYTGKAWETTEWIKTQRNEASLAWLREFNDNWNMHLTASYADHKQDSFYEGFDYTADDKMWFFDARFNYLLTDSQLLTFGADLRTEEMRSHSRSGSANPDYVSDSFDYDVKGVYLQDTWQATESLEVAMALRYDTISADFTDPNKPGTELDESILSPRVDIRLRHNDEWTSRLSAGRGYRAPLSFFETDHGILDGSLGFDIDIDELERSNSANYALSYEGERLTSTASIAWTEVEHLAALTTNDHGIPLLTQLDEKARVITSDIALGYRLTDDMSLSLTAEHFDYDSVFKSSYAIAPVEKRVTLSMDWDVNDWEIFANLVWIGSRDLSDFGYEGYNRLDANGQVDPSSKKTTDAPSYVTLDLKVSYQLNDTLSLYTGVSNLFDYTQAGDEETPLFYDAEGAFDVGYIYGPLRGREIYAGMKFSF

SEQ ID NO: 20964 - protein, 1071 aa, Shewanella oneidensis
MKSFYLSMLLLFTASLYAQTTVTGTVTNAEDNTTIPFVNVLVEGTNQGTITDENGVYTITIPTDASVLKFSSLGYSSQLITVAGRTQINVTLNISQEGLDEVVVTALGVKRNTRELGYTVQTINAKDIDEVKSVNFLDNLSGKLAGVTITQGATGVGSSSRISIRGEASFSNNNPLFVVDGVPINNNTVFNFTNEAAAGFQEVDFGNGAMEVNPDDIASVSVLKGPSAAALYGTRASNGVIVIETKDGSKKKGLGISINSSIFLDSAFQLPDFQNEYGQGQGGVFEYVDGLGAGISDNITYSWGPRLDAGNLIPQFDSPVTLADGMIVRGGDTALYNGLAITPTEFRSNPDNLKDFYETGVTTINNVSVSSGFDKGDFRISFTDLRSESIIPGVNLDRQTIATKLNFKPTDKTKIKASISYVNSGSDNRPSNGYGSENVNYSLVAWGPRSLNIDSLRDYWQPGLEGVQQYSFNYTFFDNPFFILQENRNSFNRDRVFGNIVLTQTLAKNLDLTIRTGMDYSSEKRQFLRNFSSNRFQNGGYAEHDVFYREINTDFLLNYDNKFGDFSLDVSLGGNRLSQVASTKQVQTTNLAQPGIFNLNNAASPIEAFQFESEKRINSFYGVVKLGYKNFLYLDVTGRNDWSSALATPFSADNTSFFYPSASLSFIGSNVWELPEAISYLQLRASVAQVGNDTNPFQTSGAFIAQTPFEGQPTFSAQNFIPNANLKPEQTTSYEIGTDIRFFKDRFNVDFTYYNALTKDQIISLPIAISSGFNQQVVNGGEVRTSGIEVIAGITPIVNENFRWNTTFNFSTNKSVVESLPQSDGRLTLAFSRIYDSANQTVFFQVEEGGEVGDIYGTGYLRNDDGDFIIDNNGRFIADNNLKKIGNYTADFNLGWNNDFRYKQWSASFLLDWRQGGDIVSRTRALGNVGGQLAETAFRPEEGIIAQGVVNTGTAANPNFVPNTTAVSAESYYRQFYDRNHEENNIYDASFLKLRQFSIGYSFKLKDGFIGLKEGVDVNLSLIGRNLFAITENPHFDPEQLAVQGQGFVSGVEDLSYATTRSFGFKAGFNF

SEQ ID NO: 20965 - protein, 734 aa, Shewanella oneidensis
MKPLPLAYLAVLLPWYAGVIQAQAAPAAGGDASITLDAVRVEASADASAGGLAPAFAGGQVATGAKVGILGTRDNLETPFSITAYTNELIQDRQAKGVGDVLQNDPGVRVARGFGNFQESYFIRGFILSSDDIAYNGLYGLLPRQYISTQLFERVEVLRGASAFLTGAPPSGGGIGGVINLVPKRAPNEPLTRFSAGYGSDSMLEASADIGRRFGPDDSVGIRINAAQRGGETAIDGERTRTTVFALGLDWRGERARLSADIGYQDNRLKRARPNVTLAGDAAKVPGAPDAGSNYAQPWSYSNERDVFGTLRGEYDFNDRITGWAAYGMRQSKEENSLANLNGVNGAGQGKFYRFDNAREDTVNTGEIGLRAKARTGPVGHELVASASYFDLEKKNAYVMDFFNQLDTSIYDPVSYAKPAISSTAFRGNDMDDPAKQGVIRLASYALGDTMSFFDDKVLLTAGIRHQRLYQRDYSYDTGIGGTPYEQSHNSPAAGLVVRETPQVSLYANYIEALSAGDTAPQTANGLPVVNHGESLAPYVSKQKEVGVKFEHDGLGGGLALFSTDKPRGFVGDDQVFRASGKDRHRGVELTTYGELTRSVRVLGGLTWLDAKQLSTGNAATDGKRVIGVPRFQANLGVEWDIPGVQGLTVDGRVVYTGSSYADAANTLEVPGWTRLDAGLRYMTDIGGHLVTWRARVENIANRDYWSSVGGYPGNGYLVLGGPRTFTLSASMEF

SEQ ID NO: 20966 - protein, 710 aa, Shewanella oneidensis
MPYQNLDGNPCAQSHKKLRLSALAIAITSVTSMSVLAASEAQKTTMETVVVTGSLIGNSELEDVKEYPGARTVLTNEQIKKTGALSIDSAFQSVPGIKVQDETGTGVLPNISVRGLKASRSGHAQFLMDGVPLTLAPYGHTGQSIFPATLSMLDRIDIVRGGAAVQYGPNNVGGVINLVTKPIPYQWQTEMSNRLTVFEDGDTPLNDIYLRTGGWLNDVLALQVEGNFLKGESFREHSDTDVKNFQAKLQWLLSDTQELQAFVQRYDADTQMPGALSPEDYEKDRTQSKRPYDEYQGKSTRWSLKYLHDLNIADSAELEVLTFGHRSERFFQWGYNSTKDVAWSDPSQPSTDIRTSPREFKVYGVEPKLAIYFDGNTVTQNVIVGARYVNEDIDYKLTQTPIAGGLTTTPRDWHLDTDAYAGYISNEIGLLNDVLKVTPGIRYESIDMAFYDLGKAEKTNNKVTEWLPGLTVAYHLTEQWVGYTNAQKSLRAPQIAYIRGKGEEGSELAWSYELGARYNQDSTSFKISLYRIDFEDQLQPQKETGTFENIGKTLHQGIELSGRYTLESLQALSLGAGYNYLDATIEEDGANKGNQLPYTSKHQFSWDATYAFSKLDTTLSGYYFSESYSDNANTSDEDAIGATGKVPAYMVWNFNLGSDLYKDESSKLRMNFAVNNLFDEDYYFRGIDTSPVGRYPAPGRSYTLDLNYQF

SEQ ID NO: 20967 - protein, 384 aa, Shewanella oneidensis
MKKTCIALMLPMLLAATSSQAVELYNDQKNSLDLSGWLGFAALNDSHDTSVIDDSSRVRFSFERSERNGWTAFATTEWGINMVSSDDSLVMQGGKLAAEKTEDFLYNRLGYVGMSHDEWGSLSFGKQWGAYYDVAGTTDLPNVFAGYSVGAYAFSDGGLTGTGRADSAFIYRNSFGPVQIALQYAAKTNGDVTLKNDDGSEMTNSELNFDSSYGASLTYSLTDKFKLLAGFNRGDFEGHLGNTQVDETNEIVGIGAMYGDYYHYADNREASGLYVGFNAHQSKNNELVGGELYDATGAELMTAYQFDNGFVPMIVLSYLDLDTDASTPIQGKWTRQFAMLGLHYRYSNDTVMFAEMKLDFSNMDDPALEAQEDNGFAVGINYFF

SEQ ID NO: 20968 - protein, 1146 aa, Shewanella oneidensis
MFNMKNAIRERKSKVLGLFLCFLLLGIDYSFASYNNYSQFKTLSVSMSNSTLREVLKTIEKSSQFVFFYLDDAVNLERKVSIDSKNKNIEEILSELFEGTSCTYRISDRQIFISGKAPASTEQQQNKRKISGRVTDIKGEPLIGVNVTVDGDANGSITNMDGLYEIFVTKKSVVLKFTYIGFKTSEIRTNASTNIYDVTLEEQVNELEETVIVGYGTQRKISNIGAQSSMKMEDIKTPSASLTTTLAGRLAGVVAVQRTGEPGKDAADIWIRGISTPNTSSPLVLVDGVERSFNDIDPEDIESLTTLKDASATAVYGVRGANGVILIKTKPGKVGKPTVSADYYESFTRFTKMVDLADGITYMNAANEAMRNDGIATKYTEDQIRNTIAGKDPYLYPNVDWLKEIFNDWGHNRRVNVNVRGGSEKVAYYASVSYFNETGMTVTDKNIDTYDSKMKYSRYNFTTNLNIDVTPTTKVEIGAQGYLGEGNYPAISSADLYNAAMSISPVEYPKMFFVNGEAFVPGTSTNNNFNNPYSQATRRGYDNLTKNQIYSNLRVTQDLDMLTKGLKLTAMYAFDVYNEIHVHQDRAESTYNFLDTSVPYDMNGQPILQRIYEGSNVLSYTQETSGNKKTYLEASLNYDRTFNDDHRVSALFLFNQQSKLLYPKGTLEDAIPYRMMGIAGRATYSWKDRYFAEFNIGYNGAENFSPKHRFGTFPAFGVGWVVSNEKFWQPLSKAVSFLKIRYTDGKVGNSEVSDRRFMYLDQMKENGDYGYKFGPNGTKWSGYETVNMAVDLIWEESRKQDLGIDLKLFNDDLSIVFDLFKERRENILLKREHSIPSFLGYNTSAPYGNIGIIENKGFDGTIEYNKRINKDWVIALRGNVTFNKDKWIQGELPEQKYEWMNQYGHNINGVKGYVAEGLFTQTEIDDMARWESLSDANKAITPKPFASQFGTVKAGDIKYKDLNNDGQIDAYDQTYISRGDVPTTVYGFGFTVGWKDLSVGMMFQGVAGAERVLNGSSVNPFNGGGGSGNLYSNIGDRWTEENPDQNAFYPRLSYGSETTSNINNFQKSTWWVRNMNFLRLKTLQISYNLPKPWVNKVHLKNAAVYVMGTNLFTLSRFKLWDPELNTDNGASYPNTTSYSVGINFTF

SEQ ID NO: 20969 - protein, 948 aa, Leptospira interrogans
MKNIRIKSVLCAALATSSLYVGAQNLPSELLDASSDSLSVAEEELVQVAYRKVNKKDLLGGVSSVNVEELMKKDYFTYSLDGMENMVSGWNGSSLWGMDSYLVLVDGVPRDANNVMPSEIKDITFLKGASAVVLYGSRAAKGVIYITTKRGKEGDTRIDVRGNTGFFVPKSYPKYLGSAEYMTLYNEARVNDGMDPLYSDVDIYNHGSGINPYRYPDVNLYSDDYLKKAYNQSDVTAEISGGSEKARFYTNINLYNTGSLIKVGNAKDDRTTRFSVRGNIDVNLGQYVKTYVNANATFYDGRSARGNFWGAAASLRPNRISPLIPVDYIMQNNTDAWNLVNNSRYLIDGKYLLGGTQVDQTNEIANLYAAGVNTYTSRQYQFDMGVDVDLSMLLKGLSFQTRFAIDYATTYNRYYGDTYATYEPQWANVNGQDQIVGLTKYGDDVHDGIQHIADSWNRQTMAFSAQLNYNNKFADSHNISAMLIAAGYQQGESAVYHKTSNVNLGLQVDYDYLSKYYMSFGGALIHSARLPENNRNAFSPSLTLGWRLSNESFLEDSSVLDDLMLSVSGSVLNTDLGIDDYYMYQSSYDQANGAWWGWADGNQSHATEARRGNNSDLSFIKRKEISVGLRGSLWNKMLTFDASFFKNSLEGMLVQPSNSYPNYFVSYWPESTLLPYVNYNNSTRTGFDLALNFNKKMGEVDFNLGVNATYYTNENTKVDELYEDAYRYRKGKPTDGMWGLQAEGFYNSEEEIQNSGITSSFGELKPGDLKYVDQNGDKIIDEKDEVYLGERYGWQGTPLTVGLNLTLKWKNFTLFALGTGYWGASAFMSGDYYWVYGDKKYSEVVRGRWTPETAETATYPRLTTQTDNHNYRNSDFWMYKTNRFNLSRLQLTYDLPKQWLGNSFVRSFSVYAYASNLLTISKEREKLELNTGAAPQTRFYNIGFKIGF

SEQ ID NO: 20970 - protein, 968 aa, Leptospira interrogans
METMKTIFAARTILASALAAALSACGDPLVRSETPTPTTPTTPTTPTTPTTPTTPTTPTTPTPLPALDPALAAEFRVHLNGTNTEPAHTLGFTGKGYMIGVVDSGVNRNHVTLHDQVIHNNVYVDYQDPASPDDVNGHGTNVAQLIAGQPVEYWPGGIAPGATIFSARVFSSAAESAKEGPIGGNFFEGEAAQIKRVNADMIAAGVRIQNNSWGYESEDTGGEPVWRSPITTGLFVNAYRDFVLNNNGLVVFASGNEAQPQPGQLSRLPSLPTVKGAPSAADLERGWLVVAALDSLDHPDQLTSYSNHCGIAMHYCLAAPGDVVVIHNSVTNSSSVDDEYYKLQGTSFSAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGTNNAYVTLQRLNVSAAAQALGIVDRVAQASAQRVEHAFRAIDAQQAQGGGALPTSFIGAAAALQQSSSAAVAAASLQSLSGQSHVAAAAASLDAIDLGRRSLATRLDAPRSGERIVTWHQALGGPGHNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 20971 - protein, 332 aa, Leptospira interrogans
MKLKMAPTLIALALAAAGTTAQAADDWYTGVGAGWAYAHGLDDFGKDTDKDATALSLFGGYNFNDYYAAELGYLYAGKAGIDGADFKTQGATLSGIARLPLGDIFSVFAEGGAYFNHANGNGNSDNGTAPLAGLGLTAKLSDLIDVQARYRYLWNLGDEQKTWESGMSVATLELVMHPNRTSYVAPVAAPAPEPVPEPVLVDKNFALSSDVLFAFGKSTLKPEGVAALNTLYQQIVDVQPKDGSAVVVGYTDRIGSDAYNQKLSEARARTVADFLVGKGLPAGKVAIEGRGEANPVTGTQCNSVKGKAQLISCLAPDRRVEVRVTGVQQVQQ

SEQ ID NO: 20972 - protein, 557 aa, Leptospira interrogans
MFAFNAQPFFSSLNQKSLQRKFFLVFPVLLSLTSAGTLWAKASLRLKIFANSKSDPPTQIWVRGNGYSKVFSLSDQSSELTIDLKEQGVYDVILTFKSGEMEHKFVTVDSDEKNLEFVQKTKKVTNGINVVGKRPEAPPNYVLSQEDAIRMPGGFGDALKAVQSMPGISPMYQMYTGASFQSAIQTFAQATNPDKPDKPNGEKGFLVMRGAGARANQFYFNGLPMSYPFHADGLTSVINNNAIRSLELYSGSYSARYGFATGGIINIEGFQKRDSNLSVAHLNAFLTDVYTYRNITKDLNVSVSGKKYYPNIVFGRVPNLIPAETFLADYNDYQARIGWDISENHSLSFQTFGAKDKRYPFKELSQYNPKETAQSFANPPSDADAARLDRIFRTDGIQHIWKPKSSITNTFNVSRNYFNEVTENGLDMLVLDITKIGYPPSLYKRVQTIQNEYFNDLRQIENVSEVELLKRNWKIVFGGQYREVDTGYKGKVSQIDLDPTYNFIHQQLLNSSDVKSVLEGDSVRTRQIGTFFENRFKFYDFNLNLGVRREYYDKSRE

SEQ ID NO: 20973 - protein, 885 aa, Leptospira interrogans
MYVRNMKHKILSLFFFLSLITSPVLGQSTGKLVGKIVDSESGDPVFGTVIIVRSIKAATRSDFDGKYELNLPPGEHSVEFQMIGFATQFKKITISPGARVSMNVVMGAQVLDTVEVKGRGLENSESALLALQRKSGVVSDAISEEAIKKSPDSSAGDVLRRVTGITLVGGRFIFVRGLGERYSNTILNDSVIPSPEPDKRIVPLDLFPAGVIKNIRVIKTASAEDSAEFSGGIVKIETKEYPDTLSLSVSLGVGKNTQVAGHKFKTFDTGEMNNNFGLVSKKQELPDMISGLPKAIPFVEGDRFGGIPTNLMKVGALSFNQEWSPKEEDSPFNKSFSISAGNSFKTEKWGRFGILAGTTYNRSYNYREEANARFQASNPISIYLKDSNMLRPLNQNNLKIYGEEVLWGNNLNLAYEPKIGQQFFIKTLYSVQSDKIVREGDGANYIDNFNFKSTNLNFISRTIFNNTLGGEHEVRAFSARPHKVEWNVNYALAERDEPDARNQAWSQGGTDLANGYRRLGNNPDGTRYFSSTADTVRSQSLKYEIPFNQWDGLQSKLKFGISNLDRFKHFEFREIAQRNFTGSDRDVIYPIPGEVIYNPLAYANGNRKIYERASGNNAYDASQALRAAFAQLEVPILAKLKSIVGVRYEDSYQKTKTYDLKNSWNGFNTSYGCKTNSEEERLLLVRANICDATNVGIGELRTKDKLPSANVVWEFAKDMNLRLGYSQTLTRPDLRELSPFGFAAYFQADRIFGNASLQRTYIHNYDLRWEYYITNTDYIGVGAFFKNLSNPIELIGLPVAGSASLVYKYANAQQATIRGIELDYRKELLWWLRVEANVFFIKSRVDVIDSKIYGLISTGQVDPLSTYAAYFRLLSIDLYKVNQTL

SEQ ID NO: 20974 - protein, 248 aa, Leptospira interrogans
MKKQLVTALTMLLVAPAMSATSLDIGYKAYTSDTKSDNGGAYDQPFVKLTHFNKAEWGTLIAYVKLENPGEISDAQHGKDGKLTVKSLLIIDKQIADSSFNIWAQNFLISNRTVMEDNFYLGVTTNQKFGSLFVNAGVGLNYSAAHFDPSGESFDGLSGYAVVINVRYPFSAMGLKHSLSVNYEGQIDRDEDHMSTLGYASYGHQIITTLKTSVSDSFYTKLHLTQFDSWGAAPNDGIEYGVSVGFKF

SEQ ID NO: 20975 - protein, 390 aa, Leptospira interrogans
MPGTAGFPHRSSGRLFDGFPAADTASRQHQRQTDAARYGEPLVTTPRFIRTAAAAATLAACGAAAHAQSALTLYGALDAGVQYLTHADGHRSAVRLQNYGILPSQVGIKGHEDLGGGWRALFKLEQGLNLNDGTSTVPGYAFFRGAYVGIAGPVGTVTLGRQFSVLFDKTLFYDPLWYGSYSGQGVLVPMNANFIDRSVKYQSPTFAGFDVEALAASAGVAGNTRAGRVLELGGQYTSNGLSVGVVLHQAHGDVSAADDASARRRELGTLAARYAFATLPLTVYAGVERLTGDLDAARTIVWGGARYLTSNGIGLNAGVYHTDSHTSAIGHPTLFIASTTYALSKRTVAYVNLGYARNSGQSSQTVYEYDPTPLAGASQFGAMVGMYHLF

SEQ ID NO: 20976 - protein, 765 aa, Leptospira interrogans
MEKIIDLLHSGGYSCVIGNGTEIRTFTQRGVADLYDLFRQDPSFMKGAGIADKVIGKAAASLMVLGEIRQVYADVISQPALALLHNANIEVSYVRLVPFIENRDKSGWCPLETACYGIESIQEIFRIIENFLSKIRMKKNLLGILLVCAFLSSSLQAQVRKDTTQAGHNYEIDDVVVTGTRNETDIRHLPMTISVVNRETIGQRSEPSLLPTLTEQVPGLFTTSRGVMGYGVSNGAAGGISLRGIGGSPTTGLLVLIDGHPQYMGLMGHPIADAYQSMLAEKVEVVRGPASVLYGSNAMGGVINIVTRRQREDGVRTGVRLGYGSYDTWMTEATNQVKKGRFNSIITGSYNRTNGHRPDMEFEQYGGYTRLGYELDHSWNVSADLNLTHFNASNPGTVSTPVFDNDSRITRGMTSFALENRYERTSGALKFFYNWGKHHINDGYGTGEEPLDYRFNSKDRMMGISWYQSASLFSGNRLTAGIDYMQFGGEAWNRFIADKHKEGISDKSENEIAGYLDFRQAIGSYLTMDAGLRIDHHTVTGTEWIPQVGLSVQLPQDASLKAMASKGFRNPTIRELYMFRPANPDLLPERLWNYELSYSQRLLKGTFYYGVNLFYINGDNMIQTIRTDGRPLNVNTGKVENWGAEADIAYHIHPMWRLTANYSWLHMEHPLIAAPEHKLYTGIDFTQKKWSFSTGIQYVTGLYTAVDPQEKKENFLLWNLRGSYRICSIADLFVKGENLLAQRYEINAGYPMPKATCMGGININF

SEQ ID NO: 20977 - protein, 1084 aa, Leptospira interrogans
MFMKNVYKSLSALVLLLVLSSATVFAQKTVTGTVLDEYDVGLPGVSVLVKGTTTGTATDIDGNFSLNVPNDQAVLVFSFIGYNKVEQTVGNRSVIDVKLAPDETTLTELVVTGYTIDSRRETTGAIATVDPKDLTVIPTGNVEQALQGRVSGVTVITNGQPGTTSIIRVRGFGSFGGNEPLYVVDGVPVQSTDFINPDDIASTTVLKDAAAASIYGARASNGVIIYTTKRGRRGNQKLRVDYNGMFGVTTPGDGLDMMNPQDFANTTWLAETNQAIIDDRDPNYEHPQFGTGTSPVLPYYINVGGAAGVPGPFTAAQLEEERAKYNVDRNKGGVYQVVRAATGEGTDWYRELTRSAPLTRHSIGLNGGSETSRFFIGLGYQDQAGIMKNNNFKRISLRANSEFDVTKKFRIGENFQATYRQVLGQTGGNGGRGVSADENDILQAFRMPSIIPVYDEFGGYAGTAARGFNNPRNPIANRDGLENNRNFNANIFGNVYAEYDILDDLTFRTSIGGQYNNYYYWNYSRLQYENSENNSSFGYSEGSGFNFQWVFTNTLSWKKTFDKHAFDVILGQEALNNGSGRNIDASGQNPFSTDPDFITVSNLPVSSRQVNSGLFRGVNFASYFGRLNYTFNDKYLFSAVVRRDGSSVFGENSRYGVFPAFSAAWRISSESFLQSATWIDELKIRGGWGQMGNSNPVPSTNQFSLFGGDVGASSYDINGSNSSALIGFRRTRIGNPNTQWETAVTKNIGFDGTFFNGRLDIILDLWQKDTKDLLFQLPIPQTAGSNATPPFINIGQMKNAGVDLLVGVKGNLSSAFTYDLTVTASTLKNEIVALAPGLDVITSINPSYRGIQPIRNQVGQSLSAFFGYKVEGLFSSAEDVSNHAIQDGAAPGRFKFEDLDGDGEITPEDRTFIGSPVPDFTGGVNFTLGFKGLDLSVYLYTSIGNEIWNQSRWFTDFYQTFEGAAISERLKDAWTPNNLGAEIPVVEKTANFSTSNVGNSFYVEDGSYLRLQNITLGYTLPATLLEKWRLERVRMFASANNLFTLSGYSGLDPAVGGNADTTFGIDVGNYPVTTGYTFGLNLSF

SEQ ID NO: 20978 - protein, 652 aa, Leptospira interrogans
MFALSGLLMASAVHADTDLTALPLEQLMQVQVTSVSKYAQPASEAPSSVSVITAADIKAYGWRTLADILRSLPGLYTTYDRSYAELGARGFLRAGDYDTRFLLLIDGYRTNDSVFDEAAIGTDFLLDVDLIDRVEYVPGAGSAVYGSNALFGVINVITKRGRDIGGVQASGSTGSAQAGEGRVTWGNRSEGGAEWLLSATVSDAPGRDLYFPEFDRPETNHGIASGLDFDRRKQVFAKGSVGEFGLTFAHADRTKGVPTAPYDQLFNASQSRAIDARDILSATWQHAVDEASDVSARVYWGRYTSRGDYVIDYPPVTLNRDLFDSAWYGTELKFVTRRIERHTLVFGTELQRDYRDSMRNFDVSPYLSYLDDHRNNSRVGIYAQDQFALHPGWLLDMAVRYDRSTFVPGIFSPRVGLIWHAAPETTLKALYGMAYRSPNVYELYYQTSAPGGQETNPGLSAERIRTYEAVAEQRVGAMGKATLSVYENNVSNLISQMQDPNTGLLVFENVARTRTRGAELGYEQSWPGGTRLRASYSLQRSTDLDSGQVLLNSPRHLAKFNVTTPLWRDDVRLGLEAQYVSCRLAQLGQAGGFWLANATLLVARLAPDLEMSASVYNLFDRRYADPAGPELTQAVIRQDGRTFRLKFTYTLR

SEQ ID NO: 20979 - protein, 386 aa, Leptospira interrogans
MKRKILALAAVSACGAASAQSGVTLYGVADINVEYVNRVGAAVPSAANGFQSGAGHSVVRENSGGYSGSRWGLRGTEDLGAGMKSIFVLESGFNLDSGASQQGGRLFGRQAFVGLSSEYGQLTFGRQYHSMFSTLANFIPARYATQYEPVGVIAGANFREDNALKYVGVFGGLTAQANMSFGVGTTLPQVIASVPAAGGNGEVPGQYRRDTAYGVGLSYLAGPFGVGVAYDQWNPTIGTGSGTFKKAAVMGSYAFNATAKVMGGYRWGQNKNQNGGLTMRDDFYWVGGQYRFSSALDFTLEYDYQNVKSLGGNTHVANPWQVALIADYTLSKRTDIYLTMAYAKNAGLAMESAASNYATSLTVNNYALSNGQSSMFGAAVGIRHVF

SEQ ID NO: 20980 - protein, 970 aa, Leptospira interrogans
MKEYKEFLCKLWMGKIVSILIHFRSFCFIFLYLYFKNILLRFPIWFIRKVNIFNIQRYRDWFLFLILCFNRFWSGLFIVGILFCHSTLFAQKSIRVEVVILDETGNHAISNTPVVFQEIGKYLITSGEGSIKVNFPAPGSYNLRIMTSEKVFKKNITVEHDGEKKFIFIRKPALGEINVYGEKDLESLSRYTLQQEEIQRLPGAQNDALKAIQTLPGITAVPPIGLSSSSFNNLVNSVGNSNPYSNSERGFLVMRGGGTLANGYYLDGFPMSYPYHLGDQSSVLNNNIIKSFNVYSGAFPVQFGFATGGIIDIKTPDTVAKTSSVINLNTFLSDVYHQNKISENLYAIVSARKSYPNVTLLKLYPDGIPQDAKYADYEDYQAKFNWKPGTNHTFNVLLFGARDKQKYTKAQDDFENSKKEFFGLQGAASGRPPVGLDRLFRTSGFRYTYNNKSWLETSISISNNYFKEFFEVDFKNPLTAEQIFELQNVTTQNINFLENNTRINLIERHLTFRFGGQFRDKTIQLQGEDIKSSNSTFLDFFNSLLDSNRQFRALIEGDSIHTREIAAFAEMEFKIGGFSILPGYRHDYYDKAHEKKDSFRGRAEYEILKTATKFLAGTGEHYNAPLQIEQFSSRSGNPNLKMEHSIHSSGGIEQRITSDYLIKVEGFHNQYSNLVTPDSYVQDPYQPNNEKRDIINHPDDVQENPLIVRNMNYSNSRDGYSRGVELFLKANQGPGRRFFGWISYTNSVSKRNNHQPQLTDDEENQRTRDNRDHRLQYQIHEGGNYLNYYDDGKWELLVDNDKLLLYDYDRTHILNVVFAWKFGQSWQIGSKYTYLTNVPITPIVDSSKASGLASTGINLYNPTYSEYYNSGRWPDFHQLDIRIDRFMNYQWGYVNTYIELINFFGNRNQISQTYNNFGPYSRSAFTNPLTGFTTPSNPTPVYNSNYIESTAIGGKVKYYPFISIGMQIRF

SEQ ID NO: 20981 - protein, 832 aa, Leptospira interrogans
MILRHNNLCKSILLILLSGGCLNIPNTVFAGDLPPPPRDINEINQLFKLYLDLVVNQYSVQQVVPVIVKNDEYFIQKKKLIDELEINIPQELLTNTDTSLSNQDVLTLGFSGDASDWISLDKLKDVSYEYQSSNQYFKLNFPPAWMPTQVLGKDSWYKPEVAQSGIGLLNNYDFYTYRPYQGGSTSSLFTEQRFFSPLGVIKNSGVYVKNQYKNEGNAESVDNDGYRRYDTSWQFDNQKNATSFLLGDIITGSKTTWGSSVRLGGFQVQRNYSTRPDLITYPLPQFIGQAALPSTVDLIINGQKTSSTEVQSGPFILNNVPFINGKGEAVVVTTDAVGRQVTTSVPFYISNTLLKPGLFDYSLSLGKIREDYGLKNFSYGKFASAADARYGVNDWLTVEGRTELSSDLQLLGAGSVLKLANLGVLSASFTQSKADKSMSEDRTKDLEGNQYTVGYSYNRNRFGFSINHNQRDDEYTDLSRLQYSNLISVNSNKSLTANTYFATKNSGTFGVGYINTKANDFKNRFLNLSWAPVLPTYMNGVTVSLSANRDFIEKEWSAAFQLSIPLFQRNATVNSGYAFNKQGDTGYVNFNRSVPSEGGFGVDLTRRFNENSEDLNQARVNYRNSYINTDFGLSGNHDYNYWFGLSGSLIYMAGDLFASNRLGESFALIDTNQVPDVLVRYENSLIGRSNKKGHIFVPSVTPYYSGKYSVDPIDLPSNFTITQVEQRIAAKRGSGVVIKFPVHQSISANVYLTQADGKPVPVGAVVHRADQESSYVGMDGIVYLENLKPNNTVTVQRSDQSICKADFSVDVEQAKQQIVVVKPVTCHEVSLP

SEQ ID NO: 20982 - protein, 682 aa, Escherichia coli O6
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYLILPDTLINFAVLNVTDRKSEDIDTIDGNWQVDEGRRYWANVRVSF

SEQ ID NO: 20983 - protein, 234 aa, Escherichia coli O6
MLMIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAAFHYDGTTTSMYNEFGDSTTTLADPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 20984 - protein, 822 aa, Escherichia coli O6
MLALASAFAFNAQAQQEKSLATVEVIGSTPLPGIGQPLNELAAPVQSATSRDITASGALELGEFMNRRLGSVHVNETQGNPFQLDVNYRGYTASPLLGTPQGLSVYMDGVRMNQPFGDVVSWDLIPRGAIASMTLMPGSNPLFGLNTLGGALSVQTKDGRNNPGTALQTTLGSNARRAVEFEHGGFNDKGLDWYVNANVFKENGWRDDSPSDVRQLFGKLGWKSGGTDLKLTLAHADNQLNGNGLQEQGLLAASRSSVYTKPDITKNRSTLLNLAGTHTVNDNLLFSGNAYYRDLKTSTYNGDINEDSLDQSVYQPSAAERAALTAAGYSGFPASGANAANTPFPKWRCIGQALLNDEPAEKCNGLINRTRTEQQNYGLSGQMTWLGDLAGKRNQFVAGAGIDASRVKFRQSSELGYLNPDRSITGVNAFGDGVTGGDVDGEPYDTRVDLKSRTRTWSVFASDTLALQDNLHLTLSGRYNATSVKNRDQLHADGDSASLSGDHRFSRFNPAVGLSYSPTKTLNAYAGYSESSRAPTSIELGCANPEQPCKLPNAMAGDPPLKQVVTRTIEAGLRGTAPGGVQWNAGVFRAENRDDILFVADNQSGYGYFKNFGQTRRQGLELGLSRQVGRLNVGAQYTFLDATYQSAETVNGSGNSSNDAASAGSPGQEGSIQIKPGDRIPLIPRQMLKLFADYAVTPAFTLNGSMVAVSGALARGNENGGHQADGTYYLGSGRSAGYAVFNLGAGYRMTPKLQLTAQLDNVFDTQYSTAAQLGATGFDANGNFVARPLGGSNADGYALRQSTFYAPGAPRRIWFGLRYVFS

SEQ ID NO: 20985 - protein, 806 aa, Escherichia coli O6
MAQRHRVRSSLSRTLLTSAVLAAMTAPAFAHGDATGAPQTLDKVVVTASGFEQKVIDAPASISVVSREELSKRPYTNLVDALRDVEGIDVGLEATDKNGRATISMRGLPSEYTLVLIDGRRQSNVGQLYPNNFGGGQFAYLPPLDAIERIEVVRGPMSTLYGSDAMGGVINIITRRNQDRWHGAVTQGFTVQQDDQFGDARTTDLYLSGPLLKDRLSLAVRGSYYDAKASNPEWDALTLPDGSLWERSIGFGGGGKSVANTNWNTGVRLDFRVNDDHELWLDYDVSRQKYDNSEGQTGTLDSLASLWRVGNAVIPNPNGSGTVTRRVVQPRVGYTAYQRYERDQLSLTHQGRYSFGTWQTSLTHSKSSNLGRSLPLTLDERANLQTLWNDVCRRTGAANNCAAGRGNALAALNPSEMARLQAFLPRPLRTMELEGYVLDTMLDLDFGAHKLTVGGQYNDTDMIDGVFGMDGAGYRSNTRQKHRMWALFAEDNWALTDTLTATFGLRYDDHNVFGSHVSPRGYLVWNASDAWTFKGGVSTGYKTPRPDQLFPGITGFGGQGVLPLVGSPNLKPETSTNYELAAYYEGQRWGFNVTGFFNTFEDKIASGGTFPNCEVARAGSGYCVDIGPGWAALGYSTFTQSVNIDKAETRGAELAGHVDLLDTLQLRGNYTWTRSEQTSGPDKGRPISGTTPAKHMANASLNWQINEAISLSLIGEGRYDRYRDTLIDSAGTRHVRYYEDYTIFHLGGSWKATPWLTVNARVNNLFDKDFVSQSCLLLNPSEFSCVDDYATKDQRRSYWISLNAKF

SEQ ID NO: 20986 - protein, 696 aa, Escherichia coli O6
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLGYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 20987 - protein, 199 aa, Escherichia coli O6
MRKLCAVILSAVVWLVAAGTPASAAEHQSTLSAGYLQTHTDMPGSDDLKGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVTIDLAYEGSGSGDWRTDAFIVGIGYRF

SEQ ID NO: 20988 - protein, 661 aa, Escherichia coli O6
MPYLHSASLRPSLIALAVVGALPGTAFAASDEMTVTATGNPRSTFEAPMMVSVIDATTPENQTASSAADLLRTVPGITLDGTGRTNGQDVNLRGYDRRGVLILVDGVRQGTDTGHLNSTFLDPALIKRIEVVRGPSALLYGSGAMGGVISYDTVEAKDLLDAGKNSGFRVFGTGATGDHSIGMGASAFGRTDVLDGVVAWSSRDRGDLRQSDGTTAPNDESINNMLAKGSWKIDSAQMLDGSLRYYNNAAQEPKNPQTIEPSESSNPMTDRSTIQRDAQLTYNLAPDGNDWLNAQAKVYWSEARINAQNVDSTAEFRKQTTKGGKVENRTHLFTDSFASHLLTYGGEYYRQEQNPGGSTTGFPEAKIDFSSGWLQDEITLRDLPVTLLGGTRYDHYRGSSEGYDDVDADKWSSRAGITVTPADWLMLFGSYAQAFRAPTMGEMFNDSKHFSIGNFYTNYWVPNPNLRPETNETQEYGFGLRFDDLMLANDELEFKASYFDTNAKDYISTSVDFAAATTMSYNVPNAKIWGWDVMAKYTADLFSLDVAYNRTRGKDTDTGEYISTINPDTVTSKLNVPVAQSGFSVGWIGTFTDRSTHVSSEYSQQPGYAVNDFYVSYQGQQALKGVTTTLVLGNAFDKEYWSPQGIPQDGRNGKIFVSYQW

SEQ ID NO: 20989 - protein, 729 aa, Escherichia coli O6
MFTDPLSRPASHSALRFLRPLWLGLACSATSLAIADESNQLDTVSVNASVPDQNTDPLPEAATASRLGLSMRETPATVDIIGRDEIEQEGLRNLIELYRNAPGVSAGNIPGSPASVSMRGFTDVGYLFNGTRAVDPGLMSRNMNTWNLERVEILKGPASVLNGTGALAGSINLITKRPDVSADAYDGMLSYGSNDTVNLGLGINKVLTDTAALRADFSHDESDGFVDDTNSRTDAFTTSLLLTPTDKLTLSFDLDLYSDKYSTPYQGAPLLPASVAHDPSDVVSGGLVLDESIRDNNYNVENGIMESDSQWFRARVDYQLNENWKLANELGFYNADRNWANSEDFTYNTGTGQLDRLTTIITHRQKSASERFFAVYDGKLGERRHRFTAGVDFRYTDFFSERRFGTTTSVDPFNPNRGELPSDNASNYPYRVNYDSIVTTQGVFLEDALNLTPNWLLVGGARYDYSDLDRRIDDLITNTRTDFGQTYESFSWRLGTIYDLNNNTQLFAQYNRAATPITSLVLSSQSRAGFDLSEGRSMEAGVRTNFWDRRATLTAAVYRIDQDDILTRDPSNPALTVQGGSQRSQGGELDLTLQLLPQWWLRLSAAHVDAKYTDLTDGSGNDLTGNRPTNVPDDTYAATSAYTFSPVSLTVGGAIRHTGDFYTSSSNDYKVASRTLLDAWVSHPLGKGTLTLRGRNLTDEFYADWSGYSATQVYVGAPRTVELGWTGHF

SEQ ID NO: 20990 - protein, 990 aa, Escherichia coli O6
MLNFYQKRTLSNTIRLMTILYMLCICQLAIAQTKNFQGVVKDAKGNTLPGVTILETGTSNGVSTNIDGIFEIKLRPGSTLTVSYIGYITRTIPTNDKTTFLNIILEEDVFQLDDVVVVGYGSMKKGEVTSAITSVKKDDFLAGMVKSPEQLLQGKVAGLQLSNYTGDPVLGLEMTIRGVNSLSGNTSPLIVIDGIPGGSLTAISSEDIESIDVLKDGSAAAIYGTRGTNGVIVITTNRAKATKLSMEYNGSISFETFAKHADMLTANDYRRLTDDPDFPGIQDEGTTTDWVDAISRTAISHNHFLSLKGGSAESNYVASIDYRKREGVIRHTDRESITAKIGLNHNMFNNKLRFQFNINDSYVTQQRAWYAAYLNALLENPTRPIYDENGNYTEYKVNLKPYNPVAMINEEYDVEGYNQLMMSGKITLSPIEGLNLSVMGAMQRFDRMENKSNTFKHMTTVVNGDYGNVWNWADNTMQKNLELVGDYTKSLGLHNLGAMIGYSYQDDDAKGIYQWAKDFPTDMFGPWNIGSMNDMKDNKAAMTSYRNTHKLISFFGRLTYNYNEKYMFMASLRREGSSRFGDNHKWGWFPAISAGWRISKENFMQDIQWLDDLKVRIGYGVTGNEVTSNLLSMYLLNYGGYAYINGKWTQGAGPYQNPNPDLKWETKSELNLGLDFSFLKNRLSGSIDIYHRETSDLLSTYEVPTPPYIVSSMMANVGKIRNQGIELLLSGTPIKTRDLRFDITGTFSYNKNKIISLSNGLYQKDYWYEGATGSPIQTHTHIVREGDPVGNFHGFQTHSLTSDGLWMVYGADGQPKLLTDADDGDKKVIGNGIPTTYGSLNLALSYKGFDVSVMFRGAFNFQVLNRQRMHWETTSRIGEGNLPRSVLEKPFGSNSYVKGAPAMQSYYVEDGDYVKLDNISVGYTFNLKKQKVIQRLRLYVAGNNLLTMTGYKGLDPEVSIKGLAPGVEGSGAGELYPTTRQFTVGLNLLF

SEQ ID NO: 20991 - protein, 108 aa, Escherichia coli O6
MESKSVDTRSIYRELGATLSYNMRLGNGMEIEPWLKAAVRKEFVDDNRVKVNSDGNFVNDLSGRRGIYQAGIKASFSSTLSGHLGVGYSRGAGVESPWNAVAGVNWSF

SEQ ID NO: 20992 - protein, 306 aa, Escherichia coli O6
MRLNDRAGEMRYIDPVTEQERSSRLWLRQIGGHNAWRDSNGQLRTTSHRYVSQLGADLLTGGFTDSDSWRLGVMAGYARDYNSTHSSVSDYRSKGSVRGYCAGLYATWFADDISKKGAYIDAWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWFHNSKDFAVSMNGVKVEQDGASNLGEIKLGVNGNLNPAASVWGNVGVQLGDNGYNDTAVMVGLKYKF

SEQ ID NO: 20993 - protein, 199 aa, Escherichia coli O6
MRKLCAVILSAVVWLVAAGTPASAAEHQSTLSAGYLQTHTDMPGSDDLNGINVKYRYEFTDTLGLITSFSYANAEGEQKTHYNDTRWHEDSVRNRWFSVMAGPSVRVNEWFSAYALAGVSYARVSSFAGDYVTLTSDEGKKQEHLTRSDSGRRSHTALTYSAGVQINPTENIVVDLAYEASGRGDWRTEAFIVGTGYRF

SEQ ID NO: 20994 - protein, 468 aa, Escherichia coli O6
MRAFSGKRSTLALAIAGVTAMSGFMAIPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAIFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 20995 - protein, 186 aa, Escherichia coli O6
MNVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTRRPLADENFHLGLGFTAGVTARDNWNYIPLPVLLPLASVGYGPATFQMTYIPGTYNNGNVYFAWMRFQF

SEQ ID NO: 20996 - protein, 995 aa, Escherichia coli O6
MHSWKKKLVVSQLALACTLAITSQANAANYDTWGYHDNTTTDLVWPYDTDNDGIADAGGMDPMGSDGNYVTYNGFVYYNNANGDFDTVFKGDTVNGTISTYYLNHDYASGSVNQVDISNSVIHGAITSELPFGYYSITPAEVNAKGEVVTPQTYNGYNFYNGITTDLDYNWYDGDVFTLNVSNSTIDDDYEALYFTDTYLDGDKSKSTNETFYTALGVAVNLDVESNINITNNSRVAGIALSEGNTSNTTYTSEYHQWDNNINVSNSTVTSGSQTPLEESNGFFGKSAEPSDYAGNGGENDVALSFSDNAGSNYSMKNNVNFDHSTLLGDVEFTSHWNNDGVFFYSTGHDSNGDGVLDTNGGWVDDAQNVDELNITLNNGSKWVGSANMSAEVIAPADMYDVAPNSLTPGATIEANDWGRIIDNKVFQSGVFNVALNNGSEWNTVNSSVIDTLAVNNGSQVNVTDSSLVSDTIGLTNGSSLNIGEDGLVATDHLTVDSYSTVNLTESTGWNNYSNLYANIITVTNGGVLDVNVDQFDTEAFRTDKLELTSGNIADHNGNVVSGVFDINSSDYVLNADLVNDRTWDTAQANYGYGVVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 20997 - protein, 776 aa, Escherichia coli O6
MKLVTRMENFFMKNSKAFYRSALATAIVMALSAPAFATDSTVSTDPVTLNTEKTTLDQDVVINGDNKITAVTIETSDSDKDLNVTFGGHDITAASTVNQDFVEGVKVSGNKNVVINATDSTITAQGEGTYVRTAMVIDSTGDVVVNGGNFVAKNEKGSATGISLEATTGNNLTLNGTTINAQGNKSYSNGSTAIFAQKGNLLQGFDGDATDNITLADSNIINGGIETIVTAGNKTGIHTVNLNIKDGSVIGAANNKQTIYASASAQGAGSATQNLNLSVADSTIYSDVLALSESENSASTTTNVNMNVARSYWEGNAYTFNSGDKAGSDLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSVIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNATVKPYLNLAALNEFSDGNKVRLGDESVNASIDGAAFRVGAGVQADITKNMGAYASLDYTKGDDIENPLQGVVGINVTW

SEQ ID NO: 20998 - protein, 1305 aa, Escherichia coli O6
MNKIYALKYCHATGGLIAVSELASRVMKKAARGSLLALFNLSLYGAFLSASQAAQLNIDNVWARDYLDLAQNKGVFKAGATNVSIQLKNGQTFNFPNVPIPDFSPASNKGATTSIGGAYSVTATHNGTTHHAISTQNWGQSSYKYIDRMTNGDFAVTRLDKFVVETTGVKNSVDFSLNSHDALERYGVEINGEKKIIGFRVGAGTTYTVQNGNTYSTGQVYNPLLLSASMFQLNWDNKRPYNNTTPFYNETTGGDSGSGFYLYDNVKKEWVMLGTLFGIASSGADVWSILNQYDENTVNGLKNKFTQKVQLNNNTMSLNSDSFTLAGNNTAVEKNNNNYKDLSFSGGGSINFDNDVNIGSGGLIFDAGHHYTVTGNNKTFKGAGLDIGDNTTVDWNVKGVVGDNLHKIGAGTLNVNVSQGNNLKTGDGLVVLNSANAFDNIYMASGHGVVKINHSAALNQNNDYRGIFFTENGGTLDLNGYDQSFNKIAATDIGALITNSAVQKAVLSVNNQSNYMYHGSVSGNTEINHQFDTQKNNSRLILDGNVDITNDINIKNSQLTMQGHATSHAVFREGGVTCMLPGVICEKDYVSGIQQQENSANKNNNTDYKTNNQVSSFEQPDWENRLFKFKTLNLINSDFIVGRNAIVVGDISANNSTLSLSGKDTKVHIDMYDGKNITGDGFGFRQDIKDGVSVSPESSSYFGNVTLNNHSLLDIGNKFTGGIEAYDSSVSVTSQNAVFDRVGSFVNSSLTLEKGAKLTAQGGIFSTGAVDVKENASLILTGTPSAQKQEYYSPVISTTEGINLGDKASLSVKNMGYLSSDIHAGTTAATINLGDGDAETDSPLFSSLMKGYNAVLSGNITGEQSTVNMNNALWYSDGNSTIGTLKSTGGRVELGGGKDFATLRVKELNANNATFLMHTNNSQADQLNVTNKLLGSNNTVLVDFLNKPASEMNVTLITAPKGSDEKTFTAGTQQIGFSNVTPVISTEKTDDATKWMLTGYQTVSDAGASKTATDFMASGYKSFLTEVNNLNKRMGDLRDTQGDAGVWARIMNGTGSADGGYSDNYTHVQIGADRKHELDGVDLFTGALLTYTDSNASSHAFSGKTKSVGGGLYASALFDSGAYFDLIGKYLHHDNQYTASFASLGTKDYSSHSWYAGAEVGYRYHLSEESWVEPQMELVYGSVSGKSFSWEDRGMALSMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINADFRYSF

SEQ ID NO: 20999 - protein, 253 aa, Escherichia coli O6
MSAKRRLLIACTLITAIYHFPAYSSLEYKGSFGSINAGYADWNSGFVNTHRGEVWKVTADFGVNFKEAEFYSFYESNVLNHAVAGRNHTVSAMTHVRLFDSDMTFFGKIYGQWDNSWGDDLDMFYGFGYLGWNGEWGFFKPYIGLHNQSGDYVSAKYGQTNGWNGYVVGWTAVLPFTLFDEKFVLSNWNEIELDRNDAYTEQQFGRNGLNGGLTIAWKFYPRWKASVTWRYFDNKLGYDGFGDQMIYMLGYDF

SEQ ID NO: 21000 - protein, 3415 aa, Brucella suis
MPNLANQDFTQFKREQQTAPAWFRILRGGRMTKWKGKVASYAPHVAPAIGWAFSRTLQLSLISLVMAGTAAASDRYWDSNGTAVGRGGSGAWNTSNAFWSPSGDGVSGPYSAWNNAAFDTAIFGGTAGTVTLGSPITVGAMTFETTGYILSGNTLTLGTATPTITTSSGTTTINSVLAGTNGLTKAGDGILSLTGANTFSGNIIVTGGTLSVNSSAALGAAANEISLANGAGLNSSGSLAGRSVTLTGGQAAIGGAGVGDAHFTGAGGLRASSSVTLSDDSNDYTGQTSLSSGGTLFFSSIGNLGEVSALGAPVDEAAGTISLVVGSSASASATYTGSGASSNRNWQLSSRFYANSTISNRGSGTLTLTGNIFNNHTNSSLSARNINFDAGTADIELLGTISSNNNGVGVVFGGTAGRTIKVSGDNTFGGAAIIQNITVQVGSLKNTGDPSALGTGTGAAGAISINSGILSYLGAGDSSDRNFTAQNNAILANDGTGALTLSGDVALTGTLTLGGSFAGTNTLAGTVSGTGNLRVDGAGSWILSSANTFTGDVGVNSGTLVVGNMQALGTTPKAATVNGGTLDLGAFDTTLSSLSGTGGNVNLGGATLTVKGSTSTDFAGSMTGSGNLLKQGTSTLTLTGASSFTGDTTINGGAISLNFKNATALTDNILSTSSTLNLAGGTFNVIGMDNAANSQTVDGLNVTAGNNKITTTSGSGGTLTLNLGAINRTGGFIDFGINADTTITTTSATLGGWATVNSTDYAKVDGGVIKALDESGYANKDDAGTWANGDIVSDAGGAANTPYFGTVGTGLQLGGLKYTAAANSTVTIAAGQTLGVNGTIIVANTVGNTNQTINGGSLTGIAGGGILGVLQTGTGTFTIQSTITDNGGAIGFTKAGAGSVTLTGQNTYSGVTTLSGGILTVTQMANAGMASGIGQSTADPANLMLESGTFRYTGGSVTTDRGFTLVNGGPARVIEVTGSGSNLAFSGLVTSPDDAGFEKKGAGTLTFLNGSNDYIGATTVSGGTLAVSTLADGGQVSSLGKSGSDATNLILAGGALNYLGSTTSSDRSFTLGAGNGSIGVANAGTTLSMSGTAVGTGGLTKLCDGTLILSGTNTYTGNTAVNAGVLRAGSAQAFGPSGLMTVGNGASLELGGYDITVSGLLGAGTVDLGGNTLTSSGSAANSFTGKITGTGGFTRTGGSTQTLSGCNSDYTGKTTIASNGTLSVDCLKNGGQASSIGASSNAPDNLVLNNGTLSYTGNTVTTDRGFTIQGGTGAISVTDAATTLTFSGQVVGTGALQKRGIGTLVLMNSNSYRGGTSVDAGTLRAGSSGAFGGGSMSLSNAAGAILDLDGFDTSVTSLSGGGALGGNVALGGATLTISSGNSNGTSYTGAITGIGNFVKNGNGTQRLTGCASSYSGSTTINGGVLEVSCLADGGSVSSIGMSSADADNLVINGGVLRYTGSGDSTDRQFTLGASGGNSIESEGTGAILFTSNAAVTFAAANTAQTLTLAGTNTDDNELGAQLTNNGSGITSLTKTDTGTWFLTNSDSTYTGVTKINGGVLSVDKLANGGLASSIGASSSAASNLIIGNDSTLRYLGTGDTTDRLFTLASGLTYIESSGSGAIVFTDTGQVALADNNQARTIALGGKNTGDNTLAGSIGDAGTGKTTLAKNDDGTWVLTGNNTFTGPTNINKGLLKIGNGGTTGSLTSDIVVTDGGLIFNRSDTLNYGGLISGAGFVTQSGSGTTILTGANSYTGATSVSAGTLLVNGDQSAATGQTSVANGSILGGSGIIGGNVVVTDGALAPGSNGAGTLTINGSLALSAGSILSMQLGQAGVAGGALNDLIEVKGNLTLDGTLDVAETAGGSYGPGIYRLINYTGSLTDNGLDIGMLPNGAGAIQTAVAGQVNLLAGGTNFNFWDGDVGPKFNSAVDGGNGTWQNSSGNNNWTDATGNINASYSDGAFAIFTGTAGTVTIDNSLGQVKAEGMQFAIDSYAVTGDKLELTGPQSTIRVGDGTTAGAAYIATINSVLTGNTQLEKTDAGTLVLTGANSYTGGTAINGGTIRISSDDNLGVASSDISFDGGALNTTANIATDRAIILTGAGTLLTDASTTLSLSGPISGTGALTKSGTGTLLLSGTAAHTGGTTITAGTLQIGNGGTDGSIDGNIVNNGALVFDRAGTLAYTGSISGTGTLTKNGSSTLTMTGTSTYTGETTVSAGTLALQAGGQIKGTASLTVDGGAEVLIDGSGSQFATGAGASVVGTGTVTVRDGGTASFDSLTTSNATGTNSTITVAGSGSQMTQTGIATFGLAGTATVDILDGGTMISSGASVFIGGQLPMDATGQVTISGAGSQWTIANALYARRGSITVDDGGVVTAGSAVIGYADTGINNPETDLVVTGAGSRFETTGELAITNSAANAARGSITIADGGVVKVGGGALAMGPGNAVLNIGAAAGGSPAHAGTVTMAVGSNQINFNHDDASTTFSATISSAGSVSQNGPGATLLTGNNSYAGLTTVTAGSLYIDGDQSMATGLTTVNPGGTLGGTGTIGGDVTVASGGAINPGSFGMAPGTLNINGDLTLASGSTQSFSFGQANIPGGPLNDLINVGGDLVLAGTLQVDTSAGGTMDPGIYRVFNYTGTLSQNAWTVNLPSPDFYVQTSVAQQINLVNTAGLALRFWDGADPQNKNNGKIEGGNGIWQAFGSAPDNGNDNWTETGNINAPFQDATFAVFTGEKGTVTVDDSKGAINVSGIQFVTDGYIVNGDAINLVGASGSTIRVGDGTTGGTDTVASIDAEITGASQLIKADMGTLILTGDNSYTGGTKITGGTLQVAKDSALGARTGELILDGGTLNTTADMTIDRSVTVDQAGTLDIDTGTTLKIDGVLSGAGAFVKTGAGRLEVAGDDHTYNGDASIASGTLALTGALGGTMNVGIDGRLEATGRVGATTNSGVIALDQEGFGSLTVNGNYTGKDGRLEIATVLGDDTLLTNRLVIDGDTAGTTQVSVTNRGGLGAQTVEGIKIIQVGGASNGMFLLAGDYMFNGEQAVVAGAYGYRLYKGGVSTPADGNWYLRSALLNPETPTNPTDPETPLYQPGVPLYESYAGSLQQLNKLGTLQQRVGNRVWAKHPVPAQNDENGAGPSGNNGIWARIEAAHAEFDPKQSTSRASYDADIWKFQTGIDGMFAETASGKFIGGVYVQYGTVSSSVSSPFGNGSIESSGYGAGATLTWYGESDFYIDGVAQINWFDSDLNSATLGRQLVDGNRAVGYSLSVETGQKIEIGEGWSLTPQAQLAYSAIRFDDFKDAFDTSVSPENDHDLTGRLGLAINRDAEWLDAQGRRVAMHIYGIGNLYYGFAGASKVDVSSVRFVSGNERLRGGIGLGGTYDWADSKYSLYGETRFDTSLQNFGDSNVIAGSVGLRVRW

SEQ ID NO: 21001 - protein, 897 aa, Brucella suis
MGAVSRSHPVPAAEIPARNIIRGGTRACMARRWLGLALVFAVLGPLARAAPTRFDLPTQPAATALMAFAKQAGVEVLFSFDELKAVQSNAVAGLFEPAEAIDRLLRGTGFTAIRNSAGKFVVVSERNRRRTGEVQGHVVADATGQPVANALVRLVDSTLAVRTRADGFFRLPEVPAEWPTLLVQAEGFTTARVEAVFVAAHRSTQLGPIRLTAGEDLQALEAVVVDASELGGTGPPAFLLEEVIVTPSRFGIEEERGLVAAMLTEADLLALPQVGEDLYRAISHLPGLAADDITARFWVRGAPHDQVLARLDGVELIEPFHMKDTDSSLSILDLETISRLNLLTGGFTAEFGDRLAGVLTMETDRYVRAKPRTTLGMSMTGARVASRGATPSGRSHWLVSARTGYPQVALRVRGADDSTELKPRYHDVFAKWETNLTPNQTLAVHALHAADRMTMNEGTQAQLHSRYGSDYAWLRWQGDFGAVQGEAVLSHAQLSWSRRASGLWNRWYELGAADERELRTTSFRQDWTAKWHPRVLLRAGMQVTTGRADFDYHGFHEALVSTDAGLIKTRQFRDLTVAPAGESWGTYLAVRAQPGGGWTVEPGVRFDGNNYAHDADVSPRFNAAWSRGATTLRFGWGRFHQAQPLYRLGVLDGETRFYPSERAEHRVVGLERRLRGGINLRLEAYERAVNRPQPHWENGVETLESAPEQGYDRLRLDPLRQRARGLELIAERRGTKLSWSGSYGLARSEETLRSGVTIARARDQRHTVYLDVTYTPNRRWQFSLAGQYHTGWPTTELDFHAAPYAEGGTVVYGELRTPFAERLPAYQRVDLRIQRRFELKRGTLRLYVDIFNVFDRENMISYGHNVTVRPDDSLEVRRTRGDLLMPLIPSVGFTWDF

SEQ ID NO: 21002 - protein, 605 aa, Brucella suis
MLLGSFPFSIGQLAAAPLDLEQQVVTATRTAQTAQQSLAAVTVLDRERIERSQAASLPELLKQVPGVSLANNGGPGKSTALFMRGTESDHVLVMIDGIKIGSVSAGGAALQDLPLELIERIEVVRGPRSSLYGSEAIGGVIQIFTRKGQGQGVKPFFSAGYGTHDTYTGSAGVSGGDGRGWYSLGVSGSDTDGINVKSAGTSGYENDADGYRNLSATLAAGYRFDNGLELDANLLQAKSHNDYDSVNSRRTSGFGANADGESKVFGTRARFSPLEPWRVTLQAGRSEDKSDAYQDGRFSSRFDSRRDSLAWQNDIDIAAGHTLTVGADYQRDEINGTTAYAEDSRDNFGRFVQYLGEAGRHDWQLSLRRDDNEQFGLHDTGNIGYGYALTDWLRATVSYGTAFKAPTFNELYFPDYGNPALDAETSRSLEAGLAGQHGWGHWAVNAYRTVVDDLIAYDASISAPANVQEARIRGVELVLGSQLLGWDWNANYSLLEPENRSAGANRGNELARRAKQLFNLDLDRRLGAFSVGASLHAEGQRYDDLANTRELSGYATLDLRGEYRITPEWRLQARVANLLDADYETAEGYNQPGQAAYLTVRYQAL

SEQ ID NO: 21003 - protein, 182 aa, Wolbachia endosymbiont
SYYVRLQYNGEILPFYTKVDGIKNATGKEKDSPLTRSFIAGGGAFGYKMDDIRVDVEGLYSQLAKDTAVVNASETNVADSLTAFSGLVNVYYDITIEDMPITPYVGVGVGAAYISNPSKADTVKDQKGFGFAYQAKAGVSYDVTPEIKLYAGARYFGSYGASFDKAAKDDTGIKNVVYSTVG

SEQ ID NO: 21004 - protein, 199 aa, Wolbachia endosymbiont
GPISDEETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVAFNF

SEQ ID NO: 21005 - protein, 283 aa, Ehrlichia chaffeensis
MNYKKIFVGSALISLMSILPYQSFADPVTSNDTGINDSKEGFYISAKYNPSISHFRKFSVGETPINGTTSATKKVIGLKKNGSIATHNDFTKVDPVFEFRNNLISGFSGSIGYAMDGPRIELEAAYQQFNAKNPDNNDSDSSDYYKYFGLSREDTIADKKYVVLKNERITFMSLMINTCYDITAEGVPFTPYACAGIGADLISIFKDFNLKFAYQGKIGVSYPITPEVSAFIGGYYHGVIGNQFNKIPVITPVVLDEAPQTTSASVTLDTGYFGGEIGVRFIF

SEQ ID NO: 21006 - protein, 197 aa, Wolbachia endosymbiont
GPISDEETSYYVRLQYNGEVLPFKTKIDGVTYKSGKENNSPLKASFLAGGGAFGYKMDDIRVDVEGLYSQLSKDADVVSDDKAADSVTAFSGLVNVYYDIAIEDMPITPYVGVGVGAAYISNPSKADAVKDQKGFGFAYQAKAGVSYDVTPEIKLFAGARYFGSYGASFDKVAKVDTGIKNVLYSTVGAEAGVAFNF

SEQ ID NO: 21007 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYGKSIATIDVSVPANFSKSGYNFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKGGISYQFTPEISLVAGGFYHGLFDESYKDIPAHNSVKFSGEAKASVKAHIADYGFNLGARFLFS

SEQ ID NO: 21008 - protein, 283 aa, Ehrlichia chaffeensis
MNYKKIFVRSALISLMSILPYQSFADPVTSNDTGINDSKEGFYISVKYNPSISHFRKFSAEETPINGTTALTKKVFGLKKDGDIAQHGNFDRTDPALEFQNNLISGFSGSIGYAMDGPRIELEAAYQKFDAKNPDNNDTNSGDYYKYVGLSREDAIADKKYVVLKNEGITFMSLMVNTCYDITAEGVPFIPYACAGIGADLINVFKDLNLKFSYQGKIGISYPITPEVSAFIGGYYHGVIGNNFNKIPVITPVVLEGAPQTTSALVTIDTGYFGGEVGIRFTF

SEQ ID NO: 21009 - protein, 140 aa, Yersinia pestis
TSDSTMTYRLGMNFDWDKSWLQSDVGRLTGYWSGAYTYWEGDKTSSNNSLSFSPVFVYEFAGQSVKPYVEAGIGVALFSNTEYEDNKLGGSFQFEDRLGFGLRFNGGHEVGIRATHYSNAGLSSDNDGVESYSLHYTMPL

SEQ ID NO: 21010 - protein, 197 aa, Wolbachia endosymbiont
SYYVRLQYNGEISPFKTKIDGIEYKKDNDAQDPLKASFMAGSGAFGYKMDDIRVDVEGLYSQLNKNDVSGAVFTPVTVADNVTAFSGLVNVYYDVAIEDMPVTPYVGVGVGAAYFSNPSSADTVKDQKGFGFAYQAKAGVSYDVTPEIKLYAGARYFGSYGAKFDGETKKQDSEGSDVTTTDKGAYKVFYSTIGAEA

SEQ ID NO: 21011 - protein, 185 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKSAKGDTAIKNVVYSTVGAEA

SEQ ID NO: 21012 - protein, 196 aa, Wolbachia endosymbiont
GPISDEETSYYVRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHPVFYSTVGAEAGVA

SEQ ID NO: 21013 - protein, 365 aa, Escherichia coli
IKSLLLGSAAALVAASGAQAADAIVAPEPEAVEYVRVCDAYGAGYFYIPGTETCLRISGYVRYDVKGGDDVYTGSDRKGWDKGARFALMFNTNSETELGTLGTYTQLRFNYTSNNSRHDGQYGDFSDDRDVADGGVSTGTDLQFAYITLGGFKVGIDESEFHTFTGYLGDVINDDVVAAGSYRTGKIAYTFTGGNGFSAVIALEQGGEDVDNDYTIDGYMPHVVGGLKYAGGWGSIAGVVAYDSVIEEWATKVRGDVNITDRFSVWLQGAYSSAATPNQNYGQWGGDWAVWGGAKFIATEKATFNLQAAHDDWGKTAVTANVAYQLVPGFTITPEVSYTKFGGEWKDTVAEDNAWGGIVRFQRSF

SEQ ID NO: 21014 - protein, 197 aa, Wolbachia endosymbiont
GPISDEETSYYVRLQYNGEILPLYTKVNGITNAKGKEKDSPLTRSFIAGGGAFGYKMDDIRVDVEGLYSQLTKDATVVFDNKAADSVTAFSGLVNVYYDIAIEDMPITPYVGVGVGAAYISNPSKDDAVKDQKGFGFAYQAKAGVSYDVTPEIKLFAGARYFGSYGASFDKAAEGDTAIKNVVYSTVGAEAGVAFNF

SEQ ID NO: 21015 - protein, 184 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTSFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEA

SEQ ID NO: 21016 - protein, 280 aa, Ehrlichia chaffeensis
MNCKKFFITTALALPMSFLPGILLSEPVQDDSVSGNFYISGKYMPSASHFGVFSAKEEKNPTVALYGLKQDWNGVSASSHADADFNNKGYSFKYENNPFLGFAGAIGYSMGGPRIEFEVSYETFDVKNQGGNYKNDAHRYCALDRKASSTNATASHYVLLKNEGLLDISLMLNACYDVVSEGIPFSPYICAGVGTDLISMFEAINPKISYQGKLGLSYSINPEASVFVGGHFHKVAGNEFRDISTLKAFATPSSAATPDLATVTLSVCHFGVELGGRFNF

SEQ ID NO: 21017 - protein, 276 aa, Ehrlichia chaffeensis
MNCKKFFITTALVSLISFLPGISFSDSVQDDNVSSNFYISGKYVPSASHFGVFSAKEEKNATVALYGLKQDWNGASASGHTDADFNNKGYSFKYEDNPFLGFAGAIGYSMGGPRVEFEVSYERFDVKNQGNNHKNDAHRYCALDRKATGSNATSGQYVLLKSEGLLDISFTLNACYDIVNESIPFSPYICAGVGTDLVSMFEATNPKISYQGKLGLSYSINPEASIFVGGHFHKVIGNEFRDIPTLKAFAASSATPDFSNSHIECVSFWNRTWRKV

SEQ ID NO: 21018 - protein, 808 aa, Pseudomonas aeruginosa
MRNTLTLHPRLSTAALAMALLAPIASQAEAQKIQFDIGAQSLPSALRQFGQQSQLQVLYSADEVQGLRSNAVRGQLSVEAALAELLRGTGASYSLQGSSVTISAQRSADSVDLGDITVTSQESAWGHVNGYVAKRSGTGTKTDTPLKEIPQTINVVTQDEIKARGSQTVTEALRYTPGITGGGFADRVKIFDEPTSRGFSPAPMYLDGLHMPYGGGSTGGALQIDPYTLERIEVLKGPASVLFGQNQPGGIVNMVSKRPTAEPIHEVVLGGGSQDRRYGAFDVAGALDEQGTYLYRITGVGRDINSEIDYAEQKRFMLAPSFTWNPNEQTSLTFYGQYQKDNDVPEAQGLPAYGTVFSTPNGRIKRSTFIGEPGLNSYDRDQFVVGYEFSHEFNDVWTFKQNTRYAYVDDQYVAPLHGYRFVPNPNTGANDQRYTTRYGVDWSQTNKVFGMDNILQAKYKTADIEHTSLIGLDYYHSNSKFLGLYSYEAASPIIDLYKPVYGKPFTFGSPYRWDRTIRQTGVYLQDQMKWNQWFLTLGGRYDWAETDSKETAGHSNAKDEKFSGRAGFGYEFSNGITPYVSYSESFQPVSGYNLDQNSKAFKPTTGKQYEAGIKYQPPGQDSFIQASVYQIDQKNVLTTNLENPNFYNQSAAMRSKGFELEGKASLTNNLGIIASFSRNDVKYTKDNDGREGRHPAGTPPMTAAVWLDYTLGGDTVLAGLGAGIGARYTRGSDGTDTADNHFTIPSYTLYDGKLSYDFEKSPLRLKGLKLQVNLENIEDKKYVSRCAGIWDCYYGQGRTITSDLTYNW

SEQ ID NO: 21019 - protein, 179 aa, Wolbachia endosymbiont
SYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKVLYST

SEQ ID NO: 21020 - protein, 198 aa, Wolbachia endosymbiont
GPISDEETSYYVRLQYNGEFLPLFTKVDGITYKKDKSDYSPLKPSFIAGGGAFGYKMDDIRVDVEGVYSYLNKNDVKDVTFDPANTIADSLTAFSGLVNVYYDIAIEDMPITPYIGVGVGAAYISNPSKVDAVKDQRGFGFAYQAKAGVSYDVTPEIKLYAGARYFGSYGANFDKTAKDDAGIKGVLYSTVGAEAGVA

SEQ ID NO: 21021 - protein, 279 aa, Ehrlichia chaffeensis
MNCKKFFITTALVSLISFLPGISFSDPAQDDNVGGNFYISGKYMPSRSHFGVFSAKEEKNRTVALYGLKTMIGTDASASGHAETDFNNKGYSFKYENNPFLGFAGAIGYSMGGPRIEFEMSYETFDVKNQGNNYKNDAHKYCALDRTGSTNPTANKYVLLKSEGLLDISFMLNACYDIINESIPFSPYICTGIGIDLVSMFEATNPKISYQGKLGLSYSINPEASIFVGGHFHKVIGNEFRDIPTLKAFVTTSTAIPDLAIVTLSVCHFGVELGGRFNF

SEQ ID NO: 21022 - protein, 1789 aa, Escherichia coli
MEIFIMNKLTEQHLLKKSRFLKYSLLASISVGAIIAIPFEGMAMSKEAFRIDLSNKLLNNLSQLNGNKDTTNTPQQIGTVIVPEPEINTYTPSEIREMKISNKPKASNPLKDVPVEDHYKVVARSKSDVGKARKVRPITRRKTFVGTEKTEQIQNTYTPEPTEQMLQKPEIIITASSPTVSPASNNSFVTAPNTPNTTLISPEHYTTAPGTPSSTPVTPYQSTSDSKPNDSLGANTPPNTNSKAARRLSFSSSDPQQQTVQSSSQVKPEVPPKSTFVPLPIKKSSTEIAAGMVSNISRVNEMIGIKLAEVTQAIQKNTTDTKNTKSLQKLYMQLTSAQKTIETLKSKAEKIETQIKVGGEDKNKIKKLEKKLTSKNNKADRLFQKIEKIDIPANKISIESQETVPVTTASTQVSAFQAQQARINEAQQGVLVQKNQQHIAAEKTKKQRQAEDKQRTEREKKKQEAQKQLSEIKKQEQAIKTAADKAKEVAASAKKETSRTALRTMQDKMNGYSEQLNEMANLKLLTPAVYNSSTGSTYKQPPKAKPTMPLSHGVQRILGEQPEDEEEYLVPIKVQQQPYIVILPSQEIENPKSMDSGLGSLSSGTLGKETDHSKDIYEAKASQYINYLNSIQPNQSNQAQIDGVMDSLATEMRKLSADQFNQKLGEIAHLASIKAYEGLFSKLYDIQQARVPETQKVYEQVEIFQSYAEYEEKSRKSATPILSRSSSAKSDSSRKNNVSGSIPEIQQLQSEKMRTETLGVQNDLGLDLHSQEERFDSGFRSLESQNLSSAYDFDQLSASWDAAYNQRMNTNVPQETLTEESTYSGSSKKKQGNIIKRAVSKVGSILQTNDAENRKRKRDGETSKQRTVDQEGGFGHAWGNENHKESSLSVVSGFTKKATQLVSLLDAKRTTILQTTSPSQKKSLNLVLQEIENDYHETIKISQELQQVLIHKPEDIKAYNAKAEKKIDAIKSRADKHFNNIKTDADVGFNPNWGNSHSMPTANMNSLPNLVDSTIKKGTQPLSTIYESVSDENLASETIYKTEQPKPSISYKNTSKRKLPIPLFRSAELDKKLDYLDLEDKLLKVEEARIVKEKQAIAKLNQYRDPENLEFKRLAVEARDLSSKESQLKEKRKAIEAAFSLNEEYSSTDVSISRSYSIGDISSLLSDAESNLSRSPSVSGLEDLNNSNVMKLGELESKHDEKIANDYKAKVTESKPVFSCSSSVGSINSLSNGDDLSSRDVVTPVDTLTIEIDKDYVDTYIRVLSNKIQKIEELPGSSSRSEELNHIKEAMAYISNRIQDVEELDEKMLLAMNARLQEHDEKISSLLLEKYTGEEAADILAQLLLQDMLVSDGKSESTLPAGDEEQEDTEVTEVSRQLSSLPALASSNECALALSDDREKECLALGDGSEDKESYDSGFEEEEETIGQLSDSDGGNLKITEVDTAIPLEQEAKKEMQTQISENAPTLNQVKVVNTIVNNMIRNRLDASMNMSNNMVAVGAGDEEESHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIRSNVKHRNHSYNAEALLHYNYLLQSKLIITPNIGLRYGKSRDGVYHETGINVQEIALTMKENNILSGIVGTKVTVPLKDALKFNNLGLTFQGAVEHNFKEKTQRINRVVKIFDNTFKHNYLIPKQPKTSYNLGTGIIGSIKNTTISLDYNYYLNKHYRSHQGSVKLKVNL

SEQ ID NO: 21023 - protein, 233 aa, Wolbachia endosymbiont
MHYKKFFSAAALATLLSLSNSAFSDPVGPISDEETSYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFCAHFDKDTAAASKDKGELKVLYSTVGAEAGVAFNF

SEQ ID NO: 21024 - protein, 759 aa, Haemophilus somnus
MKSKYSIILNQLFLSSSLMFPALSLADSNPAKTKPHKAEELGEISVVANVEPIFSSTQSSEQLRKNMVSNERDLFRHEVGIGVPEAGRSGSNGFAIRGVDKDRVAVIVDGIPQAESTMSTSARYSTERHNGNINNTEYENISSVKVQKGANSVINGSGALGGAVVFTTKEIEDFVDPDRTFGFLSKTGYTSKNREWREVIGGGVKGEHFFGFAQLTKRWGHETVNNGKGDDILGEHRGKPNPLNYYTTSWLSKVGYDINNTHRFTLFYEDRNEKKFTEEKTLGLSDENRFATDRTPYRRYGIEYRYNGLSWLETAKLFVAKQQIKQLSALRGVNSVNNNLFQLASYQYIQDQTITRGELSTYPLALWRTTHRLSGKVEFRDQFLENSNSQRYFVSYLIKRNRPNYTEIVPVKSRVMSISLLDEIALTDALKATIGGRYDRYNYNPQQKMNQQINFAIVKFPPRKLSHLSWQLGLEYQVHPSHQIGYRLSTGFRVPRVEDLYFVARDSGTTHQFRPNPLLQAETALNHELSYRFQNQYTHFSIGLFRTRYHNFIQERERCQPSFLNEKECGFNLITQFVNEPKAVIKGIEVSGAVNGSALGLSDGLTFRLKGSYSKGQNHDGEPLRSIQPWTVVGGIDYETEKWSISLTGRYSAAKKAKDAIVITYETVDVNAKKKVNQWPHLSPSYFVVDLTGQVNLSKNVILNLGVFNLFNRDYMTWDSAYNLFTRGYTSRSVSRNSPGINRFTAPKRNFAASVEVRF

SEQ ID NO: 21025 - protein, 667 aa, Erwinia pyrifoliae
MKKKYAKASVLCCLISPMVWAEHSPEATEDTLVVTANKREEALNKVDGSVLVKTGEELEQAGITQVQDLERAFPGLQIRSRGNRTYSATTIRGISSPDFYSPSIRIYVDGVPQDHQFLTQELINVERVELLRGPQGTLYGGNAQAGVINIITRSPKEGPWLNLSGNYSKLKQGGSFSGSMPLIEDVLYGSTSLRWVNESGQIDIPSRGDKNVDSSKTWLGKGQLTFAPEDSPFSAELSFAHEDLDSHEELYLTDEQFRQKKYEGPIPDLTRRVNSYTLKAEYDFGSSTLTSVTSYQDRDIFRDFIGGKWKEKHHATTQELRLNSNFSNGISSVLGGWFSDENNKHHTSGYPGYYGDAFNTIKGKSLALFGEVKLPIAAQWDLTLGGRLSHEKSQIDYAGRSGMMAVDAFDNQVSSNEFTPKAALGWQFTPDTRFYVSATKGYKPGGFNNIVSSANDRKPYDTETSDNYELGWHTSFFNNAMTLDSAVYYIRSKDKQIYVGPIGMQSIRNAGKAESKGIELSSQIKPMQGLKFSLGGSVGKSNFTDATDTTNGISYNGKRLPYAPDVMLNASFDYLIDQTLLPGNLYLNAGARYYSKSYFNEANTLEQGGYTLYDASLSLEMAHGINVKFYGENLGNKKYRLSSFQQGNTLSMMSKGLNVGLDVSVAL

SEQ ID NO: 21026 - protein, 199 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDLEKKVTDKGAHKVFYNTIGAEA

SEQ ID NO: 21027 - protein, 205 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYNVTPEIKLYAGARYFGSYGANFDGTKQDPAHPDDPEKKVTDKGAHKVFYSTIGAEAGVVFNF

SEQ ID NO: 21028 - protein, 374 aa, Wolbachia sp. wKue
EEKFMKPLKQVLSELKLRGSFGLSGNNAIGDYNYETKMSQQSYIVDGSVVSGWAPSNIANPDLKWEVSKQTNLGVDIGLFHNRIFMQLDLYKSITSDMLLNTIVPSTLGVSRMLQNVGSVENKGIEFNIVSRNLTGKFKWTTTFNISANRNKVLALGLDSEAIIDGVAESNITKVGYPIGMFYGNVFGGIYQSMEEIQALRNDPYSGLAFDPNVRPGDCKWYDLNGDGLYDDNDRTIIGNPYPRFNAGMVNTFSYRNFSFSFQLNGQYGNQIYNYTLRETLRGNNNGNLSIKVADRWRSPESPGNGLADRTYTSNDVHPTTEMSKFTNRYLEDGSYLSIRNIQLSYTFDKKTLRKTFLNGLVLSFNIGQLAYFH

SEQ ID NO: 21029 - protein, 191 aa, Wolbachia sp. wKue
  misc_feature (7)..(7): Xaa can be any naturally occurring amino acid
  misc_feature (71)..(71): Xaa can be any naturally occurring amino acid
  misc_feature (76)..(76): Xaa can be any naturally occurring amino acid
DEETSYXIRLQYNGEFLPLFTKVDGITYKKDNSDYSPLKASFIAGGGAFGYKMDDIRVDVEGVYSYLNKNXVTDAXFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 21030 - protein, 189 aa, Wolbachia sp. wKue
  misc_feature (33)..(33): Xaa can be any naturally occurring amino acid
  misc_feature (36)..(36): Xaa can be any naturally occurring amino acid
  misc_feature (47)..(47): Xaa can be any naturally occurring amino acid
  misc_feature (51)..(51): Xaa can be any naturally occurring amino acid
  misc_feature (56)..(57): Xaa can be any naturally occurring amino acid
  misc_feature (60)..(60): Xaa can be any naturally occurring amino acid
  misc_feature (72)..(72): Xaa can be any naturally occurring amino acid
  misc_feature (76)..(76): Xaa can be any naturally occurring amino acid
  misc_feature (86)..(86): Xaa can be any naturally occurring amino acid
DEETSYYVRLQYNGEVLPLFTKVDGMTFKKGNXDVXPFKASFIAGGXAFGXKMDDXXVDXEGVYSHLNKNVXTDAXFTPDTVADSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGA

SEQ ID NO: 21031 - protein, 192 aa, Wolbachia endosymbiont
  misc_feature (1)..(1): Xaa can be any naturally occurring amino acid
  misc_feature (29)..(29): Xaa can be any naturally occurring amino acid
XDEETSYYVRLQYNGEILPLYTKVDGITXATGKEKDSPLTRSFIAGGGAFGYKMDDIRVDVEGLYSQLAKDATVVSDNKAADSVTAFSGLVNVYYDIAIEDMPITPYIGVGVGAAYISNPSKADAVKEQKGFGFAYQAKAGVSYDVTPEIKLFAGARYFGSYGASFNKETVSATKEINVLYSAVGAEAGVAL

SEQ ID NO: 21032 - protein, 196 aa, Wolbachia endosymbiont
DEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKEFGFAYQAKAGVSYDVTPEIKLYAGARYFGSYGASFNKEAVSATKEINVLYSAVGAEAGVAFNF

SEQ ID NO: 21033 - protein, 191 aa, Wolbachia endosymbiont
  misc_feature (16)..(16): Xaa can be any naturally occurring amino acid
  misc_feature (29)..(29): Xaa can be any naturally occurring amino acid
  misc_feature (31)..(31): Xaa can be any naturally occurring amino acid
  misc_feature (35)..(35): Xaa can be any naturally occurring amino acid
  misc_feature (38)..(38): Xaa can be any naturally occurring amino acid
  misc_feature (60)..(60): Xaa can be any naturally occurring amino acid
  misc_feature (66)..(66): Xaa can be any naturally occurring amino acid
  misc_feature (71)..(71): Xaa can be any naturally occurring amino acid
  misc_feature (76)..(76): Xaa can be any naturally occurring amino acid
DEETSYYVRLQYNGEXLPLFTKVDGITYXKXNSDXSPXKASFIAGGGAFGYKMDDIRVDXEGVYSXLNKNXVTDAXFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGAHTVLYSTVGAEA

SEQ ID NO: 21034 - protein, 290 aa, Wolbachia endosymbiont
ETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHEQIDNVKIEKYQIHRLVSGYDNDALHASVAVQQQDAKLVEDNYSHNSQTEVAATLAYRFGNVTPRVSYAHGFKGSFDDADRYNTYDQVVVGAEYDFSKRTSALVSAGWLQEGEGESKFVSTA

SEQ ID NO: 21035 - protein, 158 aa, Wolbachia endosymbiont
DDLEVYTRLGGMVWRADSSNSIAGDDHDTGVSPVFAGGVEWAMTRDIATRLEYQWVNNIGDGNTVGVRPDNGMLSVGVSYRFGQQEDAAPIVAPAPAPAPEVQTKHFTLKSDVLFNFNKATLKPEGQQALDQLYTQLSNLDPKDGSVVVLGFTDRIGS

SEQ ID NO: 21036 - protein, 185 aa, Wolbachia endosymbiont
  misc_feature (5)..(5): Xaa can be any naturally occurring amino acid
  misc_feature (7)..(7): Xaa can be any naturally occurring amino acid
  misc_feature (29)..(30): Xaa can be any naturally occurring amino acid
  misc_feature (36)..(36): Xaa can be any naturally occurring amino acid
  misc_feature (60)..(60): Xaa can be any naturally occurring amino acid
  misc_feature (71)..(71): Xaa can be any naturally occurring amino acid
  misc_feature (76)..(76): Xaa can be any naturally occurring amino acid
  misc_feature (82)..(82): Xaa can be any naturally occurring amino acid
  misc_feature (86)..(86): Xaa can be any naturally occurring amino acid
DEETXYXVRLQYNGEVLPLFTKVDGITYXXGNSDDXPFKASFIAGGGAFGYKMDDIRVDXEGVYSHLNKNXVTDAXFTPDTXADSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYS

SEQ ID NO: 21037 - protein, 189 aa, Wolbachia endosymbiont
  misc_feature (8)..(8): Xaa can be any naturally occurring amino acid
  misc_feature (40)..(40): Xaa can be any naturally occurring amino acid
  misc_feature (71)..(71): Xaa can be any naturally occurring amino acid
  misc_feature (76)..(76): Xaa can be any naturally occurring amino acid
  misc_feature (86)..(86): Xaa can be any naturally occurring amino acid
DEETSYYXRLQYNGEFLPLFTKVDGITYKKDNSDYSPLKXSFIAGGGAFGYKMDDIRVDVEGVYSYLNKNXVTDAXFTPDTIADSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGA

SEQ ID NO: 21038 - protein, 199 aa, Wolbachia endosymbiont
DEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGATYISTPLEPAVNDQKSKFGFAGQVKAGVSYDVTPEVKLYAGARYFGSYGANFDGKKTDPKDSTRQVTDAGAYKVLYSTVGAE

SEQ ID NO: 21039 - protein, 189 aa, Wolbachia endosymbiont
  misc_feature (5)..(6): Xaa can be any naturally occurring amino acid
  misc_feature (16)..(16): Xaa can be any naturally occurring amino acid
  misc_feature (21)..(21): Xaa can be any naturally occurring amino acid
  misc_feature (29)..(30): Xaa can be any naturally occurring amino acid
  misc_feature (36)..(36): Xaa can be any naturally occurring amino acid
  misc_feature (47)..(47): Xaa can be any naturally occurring amino acid
  misc_feature (60)..(60): Xaa can be any naturally occurring amino acid
  misc_feature (69)..(69): Xaa can be any naturally occurring amino acid
  misc_feature (72)..(72): Xaa can be any naturally occurring amino acid
  misc_feature (77)..(77): Xaa can be any naturally occurring amino acid
  misc_feature (82)..(82): Xaa can be any naturally occurring amino acid
  misc_feature (84)..(84): Xaa can be any naturally occurring amino acid
DEETXXYVRLQYNGEXLPLFXKVDGITYXXGNSDDXPFKASFIAGGXAFGYKMDDIRVDXEGVYSHLNXNVXTDAVXTPDTXAXSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGA

SEQ ID NO: 21040 - protein, 416 aa, Wolbachia endosymbiont
DEFFATSELSRSYRNTTWRIGVNEWHYKVDYASNTTMYDHMVGEYPERLVREGNTDGVYYDFNKNASEYYKGHENKLAVYATHDWDISPKWNVYYGARLEWQHLEGENAAVYDAEGNAVGRFPDYYLGAVSDKGVRITPRLFDYDWMNMAFTAAATYKLTREFGFTADFTYNTQRPGLSNFAPATMPNTDKISVPLGRAGVYYNTDWISLTSLFSYISKTNNNSTLNLINPNDQTEILAAPLSYDIQTIGWTTDAVIKPFKGFNFHFLFTYQSPTYKKYETSVTFKDGTVGEIDATGNIVTEIPKVLVELDPSYNITNDLRVWASFRYFSKTYANIKNAYYFNGRWETFGGINWTVNKHLALSATVINFLNQTGAKGSIAGAELVDKKDAASYNGHWMAGSYIRPFTVELAASIRF

SEQ ID NO: 21041 - protein, 174 aa, Wolbachia endosymbiont
  misc_feature (1)..(1): Xaa can be any naturally occurring amino acid
  misc_feature (3)..(3): Xaa can be any naturally occurring amino acid
  misc_feature (5)..(6): Xaa can be any naturally occurring amino acid
  misc_feature (8)..(8): Xaa can be any naturally occurring amino acid
  misc_feature (10)..(11): Xaa can be any naturally occurring amino acid
  misc_feature (13)..(15): Xaa can be any naturally occurring amino acid
  misc_feature (18)..(19): Xaa can be any naturally occurring amino acid
  misc_feature (22)..(22): Xaa can be any naturally occurring amino acid
  misc_feature (44)..(44): Xaa can be any naturally occurring amino acid
  misc_feature (50)..(50): Xaa can be any naturally occurring amino acid
  misc_feature (55)..(55): Xaa can be any naturally occurring amino acid
  misc_feature (60)..(60): Xaa can be any naturally occurring amino acid
  misc_feature (70)..(70): Xaa can be any naturally occurring amino acid
XPXFXXVXGXXYXXXNSXXSPXKASFIAGGGAFGYKMDDIRVDXEGVYSXLNKNXVTDAXFTPDTIADSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAE

SEQ ID NO: 21042 - protein, 185 aa, Wolbachia endosymbiont
SYYVRLQYTGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVVYSTFGAEA

SEQ ID NO: 21043 - protein, 185 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEA

SEQ ID NO: 21044 - protein, 185 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKGDTAIKNVVYSTVGAEA

SEQ ID NO: 21045 - protein, 641 aa, Bordetella pertussis
MHIYGNMNRATPCRGAVRALALALLGAGMWTLSPPSAWALKLPSLLTDDELKLVLPTGMSLEDFKRSLQESAPSALATPPSSSPPVAKPGPGSVAEAPSGSGHKDNPSPPVVGVGPGMAESSGGHNPGVGGGTHENGLPGIGKVGGSAPGPDTSTGSGPDAGMASGAGSTSPGASGMPPSEGERPDSGMSDSGRGGESSAGGLNPDGAGKPPREEGEPGSKSPADGGQDGPPPPRDGGDADPQPPRDDGNGEQQPPKGGGDEGQRPPPAAGNGGNGGNGNAQLPERGDDAGPKPPEGEGGDEGPQPPQGGGEQDAPEVPPVAPAPPAGNGVYDPGTHTLTTPASAAVSLASSSHGVWQAEMNALSKRMGELRLTPVAGGVWGRAFGRRQDVDNRVSREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRTELAVGVASQLGKHGSLFGSYEYAKGSRQTMPWTFHVGYRYAW

SEQ ID NO: 21046 - protein, 365 aa, Erwinia chrysanthemi
MRLMMKKSTLSAVILAALTSSSAFAAHTFINDAGDSLTIDGRFDLRYQDRGGDDNGEWNSGSSRFGLKGQTDLDNGWTGFGHAEWGYNSGANGDNIYDRLLYAGVDHEKYGKIAAGTKQWSTFYDVAWYTDLGRVFGTRGSGVYNLADWGIASGAGRAENSITYRNSINEKVGYGFTYQTTREDVALANNATASLKNGMGASITYKPVDGVTLGAAYHQNEVADLDASVVGVENGDNMRIMLLGANYSNGGFYAGATFHVGENWEAVSQSGTDVMFDTLGGEIYTYYHFDNGLRPTLNYNYMEDRGDETQGYERNLLIPGLEYHFQKNKFLVWTEYQFDLGKDQYDGSKFENRDDQFAAGIRYYF

SEQ ID NO: 21047 - protein, 212 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQNQPPTLVPAVVGK

SEQ ID NO: 21048 - protein, 385 aa, Neisseria meningitidis
MRKKLTALVLSALPLAAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 21049 - protein, 373 aa, Aeromonas hydrophila
MKKTILAIAIPALFASAANAAVVYDKDGTTFDVYGRVQANYYGDHNKSVAATDGSWGFSETGTPEYTPGTAAHYSDVDGELVGSSRLGWSGKIALNNTWSGIAKTEWQVSAENSANKFDSRHIYVGFDGTQYGKIIFGQTDTAFYDVLEPTDIFNEWGDVGNFYDGRQEGQVIYSNTYGGFKGKLSYQTNDDKAVKVTDVGQGIKEKAVYGKDVKRNYGYAAAAGYDFDFGLGLNAGYAYSDLENTATNNTGDKKEWAPGAHYAINGFYFAGVYTQADLSYDTTTGGDKDKGRGYELAASYNVDAWTFLAGYNFTEGKVASNKAGAEYQDIVDETLLGVQYAFTSKLKAYTEYKIQGIDKMDDEWTVALQYNF

SEQ ID NO: 21050 - protein, 180 aa, Wolbachia endosymbiont
SYYVRLQYNGEILPFYTKVDGITNATGKEKDSPLTRSFIAGGGAFGYKMDDIRVDVEGLYSQLTKDATVVSDNKAADSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAVG

SEQ ID NO: 21051 - protein, 182 aa, Wolbachia endosymbiont
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSIVG

SEQ ID NO: 21052 - protein, 182 aa, Wolbachia endosymbiont
SYYVRLQYNGEILPLFTKIDGITNATGKEKDSPLKASFIAGGGAFGYKMDDIRVDFEGLYSWLNKDADVVGDTVADNLTAISGLVNAYYDIAIEDMPITPYVGIGVGAAYVSNPLATKVTNDKASGFGVAYQAKAGVSYDVTPEVKLYAGARYFGSYGANFGKATKDDAGIKVLYSTVGAEA

SEQ ID NO: 21053 - protein, 188 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKASAVKDQKGFGFAYQAKAGVSYDVTPEIKLYAGARYFGSYGASFNKETVSATKEINVLYSAVGAEAGVA

SEQ ID NO: 21054 - protein, 205 aa, Wolbachia endosymbiont
SYYIRFQYNSEFSPLNTKVDGITGAQKDSKDTNDLYKPSFMAGGSAFGYRMDDIRVDIEGLYSQLSKSTLSRAPTPDIVDNLTAISGLVNVYYDVIIEDIPITPYVGVGLGVAYISNPAKAQVIADQKHGFGFAYQAKAGISYDVTPEIKLFAGARYFGSYGANFDKSEEVNKGTSEDKETKVTAGAYKVLYSTIGAEAGVAFNF

SEQ ID NO: 21055 - protein, 180 aa, Wolbachia endosymbiont
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYST

SEQ ID NO: 21056 - protein, 339 aa, Vibrio anguillarum
MNKTLIALAVSAAAVATGVNAGEIYNQDGASLTMGGRAEARLSLKDGKADDKSRVRLNFLGKVAINDSLYGVGFYEGEFTTNDQGEAKDGNLNNRYTYAGIGGTYGEVTYGKNDGALGVITDFTDIMAYHGNSAAYKIAVADRVDNMLAYKGQFGDLGVKASYRFADRSADKDVNGDWNNAYTDNNADGYSLSAVYAIGETGITLGAGYADQDNQNTSADQYMLAASYTISDFYFAGTFVDGQVKEFNDKADLTGYELAAKYTMGQAVFSTTYNYLESKSSGTKTDEADNFAIDATYYFKPNFRSYISYNFNLLDEDANKGITKAQAEDELAIGLRYDF

SEQ ID NO: 21057 - protein, 196 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFSGQVKAGVSYDVTPEVKLYAEARYFGSYGANFDGKKTDPKNSTGQAADAGAYKVLYSTVGAEA

SEQ ID NO: 21058 - protein, 209 aa, Wolbachia endosymbiont
DEETSYYIRLQYNGEVLPFKTEVDGITGAKKKTTDTNTTTDLYKASFMAGGGAFGYKMDDIRVDVEGLYSQLSKDTFDTAPTPAIADKLTAISGLVNVYYDVAIEDMPITPYVGVGIGAAYVSNPATAQVVADQKHGFGFAYQAKAGVSYDITPEIKLFAGARYFGSYGASFDKSEQVDKVGGASGEKEARVTKDAYKVLYSTIGAEAG

SEQ ID NO: 21059 - protein, 632 aa, Helicobacter pylori
MKKTKKTILLSLTLASSLLHAEDNGVFLSVGYQIGEAVQKVKNADKVQKLSDAYENLNKLLANHSHSNPEAINANSATAINQAIGNLNANTQNLIDKTDNSPAYQATLLALKSTVGLWNSIAYAVICGGYTDKPNHNTTETFYNQPGQCSDSITCGGHVGLLQAGKNNSLSIEQFATLNKAYQIIQAALKQGLPALSDTKKTVEVTIKTATNANNINVNNNNNNAADTTVSITDTFINDAQNLLTQAQTIINTLQDNCPQLKGKSSSNGGTNGANTPSWQTGANQNSCSVFGTEFSAISDMISNAQNIVQETQQLNTTPLKSIAQPNNFNLNSPNSIALAQSMLKNAQSQAAVLKLANQVGSDFNRISTGVLKNYIEECNANASSESVSSNTWGKGCAGVKQTLTSLENSNASFSSQTPQINQAQNLANTIVQELGHNPFKRVGIISSQTNNGAMNGLGVQVGYKQFFGEKKRWGLRYYGFFDYNHTYIKSNFFNSASDVWTYGVGSDLLFNFINDKNTNFLGKNNQISVGLFGGIALAGTSWLNSQFVNLKTISNVYSAKVNTANFQFLFNLGLRTNLARPKKKDSHHAGQHGMELGVKIPTINTNYYSFLDTKLEYRRLYSVYLNYVFAY

SEQ ID NO: 21060 - protein, 643 aa, Helicobacter pylori
MKKTKKTILLSLTLAASLLHAEDNGVFLSVGYQIGEAVQKVKNADKVQKLSDVYEQLSKLLANDNGTSSKTSAQAINQAVNNLNESAKTLAGGTTNSPAYQATLLALRSALGLWNSMGYAVVCGGYIKKPGENNQKNFHYTDENGNGTTINCGGSTNSNGTHSPNGTNTLKADKNVSLSIEQYEKIHEAYQILSKALKQAGLAPLNSKGEKLEAHVTTSKDQQGTSSDQTTTTTSVIDTTNDAQNLLTQAQTIVNTLKDYCPMLIAKSSSNGGTNGANTPSWQTAGGGKNSCATFGAEFSAISDMISNAQKIVQETQQLNANQPKNITQPNNFNLNSPGSLTALAQSMLKNAQSQTEILKLANQVASDFDKLSSGYLKDYIGKCDVSGVSSSNMTPQNMNTTWGKGCAGVEETLTSLKASTTDFNNQTTPQLDQAQTLANTLTQELGNNPFKRVGIIGSQTNNGAMNGLGVQAGYKQFFGQKRRWGLRYYGFFDYNHTYIKSSFFNSSSDVLTYGVGSDLLFNFINDKNTNFLGKNNKISVGLFGGIALAGTSWLNSQFVNLKTISNVYSAKVNTANFQFLFNLGLRTNLARPKKKDSDHSAQHGMELGVKIPTINTNYYSYLGTKLEYRRLYSVYLNYVFAY

SEQ ID NO: 21061 - protein, 631 aa, Helicobacter pylori
MKKTKKTILLSLTLASSLLHAEDNGVFLSVGYQIGEAVQKVKNADKVQKLSDAYENLNKLLANHSHSNPEAINASSATAINQAIGNLNKSAQSLIDKTDNSPAYQATLLALKSTVGLWNSIAYAVICGGYTDKPNHNITETFYNQPGQGSDSITCGGYVGLLQAGKGNSLSIEQFATLNKAYQIIQAALKQGLPALNNTKKTVEVTIKTATNAQNINVNNNNNNAADATISITDTFINDAQNLLTQAQTIINTLQDNCPMLKGKSSNGGTNGANTPSWQTSANQNSCSVFGTEFSAISDMISNAQNIIQETQQLNTTPLKSIAQPHDFNLNSPNSIALAQSMLKNAQSQAAVLKLANQVGSDFNRISTGVLKNYIEECSANASSESVSNNTWGKGCAGVKQTLTSLENSNASFSSQTPQINQAQNLANTIVQELGHNPFKRVGIISSQTNNGAMNGLGVQVGYKQFFGEKKRWGLRYYGFFDYNHAYIKSNFFNSASDVWTYGVGSDLLFNFINDKNTNFLGKNNQISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 21062 - protein, 641 aa, Helicobacter pylori
MKKTKKTILLSLTLASSLLHAEDNGVFLSVGYQIGEAVQKVKNAGKVQKLSDTYEQLSRLLTNDNGTNSKTSAQAINQAVNNLNERAKTLAGGTTNSPAYQATLLALRSVLGLWNSMGYAVICGGYTKSPSENNQKDFHYTDENGNGTIINCGGSTNSNGTHSSNGTNTLPADKNSSLSIKQYEEIHEAYQILSKALKEAGLAPLTSKGDKLEAHVTTSVNQQSNEIKTTTSVIDTTNGAQNLLTYAQTIVNTLKDYCPMLIAKSSSGSSGGATTNTPSWQTAGGGKNSCTTFGAEFSAASDMINNAQEIVKKTQQLSANQPKNITQPHNFNLNSPSSLTALAQKMLKNAQSQAEILKLANQVESDFGKLSSGYLKDYIGKCDMSAISSTNMTMQNQKSNWGNGCANVEETLASLKSSNASFDSQTPQINEAQTLASTLIQELGNNPFGNVGMIASSATNNGALNGFGVQAGYKQFFGKKKRWGLRYYGFFDYNHAYIKSSFFNSSSDIWTYGVGSDLLFNFINDKNTNFLGKNNKISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 21063 - protein, 640 aa, Helicobacter pylori
MKKTKKTILLSLTLASSLLHAEDNGVFLSVGYQIGEAVQKVKNADKVQKLSDAYEQLSRLLTNDNGTNSKTSAQAINQAVNNLNERAKTLAGGTTNSPAYQATLLALRSVLGLWNSMGYAVICGGYTKSPGENNQKNFHYTDENGNGTIINCGGSTNSNGTHSSNGTNTLKADKNVSLSIEQYEKIHEAYQILSKALKQAGLAPLNSKGEKLEAHVTTSKAQQDNQTKTTTSVIDTTNDAQNLLTQAQTIVNTLKDYCPMLIAKSSSGSSGTATTNTPSWQTSTNQNSCSVFGTEFSAISDMINNAQKIVQETQQLSANQPKNITQPHNLNLNTHSSLTALAQKMLKNAQSQAEILKLANQVESDFNKLSSGHLKDYIGKCDASAISSANMTMQNQKNNWGNGCASVEEAQSLLKTSAADFNNQTPQINQAQTLANTLIQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNQISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 21064 - protein, 632 aa, Helicobacter pylori
MKKTKKTILLSLTLASSLLHAEDNGVFLSVGYQIGEAVQKVKNADKVQKLSDAYENLNKLLANHSHSNPEAINANSATAINQAIGNLNANTQNLIDKTDNSPAYQATLLALKSTVGLWNSIAYAVICGGYTDKPNHNTTETFYNQPGQGSDSITCGGHVGLLQAGKNNSLSIEQFATLNKAYQIIQAALKQGLPALSDTKKTVEVTIKTATNANNINVNNNNNNAADTTVSITDTFINDAQNLLTQAQTIINTLQDNCPQLKGKSSSNGGTNGANTPSWQTGANQNSCSVFGTEFSAISDMISNAQNIVQETQQLNTTPLKSIAQPNNFNLNSPNSIALAQSMLKNAQSQAAVLKLANQVGSDFNRISTGVLKNYIEECNANASSESVSSNTWGKGCAGVKQTLTSLENSNASFSSQTPQINQAQNLANTIVQELGHNPFKRVGIISSQTNNGAMNGLGVQVGYKQFFGEKKRWGLRYYGFFDYNHTYIKSNFFNSASDVWTYGVGSDLLFNFINDKNTNFLGKNNQISVGLFGGIALAGTSWLNSQFVNLKTISNVYSAKVNTANFQFLFNLGLRTNLARPKKKDSHHAGQHGMELGVKIPTINTNYYSFLDTKLEYRRLYSVYLNYVFAY

SEQ ID NO: 21065 - protein, 629 aa, Helicobacter pylori
MKKTKKTILLSLTLASSLLHAEDNGVFLSVGYQIGEAVQKVKNADKVQKLSDAYENLNKLLANHSHSNPEAINANSATAINQAIGNLNANTQNLIDKTDNSPAYQATLLALKSTVGLWNSIAYAVICGGYTDKPNHNTTETFYNQPGQGSDSITCGGHVGLLQAGKNNSLSIEQFATLNKAYQIIQAALKQGLPALSDTKTTVEVTIKTATNAKNINVNNDNNNAADATIETKNTYINDAQNLLTQAQTIINTLQDNCPMLKGKSSDGSNANTPSWQTSANQNSCSVFGTEFSAISDMISNAQNIVQETQQLNTAPLKSIAQPHNFNLNSPNSIALAQSMLKNAQSQAAVLKLANQVGSDFNRISTGVLKNYIEECSANASSESVSSNTWGKGCAGVKQTLTSLENSNASFSSQTPQINQAQNLANTIVQELGHNPFKRVGIISSQTNNGAMNGLGVQVGYKQFFGEKKRWGLRYYGFFDYNHAYIKSSFFNSASDVWTYGVGSDLLFNFINDKNTNFLGKNNQISVGLFGGIALAGTSWLNSQFVNLKTISNVYSAKVNTANFQFLFNLGLRTNLARPKKKDSHHAGQHGMELGVKIPTINTNYYSFLDTKLEYRRLYSVYLNYVFAY

SEQ ID NO: 21066 - protein, 641 aa, Helicobacter pylori
MKKTKKTILLSLTLASSLLHAEDNGVFLSVGYQIGEAVQKVKNTDKVQKLSDTYEQLSRLLTNDNGTNSKTSAQAINQAVNNLNERAKTLAGGTTNSPAYQATLLALRSVLGLWNSMGYAVICGGYTKSPGENNQKNFHYTDENGNGTTINCGGSTNSDGTYNPNGTNTLKADKNVSLSIEQYEKIHEAYQILSKALKQAGLAPLNSKGEKLEAHVTTSKHQSDNQTKTTTSVIDTTNDAQNLLTQAQTIVNTLKDYCPMLIAKSSSGSSGTATTKTPSWQTAGGGKNSCATFGAEFSAASDMINNAQKIVQETQQLSANQPKNITQPNNFNLNTPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRNMGMIASSTTNNGALNGLGVQAGYKQFFGQKRRWGLRYYGFFDYNHTYIKSSFFNSASDVWTYGVGSDLLFNFINDKNTNFLGKNNKISVGLFGGIALAGTSWLNSQFVNLKTISNVYSAKVNTANFQFLFNLGLRTNLARPKKKDSDHSAQHGMELGVKIPTINTNYYSYLGTKLEYRRLYSVYLNYVFAY

SEQ ID NO: 21067 - protein, 628 aa, Helicobacter pylori
MKKTKKTILLSLTLAASLLHAEDNGVFLSVGYQIGEAVQKVKNADKVQKLSDAYENLNKLLANHGHSHQEINANSATAINQAIGNLNANTQNLIDKTDNSPAYQATLLALKSTVGLWNSIAYAVICGGYTDKPNGNITETFYNQPGQNSDSITCGGDTGLLKAGKNSHLSIEQFATLNKAYQIIQAALKKGLPALSNTKTTVEVTIKTGTNAKNINVNNNNNNAADTTVSITNINDAQNLLTQAQTIISTLQDNCPMLKGKSSNGGTNGANTPLWQTSANQNSCSVFGTEFSAISDMINNAQSIVQETQQLNTTPLKSIAQPNNFNLNSPNSVALAQSILKNAQSQAAVLKLANQVGSDFNRISTGVLKNYIEGCSANASSESVSSNTWGKGCAGVKQTLTSLESGNASFSSQTPQINQAQTLANAIVQELGHNPFKRVGIISSQTNNGAMNGLGVQVGYKQFFGKKKRWGLRYYGFFDYNHAYIKSNFFNSASDVWTYGVGSDLLFNFINDKKTNFLGKNNHFSMGLFGGIALAGTSWLNSQLVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 21068 - protein, 674 aa, Actinobacillus pleuropneumoniae
MKKTFFYSTVASAVALAISPAIAQETAVLDEVSVVGSVSKAGKVEYMTPKSVNVINDAQIADENAQKVDQALRYEAGIVTEPYGGDNDTDWFKIRGFDASMTLDGTALGKNGFFVWLPNTYGLESIEVVKGADSFTYGAVETGGLVNLVSKRPSKEPKGEIKLTGGNKDERGVSFDVSNQFADNLRYRVVGDYNKRHGQLNGTWLESYYFAPSLTWDISNTAALTLLASVQKDVGVPVNPFLPAYGSLIPTPNGTISHGVNLGEPSQDYTDRSQYSLGYEYTNKFSEGWQFTQNYRFSRLNIDQYNTFAWSSDQVANASRGYAYTVGHTNNHTFDNRISKNWNIGEFDNTTTVGVDYQHSETKGINEGFGQTVNSINMFNPIYGQTPYNPIGKSYNLKTIQLGLYAQNQLRYKNWLWNVSARHDDVRANSESNGAITGYNVSHNSYSTGLMYQFDNGLAPYANYSESFRAVSGNDDYGRAYKPFEGKQYEVGFKYLPSFINGTFSLAWFDLEEKNTLIADPSNISVQAGKQKSHGVELQANLGFTDNLSGQFAYTYTKAKTDLSVSQSIRSALIPRHAYAAKLNYRFADNVLNGLTVGAGIRYVGSTTDEQYYKGYKIGHYTLADLSAKYEFAKNWVAQVNVDNLFNKKYLASCSFYCYYGEGRKVTANLTYKF

SEQ ID NO: 21069 - protein, 506 aa, Edwardsiella tarda
MCLCAGGRCWPCAPRAERRAPSAAGLIRGTTRLKSINGKKSHMVRAAAALSLVAAALPSPASAQQPAAPPQAPAPPQAPAPLPAPAPQETGAAAGVEPLSRRVAELEQQQRALIERLEAERKAAAEERASAEKDKGSGVKVTAGAGKGFTVKTADDKFSSTIRARLQVRETITHTGEDDTHEINVRTVRLTTSGHILSPDLKYNVQLAFGGNDFEKDSASPILDAFVEYNGIRDLNVRVGQFLTPFNRARTLREPSLQQTERPIAVREFNLDRDVGLMFSSPDLFGFGGKLSYNLFVGGGEGRNRFGGQKHGPLAVARLAVRPFGAFDDDQDADLSREAKPRLAVGVTGAYNHQTNRQNSTFGTTLTLGAADYLHGAADLIFKYAGFSLAAEAVVRHAKQDSFEGEVNGAAAQEWTRSGYGYFAQAGYLLTDEVEVAARWDQIFAERGTDPKLVGLVDTQGKQVGGGLNYYVNGYALKIQGDYFYIFGKDTADARHVGRLQLDASF

SEQ ID NO: 21070 - protein, 647 aa, Zymomonas mobilis
MITDPVEAASSIQAETTSAYKEKQTTENKALLRPKDITVTAKRPISTQASSSTHISAEDMQAYRMQTVSDIAERVPNLSFTSMTPSNPVVTVRGMGSSEDHGSSSYTPILIDGVSVPSFALGQIFDLSDVDVMRGAQITEGINAFAGLISAHSHDPGDKLSASASFEYGTGNRKRGSFTADIPVNDSTSIRLALGGETADGYIHNKVLDKHNTGGWHSWWGRLKILHTDSSGGEWRISLHHMINHGGNDYFEMPENAKKHISYSTDQGKNDTEYLLGSLQYHRSFSEHLNIDAMFGGVGTKWKYWNPRSVFNAVSGNSAPTQQIGGSLMLSGTFGKLDWKGGVYGQRALRSSPYDFDMSPYYISHTTADLGTTEIAFMGELGWHFAQNWKLVPSIRVEHVDSSLKNWTSSISGDVPTAFSMYQSLPDQTISKTVPLPGVKLEYSPKNFSSLRQFMWLSYTRSFLAPGYNPFSNYAETASVPYSSSYGNNIELGYRVGDKKNIWSIEVVGFSNFLSNLQVAATSKLGETVVATAKKAHSRGMEATVHWRPIHNFKLNGFVGLTYAAYDRFIYGGKDYSGELMDSTPISNFGFSGAWTPIKDLTVNASIIRRGRSTLHPSSNVENDPYLLMDAQIQKRWKHWSIPNLRS

SEQ ID NO: 21071 - protein, 692 aa, Zymomonas mobilis
MKKFKLLPIPALVFGVFAANTFAQADTTRLDTINVTDHQGLKVKTNVVTTQIKDESTETDLRGLLKNEPSIAIGGGNGTSQYLYIRGMGQNSIDVKVDNAYSDAQIHYHQGRHMLDPAMVKIVAVQKGAGSASAGIGQTNGAIVAKTLDALDLLEGSDKNFGARVGTGFSTNYSQNYNATVYGKSGMFDALIATNFVKDGNYKAGKGYYDSLNKTDRVLYSDLNKLSYLAKVGATVGDHRFVLSHLHEQHEGDRLVREEFVNFDPTRQAPAARKMTVDNTNLEWTGKNLGFAKEATANVYRLVHGRWSANDKGNGYAGNREGATQIKVVTQGANVNFDLPVHHNVLVKYGINYRHQESKPHFKAADISNQRKSDTGFYVEAITSATDQLTLTTGLRYDQFTFKAMDGKKVSDSSFNPSIGVIFEATPELSFSASHNYATRSPRMQDAILSHGQNRGLTSILEGTKAEQARTTEIGFNYDNGTFSVDGSYFWQRIKDALGTTAGRDNHTSDGTWQSILNAGKIKNHGYELNFGYHQGGFTARLGVADSKPRFYTNLGKKAKKGGGIEDNKPLLSGNPEYASAMGRTWTASVSYRFEEPNIEIGLHHRLVEKVKAKDDFLLVGGNVTPGKGKPGYNVTDLTINWKPFNDDSMNVNFAIDNIMNKHYKSHAQRGGNANTLPARGHEFRLGVNYKF

SEQ ID NO: 21072 - protein, 750 aa, Zymomonas mobilis
MNFRALCLNTIGLSSLLSGMGTAFLSSSAWAENATSQSRNNALLFSSKASDLKKEETVPATTKQEDLIVTASRNNRMYVSSGGDLGALGNKKGLDVPFNIRSYNSSLILNQQAQTLGEVLLNDPTVRTTTGYGNYAQLFQIRGFTLYGDDVAIDGLYAVTPRQLVSPQLYDSVQVLNGASAFLNGAAPGGSAIGGNINLVPKRATSTDITRVTGDYTSNGQGGGAVDISRRFGQDRAYGFRFNAAGMNGRTAIKGERRDDIAIAGAFDWHNEDTRIDMNMNYQKQQVFGGRSSIIVSSLGTDMPVPKTTSPSKNWGQKWAYTDLSYLFGTLNIEHDFGDHITLYGKFGAQSGQEIGNYATTTLKNSYTGDGSVGAMATAYNVLNKSTQAGVRAHFKTGFIKHEINAGGSAIWEESYAAYAMSLVGQAGNIYNPIQFTPNETYASGNMKNPGRVSMNKLYSLFFSDTMNFWDDRISLTGGFRYQNILSNSYAYGTGKLQSQYESDVISPVVGLVVHPIKHFAVYFNRIQGLSAGTTVGASYVNAGQTFAPYQSTQYEVGAKYDIGRFSASVSFYQTAMPYGMVETYGNTGLLIYTQDGKQRNRAYGVIICETIWLGLRFNDGLTLIYGKQMRSSGRQLPGNNRDWRWGLYRCNGNPEYDMPFVKRSRPLSGTQLVSHRKCNNLTNANTAHLPAWARFDLGARYTFLVRNKPLTARIEIDNVGNQRYWDSVYQSNLIMGVPQTFKFSITADL

SEQ ID NO: 21073 - protein, 277 aa, Ehrlichia chaffeensis
MNCKKFFITTALVSLMSFLPGISFSDTVQGDSVSGNFYISGKYMPSASHFGVFSAKEEKNATVALYGLKQDWNGASASGHTDADFNNKGYSFKYEDNPFLGFAGAIGYSMGSPRIEFEVSYETFDVKNQGNNYKNDAHKYCALDYQGSTNATQNKYVLLKNEGLLDISFMLNVCYDITDESIPFSPYICAGVGTDLISMFEAINSKISYQGKLGLSYSISPEASVFVGGHFHKVIGNEFRDIPTLKAFATSTATPDLAIVTLSVCHFGVELGGRFNF

SEQ ID NO: 21074 - protein, 283 aa, Ehrlichia chaffeensis
MNYKKIFVRSALISLMSILPYQSFADPVTSNDTGINDSKEGFYISVKYNPSISHFRKFSAEETPINGTTALTKKVFGLKKDGDIAQHGNFDRTDPALEFQNNLISGFSGSIGYAMDGPRIELEAAYQKFDAKNPDNNDTNSGDYYKYFGLSREDAIADKKYVVLKNEGITFMSLMVNTCYDITAEGVPFIPYACAGIGADLINVFKDLNLKFSYQGKIGISYPITPEVSAFIGGYYHGVIGNNFNKIPVITPVVLEGAPQTTSALVTIDTGYFGGEVGIRFTF

SEQ ID NO: 21075 - protein, 442 aa, Ehrlichia chaffeensis
MNCFRNLRLLFYLIYVGDLCANPLKLTSPLSHSLSREYQDTSSISSNPAAVNVRTGSGILQQYIEKKLGIQDSHGISTQFAWIGDTNELFGGGIPNAKDNTSNSVGLLDLTIQMEHFNGWKGGLFSAQFLQQNAQNTNGPAGVIQGYNSLPDVPPYNRSELYALWYRQALFDDTFFIRLGKTITTLDFNNVIKPVQLSKDEPNIPAVTSLIYTPIFINPSVDGLMPGYTNTAYGITATYTPIKSWYASYGIYDGNLARGKQTGLSGPTFNGNYFQVGETGSVWLLGKDKKPGTIGIGLWHQTGLIKQGNLIQRDSSGTYLFGSQRLWYRHPGQDISGISGFYQYGINNSRVLPMKQSIGAGLTAFGLIANRKADSIGSGFSLAWLNQRVTNRKTELMFQIYYQAKLFNFIYLEPVLSYIPTPGQSSHLNPASAGTLRAIVLL

SEQ ID NO: 21076 - protein, 651 aa, Pseudomonas resinovorans
MLGDKQDLDIPFSITSYTSKYIADQQATSVADALRSEPSVRSVFSKGGIGEYFNIRGLYTQSHELAWNGLFGLLPHNRVPTEFLERVDVFKGTSALLNGMSIGGAVGGVINVVPKRATSEDITRLTTTYKSDSTFGAHIDVGRRFGQEDQFGVRVNALKSLGDKALDGQEENRYLGSAAFDYKGEKFRASLDLYDINEKLDGGQPLMVSFATSVVPKAPDSKLNHQPGSYSHTKTRGAIAHVEYDFAPEWTAFASAGTKRQNGVGVIANNALGNAAQPNGDYMAVSRMNANNTNVDAGELGVRGKFNTGAIKHNVVISANSLDQDTHMGLVMGTPWASNIYRPTRPALIASPPTYTPKTLDTTLTSFAFADTLSILDDKYQLTLGVRHQNVKSQSYSILTGLPSSPYYDESAVTPMVGFVVKPWDNTLSLYANYIEGLSQGGTIIDPSNPLVAEKTFKPYKSKQYEIGTKWDMGKFKNTLSIYQITKNDLAQDANRNYSESEQRNRGIEWTTAGEIVKDIRLLGGVSYLEAEWKKTAGGLMDGNDVKGIPHWQSNLGLEWDVQPVEGLTLTANTTYTGSLYANDTNTQKIPDWFVLDLGGRYATNIAKHNVVFRGGVDNVFDKKHWAGGWNGYVGVGGDPRSYKLSMQIDF

SEQ ID NO: 21077 - protein, 193 aa, Wolbachia endosymbiont
YNHDLDFIKILSGLGIGVGFNTLNRFVVEQPIEGKYKTLQTSAQLGVTKDIILGQDFIFNPLMYFTHSFFYQEDFKENKSPFAKNYESLKHHSINANLGFNLAKNIEQDDYQASFSTFVILKKEFMENFRNKASLLIFLLLLFKYKLKDNILSQGFNSEFLYKNNVFWQFMLMNRFSHNAYELHLMSSVGKRF

SEQ ID NO: 21078 - protein, 907 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLFDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGGVPGGAVPGGAVPGGFGPGGFGPVLDGWYGVDVSGSSVELAQSIVEAPELGAAIRVGRGARVTVSGGSLFAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVRTNGIAHRTELRGTRAELGLGMAAALGRGHSLYASYEYSKGPKLAMPWTFHAGYRYSW

SEQ ID NO: 21079 - protein, 1457 aa, Neisseria meningitidis
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 21080 - protein, 1082 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPPNLHTGDFPNPNDAYKNLINLKPAIEAGYTGRGVEVGIVDTGESVGSISFPELYGRKEHGYNENYKNYTAYMRKEAPEDGGGKDIEASFDDEAVIETEAKPTDIRHVKEIGHIDLVSHIIGGRSVDGRPAGGIAPDATLHIMNTNDETKNEMMVAAIRNAWVKLGERGVRIVNNSFGTTSRAGTADLFQIANSEEQYRQALLDYSGGDKTDEGIRLMQQSDYGNLSYHIRNKNMLFIFSTGNDAQAQPNTYALLPFYEKDAQKGIITVAGVDRSGEKFKREMYGEPGTEPLEYGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDQSGANETVHIKGSLQLDGKGTLYTRLGKLLKVDGTAIIGGKLYMSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 21081 - protein, 196 aa, Wolbachia endosymbiont
GPISDEETSYYVRLQYNGEFLPLFTKVDGITYKKDKSDYSPLKPSFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYSTVGAEAGVT

SEQ ID NO: 21082 - protein, 282 aa, Haemophilus influenzae
AVVRPYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGRKNAKIKTGYKREHINLGCDVDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 21083 - protein, 349 aa, Haemophilus influenzae
AVVYNNEGTNVELGGRLSIIAEQSNSTIKGQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPTNGNTVGYTFKGIDGLVLGANYLLAQERYKYTAAAVPGAGAGAVAVAGEVYPQKISNGVQVGAKYDANNIIAGIAYGRTNYREDITGSDLGKKQQVNGALSTLGYRFSDLGLLVSLDSGYAKTKNYKAKHEKSYFVSPGFQYELMEDTNFYGNFKYERNSVDQGKKEREQAVLFGIDHKLHKQVLTYIEGAYARTRTNDKSKAEKTEKEKSVGVGLRVYF

SEQ ID NO: 21084 - protein, 198 aa, Wolbachia endosymbiont
GPISDEETSYYIRLQYNGEILPLFTKIEGIEYKKGTDIHNPLKASFIAGGGAFGYKMDDIRVDVEGVYSYLNKNDVADAKFTPDTVADSLTAISGLVNVYYDVAIEDMPITPYVGIGVGAARISTPLNTAVDGQTYKFGFAGQVKAGVSYDVTPEVKLYAGARYFGSYGANFDKSSGDKGKGGHTVLYSTVGAEAGVA

SEQ ID NO: 21085 - protein, 198 aa, Wolbachia endosymbiont
GPISDEETSYYIRLQYNGEILPLFTKIEGIEYKKGTDIHNPLKASFIAGGGAFGYKMDDIRVDVEGVYSYLNKNDVADAKFTPDTVADSLTAISGLVNVYYDVAIEDMPITPYVGIGVGAARIGTPLNTAVDGQTYKFGFAGQVKAGVSYDVTPEVKLYAGARYFGSYGANFDKSSGDKGKGGHTVLYSTVGAEAGVA

SEQ ID NO: 21086 - protein, 196 aa, Wolbachia endosymbiont
GPISDEETSYYARLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYSTVGAEAGVA

SEQ ID NO: 21087 - protein, 849 aa, Pseudomonas aeruginosa
MPALRSPHSHTNSLAVPLHPVTLAVKGALVAALGTATLGLYAPATYAAEPIARPAQQTYQISAGLLGPALMEFAAQAGINLSMDPDLLKNLRTPGLSGPQTIDSGFARLLESSGLHVRRLGAGNYALEAAPAAKAATASSTPRSDASASADQSGAPELAAVTVTARTQNNLVAPARKISLLEGEEVQQLRQGSDSLATMLSKVVPGMADSSHTITDYGQTLRGRNMLILVDGVPLNTNRDSSRNLANINPADIEQIEVLRGSSAIYGSGAAGGIVSVRTKRPSGETKAETVVTGSSPLFRPKAAGLGAEVQHYLSGGGDVVDYSVSLGAKQAGGSFDAKGNRIAPEPSQGDLFDSNIYNASAKIGFKLDANQRLQFSASHYNASQDTDYASDPSVARLPAGTAAARPIKGLVLADQNQIKNTMLGLDYENRDLAGSTLAAQLYYRDFYTRFAPFDARAVAVRGANVDQSMQNSDVFGGRLTIKTPLGQEKNSLLIWGADFNHERTDMPIDIFDPKAYDASKGLVFNKIGRLIYMPPVTTRSIGAFAQLQHKFSDKWSVEGGARYDRAQASFSDFSPLSQSKLPSPQTVAGGTVKYGSWTYNLGTVFTPAKGHELYASYSQGFELPDIGVVVRNATAGFNIGNSNLQAVKTDTVEIGWRGKFSNVIANLGAFQSQSDLGAVQSFNNGLTLLRTKEKIHGLEASLDYFNDDDRWITGASFTWMKGRELPHGASSYQSMTGYRIPPLKLTAYVEYRPSASWSHRVQATSYASRDYRLDGKTSFGRYDTKGYTTVDLISQWKIDPKNRVSLGVENLFDRNYFPLYSQLLRSNNNTSRLPAAGTVVRISYAHTW

SEQ ID NO: 21088 - protein, 432 aa, Pseudomonas aeruginosa
MPTAFPPPDTCPATPPCRSLRLPSLAASTVLLAFGPSSLAQAANVAETLSGPSATPSTLSYDAQDKDSLLAVDIQEGWTQWKSDLEARTGLTLGFDYNALGFRASSSPGDRTAGSGVFRAFGKWALVGRDGPNTGNLVFKLEQRHAYGDLAVTDFGTELGYVGLVNSVFNDQGWRATNLYWQQNLADGQAVVSVGWLDVTDYVDVFALASPWTGFSNLAFQTGSGTIGGLPDGALGAVAAGFLTDRVYAAVGIVDANGDATDLLGGFDTLFDEGETFKSLELGWTSGPKALFIDNAHVTLWQIDERTKAGSDDGYGIAFSYTRGIENTWLPFVRGGWADAGGSLYEAALSVGVGYTQNPGRQLTGLGVNWSRPNDDTFGVDLDDQWTVEAFSRWQLTEGIEITPSVQIIQNPALNPDKDTIALFGLRLRAAF

SEQ ID NO: 21089 - protein, 686 aa, Sulfurospirillum barnesii
MKLAIRTLLLTGCIIYCGAAVAVQADEQKAQATAMLDEIVVTATKTEETRKDVPNAVIVIDQAAIEASTADTVGELLANEPGVDFRTRGDYGGAAQSLNIRGMSDTEVQVMVNGVSANSPSLGSADIGTIPLSSIERIEIVKGSGSMLHGSGAMAGAVNIITKRPKRDRMDAKASAGYGTDNTYQLAAEHGQYIGDFGYYLTAGQQETDGRRDNGDMEQQDASLALVLDRDDLLNVTLNGSVVDREFGVPGVKPPAGTGTHYVGGVAFYNADSASLVDNGSDTTYQASLEIKSRPTDWLAVNLKPFYSDLENYHSTRYNDTSWGHLAGEGYKTWVYNTVKGIDGHVALDPVDGLTLLLGGDYKDYEWETEQSFLDVSGAFNPAIPVATNDAKLFTKSCFGEVQYRPSQYVKLLAGVREENHSTFGRETLPRYGLVFNPTGSTAVKFSHGKHFKAPTPNDLFWPEDDFTRGNPTLKPQTGWHTDVTIEQGLCQNALLVTASAFTWDIDDKIDWAPNPAFPGPYGDKWTPTNVNSSRGHGWEAGLRIQPEEHWAADISYTYTSATDTLQFVERTAQYLANHRAKIGGSYRFGFGLTTALTCRYVGTRDFYRSSYDSLPTDRLDSYITVDLKAEQRLAGHWILTLRADNLIDEEYDTYVGTFTDSAGAMQYGRFPGGGSSYFASVGYEY

SEQ ID NO: 21090 - protein, 282 aa, Anaplasma centrale
MNYRELFTGGLSAATVCACSLLVSGAVVASPMTHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 21091 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYGKSIATIDVSVPANFSKSGYNFAFSKNLITSFDGAVGYSLGGARVELEARYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 21092 - protein, 1401 aa, Haemophilus influenzae
MKKTVFRLNFLTACISLGIVSQAWAGHTYFGIDYQYYRDFAENKGKFTVGAKNIEVYNKNGNLVGTSMTKAPMIDFSVVSRNGVAALVGDQYIVSVAHNGGYNSVDFGAEGPNPDQHRFTYQIVKRNNYKPDKDNPYHGDYHMPRLHKFVTDAEPAKMTDNMNGNNYADLSKYPDRVRIGTGEQWWRTDEEQKQGSKSSWLADAYQWRIAGNTHSQSGAGKGTVNLSGDITKPNNYGPLPTGVSFGDSGSPMFIYDAIKQKWLINGVLQTGNPFSGAGNGFQLIRKNWFYDNVFAEDLPITFLEPRSNGHYSFTSNNNGTGTVTQTNEKVSMPRFKVRTVQLFNEALKAEDKEPVYAAGGVNAYKPRLNNGKSIYFGDRGTGTLTIENNINQGAGGLYFEGNFTVSSENNATWQGAGVHVGEESTVTWKVNGVENDRLSKIGKGTLHVKAKGENKGSISVGDGKVILEQQADDQNKKQAFSEIGLVSGRGTVQLNDDKQFDTDKFYFGFRGGRLDLNGHSLTFKRIQNTDEGAMIVNHNTTQVANVTITGNESITPPNKKNINKLNYSKEIAYNGWFGETDENKHNGRLNLIYKPTTEDRTLLLSGGTNLKGDITQEGGTLVFSGRPTPHAYNHLDRPKDLGRPKGEVVIDDDWINRTFQAENFQIKGGSAVVSRNVSSIEGNWTVSNNANATFGVVPNQQNTICTRSDWTGLTTCKTENLTDTKVINSIPTTQINGSINLTDNATANVKGLAKLNGNVTLTNHSQFTLSNNATQTGNIKLSNHANATVDNANLNGNVHLTDSAQFYLKNSHFSHQIQGDKDTTVTLENATWTMPSDTTLQNLTLNNSTVTLNSAYSASSNNTPRRRRRSLETETTPTSAEHRFNTLTVNGTLKGKGTFQFTSSLFGYKSDKLKLSNDAEGDYTLSVRDTGKEPETLEQLTLIEGLDNQRLSDKLKFTLENDHVDAGALRYRLVKNNGEFRLHNPIKEQELHNDLVKAEQAERTLEAKQAELTAETQTGKAKVRLRRAAFSDTSPDQSLLNSLEAKQVELTAETQKSKAKTKKARSKRALFFDTPPDLSQLKVLEVKLEAINAQQQAEKERQAQEEEAKRQHKQKELISRYSNSALSELSATVNSMLSVQDELDRLFVDQAQSAVWTNISQDKRRYDSDAFRAYQQKTNLRQIGVQKALANGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEEVKVQTPSLVFNRYNAGIRVDYTFTPTNNISVKPYFFVNYVDVSNANVQTTVNSTMLQQSFGRYWQKEVGLKAEILHFQLSAFISKSQGSQLGKQQNVGVKLGYRW

SEQ ID NO: 21093 - protein, 1395 aa, Haemophilus influenzae
MKKTVFRLNFLTACISLGIVSQAWAGHTYFGIDYQYYRDFAENKGKFAVGAKDIEVYNKKGELVGKSMTKAPMIDFASVARSGYAALVGDQYIVSVAHNGGYTNADFGAEGQNPDQHRFTYQIVKRNNYKPDQKHHYNGDYHMPRLHKFVTESSPFDMTGSMKGQTYADKEKYPMRVRIGSGDQYWRNEQDKGTQVAEAYGYLIAGNTHMQTGAGNGDVSLSGDVRKGNDYGPMPTAGSFGDSGSPMFIYDATEKKWLINGVLRTGNPSLGRENTFQLVRKNYFDEIFSANLKTTIFDFRTPKNQQNQHYTFHSKNDGSGTITSGAGKIYKVKLANYNLSMKGTEPVYTNGGVNNYSPALSHGENLYFIDYGKGVLTFSNNIDQGAGGLYFEGDFIVSPTHNETWKGAGISISDESTVIWKVNGVENDRLSKIGKGTLHVKAKGENKGSISVGDGKVILEQQADDQNKKQAFSEIGLVSGRGTVQLNDDKQFDTDKFYFGFRGGRLDLNGHSLTFKRIQNTDEGAMIVNHNTTQVANVTITGNESIVLPNGNNINKLNYSKYIAFNGWFGETDKNKHNGRLNLIYKPTTEDRTLLLSGGTNLKGDITQEGGTLVFSGRPTPHAYNHLRKDLSKLEGIPQGEIVWDHDWINRTFKAENFQIKGGSAVVSRNVSSIEGNWTVSNNANATFGVVPNQQNTICTRSDWTGLTTCQKVDLTDTKVINSIPTTQINGSINLTDNATANVKGLAKLNGNVTLTNHSQFTLSNNATQIGNIRLSDNSTATVDNANLNGNVHLTDSAQFSLKNSHFSHQIQGDKGTTVMLENATWTMPSDTTLQNLTLNNSTITLNSAYSATTNNTPRRRRRSLETETTPTSAEHRFNTLTVNGKLSGQGTFQFTSSLFGYKSDKLKLSKDAEGTYKLAVRNTGKEPVTLEQLTLIESLDNQPLSDKLKFTLENDHVDAGALRYKLVKNDGEFRLHNPIKEQELHNDLVRAEQAERTLEAKQVEPTAKTQTGEPKVRSRRAARAAFPDTLPDQSLLNALEAKQAELTAETQKSKAKTKKVRSKRAVFSDPPLDSLFALEAALEVIDAPQKSEKDRLAQEEAEKQRKQKDLISRYSNSALSELSATVNSMLSVQDELDRLFVDQAQSAVWTNISQDKRRYDSDAFRAYQQKTNLRQIGVQKALANGRIGAVFSHSRSDNTFDEQVKNHATLTMMSGFAQYQWGDLQFGVNVGTGISASKMAEEQSRKIHRKAINYGVNASYSFHLGQLGIQPYFGVNRYFIERKNYQSEEVKVQTPSLAFNRYNAGVRVDYTFTPTENISVKPYFFVNYVDVSNANVQTTVNRAVLQQPFGRYWQKEVGLKAEILHFQLSAFISKSQGSQLGKQRNMGVKLGYRW

SEQ ID NO: 21094 - protein, 199 aa, Wolbachia endosymbiont
GPISDEETSYYVRLQYNGEILPFYTKVDGIKNSTSKEEDSPLKRSFIAGGVAFGYKMDDIRVDVEGLYSRLAKNKAVIDASESHVADSLTAFSGLVNVYYDIVIEDMPITPYVGVGVGAAYISNPSNAAEVKDQRRFGFAYQAKAGVSYDVAPEIKLFAGARYFGSYGASFDKAAKGDDGIKNVLYNTFGAEAGVAFNF

SEQ ID NO: 21095 - protein, 200 aa, Wolbachia endosymbiont
GPISDEETSYYVRLHYTADEVVPFKTKIDGIEYKKGTDVQDPLKASFLAGGGAFGYKMDDIRVDVEGLYSQLNKNDVSGAAFTPADVADSVTAFSGLVNVYYDIAIEDMPITPYIGVGVGASYLSNPSKADAVKDQKVFGFAYQAKAGVSYDVTPEIKLFAGARYFGSYGANFGKEAKDDGGIKVLYSTVGAEAGVAFNF

SEQ ID NO: 21096 - protein, 201 aa, Wolbachia endosymbiont
GPISDEETSYYVRLQYNGEILPLFTKVEGITYKKDSSDYSPLKASFIAGGGAFGYKMDDIRVDVEGVYSYLNKNDVTGATFTPDTIANSLTAISGLVNVYYDIAIEDMPITPYVGVGVGAAYVSTPLKEAINGQKNKFGFAYQAKAGVNYDVTPEIKLYAGARYFGSCGANFDSDASKKDKGGHAVFYSTVGAEVGVAFNF

SEQ ID NO: 21097 - protein, 196 aa, Wolbachia endosymbiont
GPISDEETSYYVRLQYNGEILPLFTKVDGATGAKKKTADTDTTTDLYKASFMAVGGAFGYKMDDIRVDVEGLYSQLSKDTLDVAPTPAIADSLTAFSGLVNVYYDIAIEDMPITPYVGVGVGAAYISTPLATSAVSSQNDKFAFAGQARAGVSYDITPEIKLYAGARYFGSFGAHFDKDTAAASKDKGELKVLYST

SEQ ID NO: 21098 - protein, 197 aa, Wolbachia endosymbiont
GPISDEETSYYVRLQYNGEVLPFKTKIDGVTYKSGKENNSPLKASFLAGGGAFGYKMDDIRVDVEGLYSQLSKDADVVSDDKAADSVTAFSGLVNVYYDIAIEDMPITPYVGVGVGAAYISNPSKADVVKDQKGFGFAYQAKAGVSYDVTPEIKLFAGARYFGSYGASFDKATKDDNVIKNVLYSTVGAEAGVAFNF

SEQ ID NO: 21099 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVAEVTGDKKSGFGFAYQAKAGVSYDVTPEIKLYAGARYFGSYGANFGKTAKDDGGIKVLYSTVGAEAGVAFNF

SEQ ID NO: 21100 - protein, 165 aa, Wolbachia endosymbiont
GPISDEETSYYVRLQYNGEILPFYTKVDGIQNTPAREKDSPLTRSFIAGSGAFGYKMDDIRVDVEGLYSRLAKDTAVIGASEKDLADSLTAFSGLVNVYYDIAIEDMPVTPYVGIGVGAAYISNLSNIADVKDQKRFGFAYQAKAGVSYDVTPEIKLFAGARYFG

SEQ ID NO: 21101 - protein, 199 aa, Wolbachia endosymbiont
GPISDEETSYYVRLQYNGEILPFYTKVDGITNAKDKEKDSPLTRSFIAGGGAFGYKMDDIRVDVEGLYSQLAKDKAVVDTSETNVADSLTAFSGLVNVYYDIAIEDMPITPYVGVGVGAAYISNPSKADAVKDQKGFGSAYQAKVGASYDVTPEIKLFAGARYFGSYGASFDKAAKDDTGIKNVVYSTVGAEAGVAFNF

SEQ ID NO: 21102 - protein, 197 aa, Wolbachia endosymbiont
GPISDEETSYYVRLQYNGEVLPFKTKIDGVTYKSGKENNSPLKASFLAGGGAFGYKMDDIRVDVEGLYSQLSKDADVVSDDKAADSVTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVLYSTVGAEAGVAFNF

SEQ ID NO: 21103 - protein, 199 aa, Wolbachia endosymbiont
GPISDEETSYYVRLQYNGEFLPLFTKVDGITYKKDKSDYSPLKPSFIAGGGAFGYKMDNIRVDVEGLYSQLNKNDVKDVTFDPANTIADSLTAFSGLVNVYYDIAIEDMPITPYVGVGVGAAYISTPLKDAVNDQKSKFGFAGQVKAGVRYDVTPEVKLYAGARYFGSYGANFDKSVGEKDKGGHTVLYSTVGAEAGVA

SEQ ID NO: 21104 - protein, 197 aa, Wolbachia endosymbiont
GPISDEETSYYVRLQYNGEVLPFKTKIDGVTYKSGKEDNSPLKASFLAGGGAFGYKMDDIRVDVEGLYSQLSKDADIVSDDKAADSVTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVLYSTVGAEAGVAFNF

SEQ ID NO: 21105 - protein, 147 aa, Wolbachia endosymbiont
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAG

SEQ ID NO: 21106 - protein, 120 aa, Wolbachia endosymbiont
GPISDEETSYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAA

SEQ ID NO: 21107 - protein, 636 aa, Pseudomonas sp. B11-1
MIKQTLFVPLAGCLLAMACAQANAAPNPYSNFVVFGDSLSDAGTFTDSGGPAGATQRYTNRTGPVYLDGSGELRSLNSTQLLGGRLGFTPDQTASSSSAVRAGQGQPDGNNWAVGGYRTDQILDSITSQSATGERTRAGYLPSNGFRADPNALYYLTGGGNDFLQGRVTSLPQANAAADRLVDSVRTLQGAGARYIMVWLLPDIGLTPAINGSPLQAFTSQLSTQFNTELVSQLQSVNANVIPLNVPVLLKEAFANPAQFGLATDQNLVGTCFSGSGCTENARYGINSATPDPTKLIYNDAVHPTEAGQRLIADYAYSLLAAPWEATLLPQMAQGTLRSHQDELRNQWLADWENWQAVGQWRAIVAGGGQHQDFDSQRSGASADGNGYNLNIGGSYRLNDAWRVGVAAGFYNQKLEAGDNDSDYKLNTYLGTAFAQYQQNRWWGDAAVTAGHLDYDSLKRKFQLGVNERGEKGDTDGYVLAFSGRVGYDIAPEASSPWHLSPFVSADFAKVEVDGYSENGADSTALTFDDQSRISRRLGLGIQGKYQITSQTQVFGELAHEREYNDDTQNVTMNLNSLPNNRYTLAGYTPQTNLNRLNLGVSHNLTKDLALRASYDIRKDDDFTQQGINVGVALDF

SEQ ID NO: 21108 - protein, 145 aa, Bartonella henselae
TSQNDMTYRLSLGLPWEKQWWKSDLGYVTGYWDAGYTYWEGGSGNDNYAGAHSLSFSPVFTYEFSGFSSVTPFLELGVGVAFFSKTRVGEQQLGSSFNFEDRIGAGIKFAGGQKVGIRAIHYSNAGIKQPNDGIESFSAYYSHAF

SEQ ID NO: 21109 - protein, 737 aa, Vibrio vulnificus
MYNRSNTRKFLLSNAALAAMLYATSAGAQTSPEAGGAFVEEVIVTAAKRSENLQSVPISVSAITGDSLAKSRIDSVDALVSRIPNLQLSSTVGANTPIFAVRGVSMSDYSLSQASPVATYYDEVYKGNFALLGVAMYDLERVEVLRGPQGTLYGKNTTGGAVNLISRDAKLGETSGYVSAGYGNYNRVDLNGAVNLPLGEDAALRLAGTYSRADGWFESVTPGIRDLNEVREYGVRATLNYEPADGVHLKLVGSTSLQNPQNYGIYATPEATNRPGLDTWEVASNIPDRRRARTWSLALHADVDVSDTLTLTSITSWDKGTLHFVEDTDGKATSELEITYGDRASQFAQDLRLTSDTGGPFNFILGAYFNREKVFNNNVQKMMNELDVNGDGVIDYNDCIDSGFVAACQLTNQFYQTKKSYALYTDVKYELDENLTLRGGLRYTRDEGEQADYQSDAYGADGVLITNLIPPTNLEYSAKNLSGKIGVDYKLSSNKMVYATISTGYRAPSFNAQAFFDPSEITVAKAEKVTSYEVGAKTQFADRRVTLNMAAFYYDYRNQQFLNIDAATARQQLLNIPKSRIYGGEAELSAYVNESFSLRAGLGLLSTEIREGTVSGVDVSGNKLSNAPEVSANLGLDLTIFENENGKLSLHPEVAYQSSQYFEVINIPRLRQDGYALLSGHISYETTDGRWNASAWIKNAANEKYFTSRIDLLNNWGFDYNQLGTPRTYGISIGAKF

SEQ ID NO: 21110 - protein, 160 aa, Chlorobium tepidum
SDYSPLKASFLAGSGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 21111 - protein, 253 aa, Chlorobium tepidum
MIRKSILLFITTTCTLPAQANYLGGFANISINYLDWTTHTTHKTGQTSHKDDFAYLELEGGAHFSWGEFYGFFDLENPFNNRQTQPGDNQRYTVKGTSRIYLADSGLNLYGHVYGTWSLPGKEYGGNFHEVNTLYGIGYNTQLADIWFKPFIALHYVDQTYYSGNNGYVVGWVAGYDFNLVNQKFSITNWHEMEFDRNKRYGNGGKNGFNGAVAIWWHPTASITTGIQYRYAYKKLGENFLQDGVIYSLKYNF

SEQ ID NO: 21112 - protein, 944 aa, Chlorobium tepidum
MIFPARVLRTHTFGLLLLGLQPLCSEVVLAAGERHYSIGAGPLDQVLSRFGAEAGISMAGSALLTAGKTSQGLQGDFNTEAGLNQLLAGTGLGYVRQADGGYALRLRLDAVSLPTQKVKGENPDEEEVYRAPRSSVYISADDMQRFGVVSVGDMLKGQPGVQVGDSRNGGGLDVNIRGIQGQSRVAVTVDGSQQALDVYRGYAGTQQRSYIDPDMISDIAIDKGPSLTSSAIGGTVKMRTLGVGDILKDGQNIGLRLKGDVWNNGVAPASRDPHSKTQDLYSEPHQSRGGLFGSEAEAGSAAFAYSHEFFDVVAAYAHRNQGNYFAGKKGQDRYRTYDRYGDEETSVATTYNAGEEVLNSSSKTESWLLKTTLRPADGHTFDLGYRRYDGRIGEIMPSDIFRFGTGGIYQYPLGHTQIDTYTARYNYLPAGNPLVDLSADLWMTDAQTSQLTAVSAPASQAYRSDRNWSRQADRRVGGGLANTSRFETGYGDLKLDLGSSFQLEELRPQKSVATTQDDINANRMLREGSRQEFSFNGKLEYKPVDSLTLWGGGRYTHYRSKDHVPTATARREERDLRYLRVSNGDNSGNMMWFPDQNGQYTDATDPRLNNGIVFQNTNFPFEGVRYNDFGATDSTVYPSQVGEVVTGYNYSGKNSNSGGAFAPAFGINIEVLPDTFVYASYTQGFRMPSLFETSQGVQQTMPGKGLKPERSSNWEIGASTLQKGLLVDDDSAAFKLAYFNNTIKNYITRYYDPSPGLWGLMRFSNTDSYKTSGLELQTRYDAGRVFADLSSTYYLKTETCDAAFAATLRATSNPYQKTADTPDCTPGSFMGSYTNTQNPPRFAGNLTTGLRFFDQSLTLGTRITYTSGPTVTADKPWQTGATTPQLNYREVALFDLFLNYKLKEDASLNVSLQNLTDRYYLDPLAQSFMPAPGRTLRVGMQAKF

SEQ ID NO: 21113 - protein, 257 aa, Chlorobium tepidum
MKKQNYIIKSFVFDIFKNGEEMMMDFVCEPGTVSRRVNRLRRLLFSVGFILLAIVLLAETSGTALAQGALTADEGWANRFLVRGRIAGVFPEDSAQYNVPARTHVSNQFIPEIDLSYFFTENIAAETICCITKHDVSLSGGPTLGEAWLIPLSVMAQYHFRPRGSIKPYIGAGPALVLVVANNERGPATSFNLETYNPGFVLQAGVDIKLRNNWYLNADIKKFFVDIDAKVTTAGGTVSGKASIDPIVAGIGIGYRF

SEQ ID NO: 21114 - protein, 191 aa, Chlorobium tepidum
MKKAVLLLAAVSAFAQANQTDVEKKDVSGFYLGGGIGVTTVYDDSVWPYAVNLDSNDSTYKLFGGYQFNRIVAIEAQYTRYGDIFDKFEDAPRTMVKPENIALMANLGYTFDSGWRPFATVGLGRTELDFGSSSKAETSFRAGVGGEYSPKAIENLNFRIAYEVDTFVIDETYDDLTIMLGSLYAGVSYKF

SEQ ID NO: 21115 - protein, 911 aa, Chlorobium tepidum
MICKITYIFLFIICSNVSLLWGQTFVFRGTVLDEQTHKALDYATVQLFVDKQIVYGGITDANGHFELLHIHPGTYRVIVSYLGYDSTEKEVKVIGDISAIFYLKPSVMALNEVVVTASESKRATSASIVDRTAMKHLQPSSFSDLMELVPGGKSADPQMGQANLIRIRETGKTEDISSLGVGFYIDGISQNTDANLQYMPNSTSAVNATSTMSKGMDMRTISTDNIEKVEIIRGIPSVAYGNVANGAVIIQRKMNESPLSARFKADKTSKLFSVGKGIRLDGNGRYVLNADLNYLESKIDPRNSVKNYTRLTASARLDGKWLWNERNIHWNISSDYTGSFDDAKRDKDATVKEDSYKSDFNSLKIAGKWSMKFPAHLWIREVGVTTSVSQQWEKMREIKSVSLNRPAAIATQTETGEFDGIYLPYNYVAQMDIDGKPLYVTASARTRLAFPLGVLQNAMNMGMEWNYQKNLGEGQVFDVTRPISESLSTRPRRFKDIPGLQPFAFYAEEVLNLPVNRHKLAFTAGIRLQSLLGLDTKYKMQGKIYPDLRLDLQWSLPVSNGWDVAFSGGLGWISRMPTTAQLYPDFKYVDLIQLNYYHTNPDYRRINMMTYKWDNTNYQLEPARNMKWEVRADVSYKGNRLSITYFRERMNNAFDDITYYRSLAYKLYDPASIDGSALTAPPELSQLTYTNEYNLDVYSTQGNVMKVCKEGVEFQFASKRIESLKTRVTMYGAWIKTIYNSDSPQYKASSILLDNKQLKYVGLYNGDNGTESQAFNTNFMFDTYIQRLGLTFSTSAQCTWYTNRRNLWNNGVPVSYIDQSGETHPFREEDKNNIQLQHLVEKYSATYFERTTVPFYMDINLKASKRIGKYLNLAFYVNRLLGIYPDYTLRGVLQRRTSESPYFGMEMNLTF

SEQ ID NO: 21116 - protein, 733 aa, Chlorobium tepidum
MKKTSLIALLALLSATAKAEEEPTLLALNVWTGPEITVSGKKGDLLNKIAGKESEVLNPSQMSVYKIINMMPSVSQQSVDPYGLADTVNYHEAFRFRGVEATAGGVPATTANVEGLPVTGRPGGGATIYDLENMENVAVYSGVMPANVGLGIADVGGKIDMEIKRPESEFGVAFKQSIGSHNFSRTYLRVDTGDLGSGLKAFVSGSTSYAEKWKGYGASNRNNLMFGLTEQFSDKVKLEAFATWSKGNIHPYRALSYAQIQDLDSAYDTDYSNDPTAYDYYGYNKNEFEDWMVMANLEIKTGEKSKLNVKPYYWSDKGYYMETITLPNGSPNIRRWDIDHDLKGILAEYTTTVGNVDLDFGYLYHTQKRPGPPNSWKNYTLSGNTLVFSKWAILSNDSSHELHEPFIEAKYRVGDWTLEGGVKYVNYALPSILTYTTTAGDVSYDEAMESATLVPFKSAESTKTFSRLFPDARLTRMIGNNTSLHLAYGESYVTHVDIYPYYISQAALNTVIPFEELWDKRAMEISRNVELGMKITGNTWSISPTIYYSKHSNKQAVLYDTDLDATYPMNSADATGYGFELEGEYKPSSKLKCYGSFSWNRFSFDQAIYSDATGSLIDVKGMQVPDAPEFMAKGLVSYTVGDVTISPVVRYMSSRYGDVQHTQKIDGTTLFDLDLTWSRPIAGLRNVDCSLSFINLFDTKYVSMISASDYKTLKTSYQPGAPFTVVASVAIHY

SEQ ID NO: 21117 - protein, 719 aa, Chlorobium tepidum
MFWARPVFTHPDGSLFAMTSRLAARALSCALAAIPLAVSTLARADATSGAQAAATVDLDETTVTARSQRGFAAGTAEVGSFRGQSLRDIPATVNVITREALDAQQDRTLYDALRNTAGVTRQQLSGETFDNIAIRGVTMENRTNFRFNGSMPFFNLMAIPLEDKERVEVLKGVSALYYGYTTPGGIVNLVTKRAGNTPVTSVGVSIDNNGTAITSVDVARRFGEDNQYGLRFNAAGGKLESPTSGIDGDRQMASVAFDWKVNSRLSLKADVEYARQVVTEQSVVTLPAAKNGVISLPAMPDPSKRLSPDWAKFRANSTTAMLRADYALNDDWLVTVEGGTSELARTRAFTEIGSVNAVTGKGTISGNRQDGRWTTGHLRADLNGTQMTGSIKHELTFGVARSEMRQAAVYSSRFTGTQNLYNPVDLGWLPTTGTSVTAAQRAVDTGVYALDRVTLTQHWQVIAGLRYTSYTSVQAPNRYDASKTTPLGALIYKFTPTLSAYASYAQGLEAGDRAPNTAANANVAMPPAVSNQKEVGVRYETPLGTQLSAALYEIDRAASYTNASNVYVQDGRQRIRGVELNAQGRVTNDLSLLASGGWIDARFRGVGNGLDGKTPENTPRATASLFAEYTLPMLRSVSLNAGAYYVGTRPVNDADQAWLGGTTLFGAGARYVTRLAGKRTTWQFNVDNLTDKRYWAAAGNNRLAMGAPRVFKLSMKIDL

SEQ ID NO: 21118 - protein, 758 aa, Chlorobium tepidum
MKKYAISSFLLLLPALILAQTNLKGMIMDAQNPKNNLGVSGATVNWLGTNIGAITNKKGWFTIPYNIQNKKLIVSYIGYKTDTISISNTTPVHHFITLAGELSEITIRSKRKAIQKSLFATANTFTVNNDELLKAACCNLAESFETNPSIDVSFSDALTGTRQIQMLGLKSPYLQIMQENIPSIRGAAQAFGLTFTPGTWVESIQITKGAGSVVNGFESISGQINAELVKPFSDAKFFLNAYSSLNGRFELNTHLNKRVSKKWQTGLYIHGNYRGEKFDKNKDGFLDAPLANQINVMNRWQYTDAQNGWVSFITARFLNDEKQTGELNFNSETDKVYPNSIRNSDDVWGSEIDTKRFETSAKLGYVFPELPYQSLGLQLAYSMHVQDSYFGLNVYDAQHESLYSNFLFNSIINDTRNKFKTGISFTYDKYDELVNETNYKRKESSLGAFFEYAFDNLDDFSLTAGLRIDTHNLLGTFITPRVHLRYAPWEKGVFRASAGRGKRSANIFAENQQLFASSRGTQGNINIDDTDGNIYGLNPEVAWNFGVSYLQRFNLFDNKGDIVFDFYRTDFSNQVVVDWENPQEISFYNLDGKSIADSFQLEVNYELIDNLSLRTAFKYFDISTDYKSGKLQKPLQPNKRFFANLSYETKLNDKNAQWKIDLTFNNIGRQRLPNTASNPIAYQLATHSKSYSLLNSQITKVFSNTFEIYFGGENITNVQQENPILASEAPFGPNFDTTIVYAPIFGRAIYAGLRFKIK

SEQ ID NO: 21119 - protein, 418 aa, Chlorobium tepidum
MTTNRIASLLAALSLLAPAAAHATNGMRMIGFSPVQDAMGGVGVGATLDAASLLTNPAGMADLGRRLELGGSYFKPSVSYSASGSGPMPQMFVANDGASLDSDRGASPIPLLAYVQPVTDRLTTGIGVFGVAGMGVDYGMNLYNGPTLTSYMQGRFTPAAAYRVSDRLSLGVTANLMVAQMEYDVASGAGQAAHDTATSFGAGATFGVKYSPVKRVSFGAAYETRSWFQDFSFTVPERPNPMTGGTNPAGTDELAFDQPQSATLGVAVTPVDALLLAVDVQWIDWSSTMGDGLPQYSSDPMATGAMPFDMGWSDQWVVKVGTQVMATPKLALRAGYNYGKMPLDPDRAFENMAFPAVSEHHVTAGAGYVFSDRLSANVAGVYALNASIEGANPAEQGISSYSTEMSQLAVDVALCYRF

SEQ ID NO: 21120 - protein, 817 aa, Chlorobium tepidum
MSGSSFVPLMLKPLHRRRGSFHHALMSCSAVALLLGPLHAGAATAAEQTQMQARQVQLDLPAQPLDQALTTFADQAGLHLLYTTGDVAGQVSPALQGNYSVEQALQQLLAGSGMSWQFSEARTVTLRKAEAAPQAVNLKPIEVSVASRTSTAISEIPGTVWVVDQQQLREQIDSGVSLKEAIGKLVPGLDLAPEGRTNYGQNMRGRNVLVMIDGVSQNSSRGLSRQFDSISPFNVERVEVLSGASAIYGGGATGGIINIVTKKGEPGPARFETQLGASSGFNNSDDLATRFAQSVSGGNERVNARLGISGEQNEAFYDGAGDQIFIDNTQTDLQYNRTIDVLGTLGLQLNDQQSLDLLAQYYDSGNHGSTGIYFPNLNYNAPSDLEDAELRSGYSSDLEPRTRRLLLNANYHHTDVLGQDFYLQASYRKEDDNFYPFPYYNRATPTGSRGVYFAASQQNFEVTSLKGLFAKQWDTLKLTYGVDLDRERFNAEQTTFNAQTSSESGGLELEKDSKADRYPSYRVDGVSVYAQLDWHATDNLTLSGGARRQQMDVDVSDFKGVPGGSNDYQVNLFNVGAIYDFKNGHQVWSNYGEGFDLPDPAKYYGKPGLSVADNPLAGIKSRQVELGWRYADLDWDAQAALYYIWSDKIINVDSQTLTIDVEEQKSRDFGFEGALTRHFQTGWEAGGTLHMTRSEEEAEDGGWIKRDARYASLSKATAFVGWKGDGRSARLQANHAFSLKDDADHEIDGYTTFDLLGSQDTGFGTFSAGIQNLLDKQYSTVWGQRATLFYSPTYGPAYLYDYQGRGRTYTLSWSMAY

SEQ ID NO: 21121 - protein, 720 aa, Chlorobium tepidum
MANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDVGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPNEFNGKPVVNKGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 21122 - protein, 712 aa, Sphingobium chlorophenolicum
MRFEILKVGVLACISASYAASVHAESPTEANVDAEERPLEETLVRGQYLQSSQINALRSPTPILDVPQSLSIITSDVIMERGYAAVSEIVEYMPGVSVSQGEGHRDAIVFRGVRSTADFFIDGVRDDVQYFRPLYNLEQLEVLRGPNALLFGRGGTGGILNRVTKKPELGQQFTQLTGYADTFGGGGVQVDTNWATGDNSGFRLNAMLEGLENHRDFFDGDRMAINPTFKMRLSDNTMLDLSYEYVDHEQFIDRGIPTGTDGRPVEAFQKITFGDEDVNVTTLKAHILMASVDHDFSESTKGKATFFHGDYDKSYQNFYASGYNEASAPNEVTLDGYVDTTQRQNTVLSGNLVNESIIGGMQHRFLAGAEFVHTKSDQDRWNTLWSATADDKETFFINRPLQVLGGVGVNSSGMPTTNDFYVDLNDDTRVSIDVYSAFIQDEISITEKFDIVLGARFDHFAIDVFNVPNNDESSRTDEEVSPRVGVVFKPAVNMSLYASYSESFLPRSGEQFANINGSKGQLDPNTFENMELGFKWDLASDLSLTAAAFQIQQTSPQVADNDPSTLDVIETETDGVEIQIEGRLADFWNISAAYTYLDGEQVGRSGPSGRRPRELPENMFSLWNSFQFSQKLSGGLGLTYQDESFINNSNSAVLPSYTRIDAALYYQLSNTLRMQVNIENLTDTDYFPSSHSTHQATVGAPLNARFAITKDF

SEQ ID NO: 21123 - protein, 192 aa, Wolbachia endosymbiont
SYYVRLQYNGEILPLFTKVDGVTGLKKKTTDTTDTTDLYTASFMAGGGAFGYKMDDIRVDVEGVYSKLNKDTTVTGASVPAEGIANNLTAISGLVNVYYDIAIEDMPVTPYIGVGVGVAYVSNPLAKKVTDDKASGFGVAYQAKAGVSYDVTPEIKLYAGARYFGSYGANFGKAAKDDAGIKVLYSTVGART

SEQ ID NO: 21124 - protein, 162 aa, Wolbachia endosymbiont
SYYVRLQYNGEILPLFTKVDGITYKKGNSDYSPLKASFIAGGGAFGYKMDDIRVDAEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSSGA

SEQ ID NO: 21125 - protein, 142 aa, Rhizobium loti
MARARGRGRRDLKSEINIVPLLDVLLVLLLIFMATAPIITQSVEVDLPDATESQAVSSNDNPPVIVEVSGIGQYTVVVEKDRLERLPPEQVVAEVSSRFKANPKTVFLIGGAKDVPYDEIIKALNLLHSAGVKSVGLMTQPI

SEQ ID NO: 21126 - protein, 1173 aa, Rhizobium loti
MKLYAFNLGMPLLWLPPKLLLIMKISCILIFITLTQISAKTIAQKITLEKHNAHLEEILLDIKTQSGYTFLLKNLDTELPRITVSLKNSDIKNALNQVLKNTSIQFKIVEKNILLTKKNLTILDNIENKITGLISKIDVKGRVIDTLGSPLIGAIVGVKGTNKYTRTNDNGEFSLNGVNENDILTITYIGYKTQEFKATSRVSIVMIADISLLNEIQIVTTGYQTLPRERATGSFTTLDEKTLSRNVGTNILDRLDGIASGLVFNKGLAGTNNSKLSIHGRSTLFSNPEPLVVLDGFPYDGTIDQINPADIETITLLKDAAASSIWGVRSGNGVIVITTKKGTRNKKLSIGVVSTYTSADKPDLYYLPQMSSSQFINLEQTLFNNGFYNAQITEPYLPISDAIEIFNKTRLGLLSPSDSSLQIDRLKSNDFRADLSKYAYRRKSQQQYALNFSGGSIYHKFYLSGGYDKTLESKQSDSYDRITLNASNTFNFFNERLEISSDINFISSKTGTSSDNYTAFSPYDKLADEYNNHLAVTSFSTLRKSYVDTVSNGKLLDWHYRPLDELNANSTNSLNQYRIKAGFNIKIVRGLSLIANYQFLNEVTNGNRTSDLNSFYTRDLINKFSAVSNNTVTRIIPFGDYLSILKGQRSSKIIRAQLNYTKQLATEHEINLLGGYEGSDTRNQIGSQPYYGYNRETLSDANGTIDPTRFYKLYYGSGSASISTTSSSVMNVDINQSFFANGSYGFRNRYILSGSIRRDESNLFGVETNQKGIPLWSGGIAWNINKEGFYKVNWLPNLKLRMTYGLNGNFDRSTSAYLATRSVARLNSWGSRYAIITNPSNPDLRWEKIKTWNIGIDFASKNDRVTGSFDIYRKNSKDLIGNSPIAYQSGVSQYRGNSANLLTKGFDLVLNSINLEGDVQWLTSFLLNYNLDKVTKYEVKQSSNALLVPQNFNNPLEGYPYHAIFSFPYAGLNGDGKPQGYLNGVITSEISKILNVFDTGLIKYHGTASPKFFGSFINTFLYKQFELSINMTYKLGYYFRRTNVFNGSNYGSAANPNFQISGFDERWKKGGDELTTRVPALSYPANIQQGEFYLNSSDLIEKGDHIRLQDIRFSYDVGKRALSTLSIKRASLFFYARNIGIAWRANRLNIDPDYGSTVLPLPLSCSFGVNLSL

SEQ ID NO: 21127 - protein, 704 aa, Pseudomonas stutzeri
MQKVGSRTRGRGILAIALPAFVASSLGASEEGVIEKLEPIKVTTATKQERWVEETPMASLIITQEEIEKLGASTLREALENSAGVYVSPDGRGMVMRGLSQDNALFLLDGRRIKGEFSNTYELERIPAGIIERIEIIKGPSSVLYGSDALGGVVNIITKRPQEGLGGRIEVSGGTNSHGKGSKSLFDLQLYGGDERTSFRAYANALDRNPYAEQEVANVLVRQAGIDRKPSATTGGVFAPIRNNVKDSYGAEVDYRDDAEVFTAGGAIRQRLAENASLRIEANYMKEDRHSRYIAANYPSNYYNGANKIMVFNTPAEWRDDNERFDVAAILDWEVARELDLRYTADYTKYKKYRNIYSLIYADLGYASSAASANSTNITTMEQWSHELMATWNPSPEHTLTTGAEYRTNDVESTAYNVNDRNYKSAYAQHEWRLTPDLNLVYGARYDRTSIGENQTSFQGGLIYSLSDKTKLRFNYAQGFKAPDDRVLYVNQINPQGRAMLGSEVLTLDKTTASTLKAESSDTFEAGITTRGERWKYDLGIFKTKVDNKIEQVQEVGAVSGIAYNTFRNVSEAEIKGVENSLGIMLHEDWWIEGAFSYIDAMNKAEDIKLMNVPKTLTNLSIEWTPLEAWSFRLMSRTIGEQYISEEEKVGSFTLVGLKASYSPSFVKGGEIFGGIDNLLDRKVPTILGGDPGLFFYLGARYNF

SEQ ID NO: 21128 - protein, 493 aa, Myxococcus xanthus
MAALSTALGWAIASAGPPEPLEIDDEASVVAPVEIDDDATVVVPESETAVEIVEITAPPAPTQDEAEPAPEPTPEVPEPPPEPPAPPPEPDTPHAQRWQAFIEHVHPAGFVQVDFLWRQISLDELSDGNREPLNETAFLLRNARLGVDADWRYVGLTAYADLFSNNQGVRPATLDAHAQIPGKRGDPPLVQLRVGMLRVPFGFENYNQSDIQRFFGERTLVVHAFMPGLFDVGASLSGHVWALDWIVGVYNGQPVGAPGWGFRDPNRAKDYAGRLRLAGELFPKLHAAFGVSLLTGTGFSAGTGPTKDSFVWVDLNEDGRVTLAELLPVPGSAGRPSENFRRWGAGADLQLETPIPRLGALTLYSEVAIGSNLDRAVAIADPVALGRDQRGIGWYLGLTQELTRYAALGVRFDEYLPNLDALEPFAGTNVITRRRFRTLAAGLAGRLYGGSFLRARLLVEYEHQLSNSLGRDAAGRPAKLDNDTLRVRAEVAF

SEQ ID NO: 21129 - protein, 176 aa, Sphingobium chlorophenolicum
  misc_feature (8)..(8): Xaa can be any naturally occurring amino acid
  misc_feature (11)..(11): Xaa can be any naturally occurring amino acid
  misc_feature (166)..(166): Xaa can be any naturally occurring amino acid
NLLLFTKXDGXTYKKDKTDYSPLKPSFIAGGGAFGYKMDDIRVDVEGVYSYLNKNDVKDVVFTPEDTIANSLTAISGLVNVYYDIVIEDMPITPYIGVGVGAAYISTPLATAVSSQNGKFAFAGQARAGVSYDITPEIKLYAGARYFGSYGANFDKTNNDGKGELXVLYSTVGAEA

SEQ ID NO: 21130 - protein, 662 aa, Sphingobium chlorophenolicum
MKRAADIRGEGGEGGKWRWRRAATHVSRLAAVACVTFKVGAVIAADATTGSLSSVDFSRMTLEDLANIEISSVLKRPERLSDAAAAVYVITSEDIRRSGYTSIPEILRLAPNLQVAREDSSNYAITARGFNSRSANKLEVLIDGRSVYTPLNSGVFWDVQDTLIEDIERIEVISGPGGTLWGSNAVNGVINIITRSSRDTQGTLLSGGGGTRERGAGARYGGKLGEDTTYRLYAKGFDRDGTQTNSGTDLQNSWNMQQAGFRIDSARATDTFTLQGDAYDGSIHQRTLADKTISGANLLGRWNRALADDANIQVQAYYDRTQRNYPGSAGFGEVLDTYDIDVQHRFRWRKDHDIVWGGGYRRERDHVDNSLFLQFLPRQKTLSRANIFVQDSIALSERLKFTLGLKLEHNNYTGLEWQPNARLAWKLNDRSLLWSAVSRAVRTPSRVDREFFVPAVPALAFPGFIGGDFTSEKLTAYEIGYRAQPTADTSFSVSTFYNVYDDLRSLEPSAGAGSPLVIANQMEGNTYGVEMWGNYRVNDWWRLSAGYNYLKKDLSLKSGSSDTTSLAGSETDPRHQFSLRSAMNLAHNVELDVSLRSIGTLSSTQVPRYTALDARLGWKVAKDVEVSLTAFNLLDKGHPEFGSGSARSEIGRSFYAKMLWKF

SEQ ID NO: 21131 - protein, 1172 aa, Xanthomonas oryzae
MSATAGTNALILGGTVNDSFDTSTIGSQYLGFSAYRKTGNGTWALTGSTSAVTPWTIDAGTLSISAAGSLGAAGSSLTFNGGTLQFSNTFDLASGNAIVLAAGGGSIDTNTFDTSISQPVSGTGNLMVYGLGQLTLAGANTYSGTTTIGNATTLNLGPGGAIADSSGVVDNGAFDISATSHGASVAGLTGTGTVYLGNQTLTLTSASGIFSGNISGRGGLVLTGGTETLAGTSTYAGNTSITAGTLALAGASSIASSSSLIDNGRFDISGASGNETIAALTGSGAGAVTLGANNLIISNGSGTFAGTIAGAGGLQLAGGTTTLAGTSTYAGNTTITAGTLALAGASSIASSSSLIDDGTFDISGASGNETIAALTGSGAGTVALGANNLIISNGSGTFAGTIAGTGGLQLAGGTTTLAGTSTYAGNTSITAGTLALAGASSIASSSSLIDDGRFDISGASGNETIAALTGSGAGAVTLGANNLIIGNGSGTFAGTIAGAGGLQLAGGTTTLAGTSTYAGNTTITAGTLALAGASSIASSSSLIDNGTFDIAGASGNETIAALTGSGAGTVALGANNLIISNGSGTFAGTIAGTGGLQLAGGTTTLAGTSTYAGNTSITGGTLLVSNDSALGAAGGNLLLSSGGTLGAMSPFGTARLIDVANTGGSLAGPAGTSLDPTTANALTLTGTLNLAGTLTTRGTVIDNATSQTNTGTGSAPVVSVANGLFEVGDSIHGSTVLHAMVTVDASAILRGHGTIAGDVANNGGIVAPGGTIGVMTVTGNYAQNPASTLSIEITPNDQAPGISYSQLAVTGSVQLAGGLAVNADSGIYRPGSRYDIVHSGGGVSGQFSTVAYNSALASYLLPQVQYTADNVYLSLNVGPLAFSSGSGVAGNAYIINQDILDTTDAVLASRKGFWLHGLGSFGQANDGNITDGGAIIGYGARIRPGFLLGVAVAGTASSSNTAYQQISNRQISLSDYGIYRHGPWRIALTLGLGHLGVNSRRSLVPSGLVATGTGHGWFLGSGVNASYTDHIDRGFIRPFVAARYLHVSQEGFAEHGAGLLDLAYGRQGNDLGAIGAGARAGYQIRTFGLDLEPWIEVGGTSYLGNRLLASTETLGTETMPVSAQAAPSATLDTGLGLTLRTQHGWKGRLVYISRRGDNTSLNAFNFTATCNW

SEQ ID NO: 21132 - protein, 703 aa, Helicobacter pylori
MNTNFKERKLTYLSACLVFLFTSQTSSAFEQPPLLNQANTAIERVAVIGSRHVYSSNFTPLETPQAEQTIDLATLENAGAWDLNQALDLSASVARQNNFGGLLNNFALRGFTGDENLSSSYLVNGFNIGWGLGGTRDLSSIASVEVLKGPRAALFGRGEPGGVVNLITKRPTFDTAGELKLAVASEDTYRADIDYTTGVSDDVAIRLIGFYEDSNSFRDTIKKTKKGVSPSVAWYINDNSELIYELEYSKQTIPFDRGVLAINGELGVIPANRFLGEPGDGPITAQVIGHQLELKHDINDDWSVLIAANYRDTKLTGFATETGFAGVVNDEVNRFRRYRDYSANYKVLRGEVTGDINFAGFEHRLTIGADTDKFENDQFLLQVKGDQYINVYNPEYGAYALPAPTTHTDRIEIQQSLGVFIQDQISLTNKLDIRLGARLDDFKQTLNNRLTNTGYKQTESRISPQLGAVYAVSDFISAYAAYGENFRPLSGTDAQGNGFKPNQTTSKEVGVKVSLNNGALVGTLALFKVEQQNMLVVDDPTAFTSAAIGEAQSKGLEIDINGQLTNNLNLWASYAYVDATTKNSFYDSNFGLNIAAGSSLLNIPQHQLSLQLVKSTEVNGKALKLGGGLLYVGDRNGFFGTDFTLPSYITARAFMRYAVSDSITLTGELDNLFNETYYISSFSDAWVQPGTPRSVRFSASFKF

SEQ ID NO: 21133 - protein, 334 aa, Bartonella quintana
MNMKFIAIAVAAATVSIPVSAATVYQDDNTVFNIGGRAEVRGNISDANKTATNDSSYKDKSRVRLTVDGKQTYNSDITFVGKYEFELTEKTDGGSDDVEMNTRHLYAGAETSFGDVFYGHQVNAVTYITDWTDVAETFSGYTNEYNVATADRAKNMLRYATTTSYGLTFQVDGNFNSDSQSDGYGTIVAYELPIGLELGAGYAASDQTYGNQFDTDSSDTYLLAAKYANDGIWLSAMYQGGDISFDGTSDSDFSAVDLYAGYSFGDNTVNMTYNYYSADDIGALDIDFIGIEYARYMGSVALFGSYKFNLLDEGEGGEGDNDEDELQLGLRYGF

SEQ ID NO: 21134 - protein, 489 aa, Bartonella quintana
MAKKPRSAQDRGFFAIGEARTAHKHFGKKIDREGIMRKFGSFCIMLMLIIFTPSLHAGNVDTQGIGAKATALGGAFSAYGDDPFAVYYNPATLTQIRSAMISLGAHVVKPEMKVSRYAVNGMNAGSSAIGPDWFGDRSHTLIVPHLGFSLPVSDSVTAGVGLYAPCGMDIRWPTTSDNPGVYNSYHSWYRREVISPAAAWQLHDQVSVGLGIALGRSFTGVENWTYFPALPGLHNRFVDTDMEDEGNWSINAGLLIKPLKALSLGLTYRGRAETKFRGTTQVKGVNEGDDLTGTGASVYNTCVSSTTKIDSPEQIQGGIRYQPVESLSLEVDLVWTRWSSIKGYTLSFDRKFLDAPALGLYNPGRTEQYYARNWEDTTQLRCGVEWKVNDILALRGSWFYDPSPIPDSTFDMQWPDGDKRTYALGIGLNWGTVNLDGVVQYTCTARKREIEGESRNLNESYLGGQGAPKVSLSGDGHLWGAGMTISYRY

SEQ ID NO: 21135 - protein, 544 aa, Bartonella quintana
MNTKRLITASIFSLISASTALAADVLIPHQPASSTSSTIVAPTFSWTGLYLGVQAGGFSSKADLALVGQEKSFPLDKEFSPKLSGFAGGFYAGSNIDLGDSFIFGIDTDLMLSGKKHTKTITIGAADNITVENAVGRSRRSASPSTPQKAALESSAPVLPRQATSTKPATTVSTGNPASGAETSPAANGGTTVTKSTETRSNQTQARQVNSSQSPNASTGQPNQLARTDNSGNVNSSITVKKSGVSTPSPSSTPSSNTTSKLPETSSASSEQGARSEQSSSSTKTVKETPASSASSTRSETSQLAASTDTSGRSLTERTVPSRNLVLSRSKVSGSETNTSNGTSGAHGGYHSAHGGGYAYSHGTSQSGGHGSGARGHNANPHSRSHGAQSTQAADKNESSVYGIEQMRRMASELGLEQGDEVETLDHTFKQNWGGATRVRIGFAADRFMPYLAGGIAYGQFQDTISISVKDEEGTVVSSKNLTDETKTMIGYTLGGGVDFSVLDNVIVRAEYRYSDFGKKKFSKEKLEVNYKTNDFRVGVAYKF

SEQ ID NO: 21136 - protein, 1023 aa, Bartonella quintana
MNMKTLTETSTFRVLSLLLCLCFFIPAMNVSASSLQADKFKVSGIVKDATGEPVIGASVVEKGTTNGTVTDLDGNFNLTVASNSTIVISFIGYSDQEYRISKDNTVLNVNLKEDTEMIDEVVVVGYGVQKKENLTGSVAAVNFKDVASMPVANTANMLQGRLPGVMLTNNGAQAGHDSPEIRIRGVGTFEHNDPMVLIDGVESSVSQIAEIPADDIESVSVLKDAASASIYGVRAANGVILVTTKRGGEQKPTITYSGSIALQEATVLPDYVNSYEWAKMYNECWPSKAYTDEMLQKLQNGSDPDHFANTDWAKEMFRTAAMHQHHLSVNGGSKAVHYMISTQYFQQDGILRETANQRFNFRSNLDAQLGIVKLGLNLSGSRQNIDEPTTSVTGEGLMRYLTWFTRPTVPVRYSNGHYGFLDGNPNISQSVFKNPIEALNMGYKDNKHYRFDGKFFGEIDIIKGLKFRSSLAYKYYMNDVTTFNPKNNIRYDAEGNALTTVGTNKLTDYHYLETTYINENILTYDFSVGKHSFNLLAGHSIQATRWDKNEASKQGFATDNIYEMDGGTMNDHVTGSAEESSLQSFFGRLNYNYGGRYLLEMNVRHDGSSRMPKAHRYATFPSFSGAWIMTNEKFMENVKFLHSLKLRGSWGKLGNQEIGNYAYAATLAASGSYYFGDSKQIGMKTAKIPNENIKWETTTITDFGFDAAFWGGKINVTFDWYEKNTSDILMKLAMPGIFLGSLDAPYQNAGKVRNRGWELAANYFDQKGDWAWQAGFSLSGVKNEITDMKGVEDIKDNTINREGEAIGSYYGLKAIGIYRTQADLDRVNANGQKILQNNQEPQLGDIMYEDIDNNGNINDADRTIIGNPFPKMQYSFNLGFSYKDFDVNTFWQGIAGVYRYNWDETTISNGGNKTSRWLDRWSESNPNGSMPRLGGTINNNYSSFWLTKGDYLRLKNLEIGYTFRQREFLTKLGVQSIRLYLAGTNLLTFTSLDDYDPEKLSTDSRNDVHPNTRTYSFGVNVKF

SEQ ID NO: 21137 - protein, 200 aa, Wolbachia endosymbiont
GPISDEETSYYVRLQYNGEILPLFTKVDGITYKKGNSDYSPLKASFIAGGGAFGYKMDDIRVDVEGVYSYLNRNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEAGVAFNF

SEQ ID NO: 21138 - protein, 200 aa, Wolbachia endosymbiont
  misc_feature (183)..(183): Xaa can be any naturally occurring amino acid
GPISDEETSYYVRLQYNGEILPLFTKVDNMKIKKGTDDVDPFKASFLGVGAAFGYKMDDIRVDIEGLYSQLNKNVNNDEVLTPDTVAGSLKAISGLVNVYYDIAIEDMPITPYVGVGVGAAYISTPLATAMSSQNGKFAFAGQARAGVSYDVTPEVKLYAGARYFGSYGANFDKTDKDGKGEXKVLYSTVGAEAGVAFNF

SEQ ID NO: 21139 - protein, 200 aa, Wolbachia endosymbiont
GPISDEETSYYVRLQYNGEILPLFTKVEGITYKKDSSDYSPLKASFIAGGGAFGYKMDDIRVDVEGVYSYLNKNDVTGATFTPDTIANSLTAISGLVNVYYDIAIEDMPITPYVGVGVGAAYISTPLATAMSSQNGKFAFAGQARAGVSYDVTPEVKLYAGARYFGSYGANFDKTDKDGKGEHKVLYSTVGAEAGVAFNF

SEQ ID NO: 21140 - protein, 201 aa, Wolbachia endosymbiont
GPISDEETSYYVRLQYNGEILPLFTKVDNMKIKKGTDDVDPFKASFLGVGAAFGYKMDDIRVDIEGLYSQLNKNVNNDEVLTPDTVAGSLKAISGLVNVYYDIAIEDMPITPYVGVGVGAAYVSTPLKEAINGQKNKFGFAYQAKAGVNYDVTPEIKLYAGARYFGSCGANFDSDASKKDKGGHAVFYSTVGAEVGVAFNF

SEQ ID NO: 21141 - protein, 206 aa, Wolbachia endosymbiont
GPISDEETSYYVRLQYNGEILPLFTKVDGATGAKKRTADTDTTTDLYKASFMAGGGAFGYKMNDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTVGAEAGVAFNF

SEQ ID NO: 21142 - protein, 645 aa, Escherichia fergusonii
MKRSFIFAPGMLALSISAISNAHAYNNLYVFGDSLSDGGNNGRYTVDGINGTESKLYNDFIAQQLGIELVNSKKGGTNYAAGGATAVADLNNKHNTQDQVMGYLASHSNRADHNGMYVHWIGGNDVDAALRNPADAQKIITESAMAASSQVHALLNAGAGLVIVPTVPDVGMTPKIMEFVLSKGGATSKDLAKIHAVVNGYPTIDKDTRLQVIHGVFKQIGSDVSGGDAKKAEETTKQLIDGYNELSSNASKLVDNYNQLEDMALSQENGNIVRVDVNALLHEVIANPLRYGFLNTIGYACAQGVNAGSCRSKDTGFDASKPFLFADDFHPTPEAHHIVSQYTVSVLNAPYRVMLLTNANNVPVKGALASLDGRLQQLRNVDNEQGKLGVFGGYSGNHSHTLTLGSDYQIMDNILLGGMISRYQDNSSPADNFHYDGRGYVFTAYGLWRYYDKGWISGDLHYLDMKYEDITRGIVLNDWLRKENASTSGHQWGGRITAGWDIPLTSAVTTSPIIQYAWDKSYVKGYRESGNNSTAMHFGEQRYDSQVGTLGWRLDTNFGYFNPYAEVRFNHQFGDKRYQIRSAINSTQTSFVSESQKQDTHWREYTIGMNAVITKDWGAFASISRNDGDVQNHTYSFSLGVNASF

SEQ ID NO: 21143 - protein, 72 aa, Escherichia fergusonii
MKPLSSAIAAALILFSAQGVAEQTTQPVVTSCANVVVVPPSQEHPPFDLNHMGTGSDKSDALGVPYYNQHAM

SEQ ID NO: 21144 - protein, 200 aa, Photorhabdus luminescens
MMYGTLFYKKVEGFIANAVFNEVYDGQVWQITRPVNGDAGKIRGAELGYTQFFDFLPGWLSGFGLQTNYTYVDSEAPSPTATDTNGQSLTVPLEGLSKNSYNAILSYETARFQGRVAYNWRSDWLVTTAGNGTGNLPVYNKGFGQLDASLRFNINDVWSISLDGVNLLDTRRESYLGTESRYRDFVINDRRYGLTLRASL

SEQ ID NO: 21145 - protein, 228 aa, Fusobacterium nucleatum
MEAMALRLKTTMVLATIALALPLAAMPAHAQDNASETAFPDSRIPESAPPVAIWSGPYAGTFVGYNVSRFDNLRGASISGDGVAGGAYAGFNLQDGSLVYGVEGDVGGAGFDATRRNALGNLDLSGESNVFGSLRGRVGVDVDPFLVYGTGGLAIAETELSLGGVSDSEASVGYTIGAGVEAQVTDSIRTRLEYRYSDFGSSDYDLGRTSVSSGFDEHSVRAGVSLNF

SEQ ID NO: 21146 - protein, 186 aa, Wolbachia endosymbiont
SYYVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEA

SEQ ID NO: 21147 - protein, 187 aa, Wolbachia endosymbiont
  misc_feature (74)..(74): Xaa can be any naturally occurring amino acid
SYYVRLQYNGEFLPLFTKVDGITYTKDKSDYSPLKPSFIAGGGAFGYKMDDIRVDVEGVYSYLNKNDVTDAEFXPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 21148 - protein, 182 aa, Wolbachia endosymbiont
SYYVHLQYNGEILPLFTKIDGITNATGKEKDSPLKASFIAGGGAFGYKMDDIRVDVEGLYSWLNKDADVVDDTVADNLTAISGLVNVYYDIAIEDMPITPYVGVGVGAAYVSNPLATKVTDDKASGFGVAYQAKAGVSYDVTPEVKLYAGARYFGSYGANFGKATKDDAGIKVLYSTVGAEA

SEQ ID NO: 21149 - protein, 189 aa, Wolbachia endosymbiont
  misc_feature (188)..(188): Xaa can be any naturally occurring amino acid
SYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTVGAXA

SEQ ID NO: 21150 - protein, 187 aa, Wolbachia endosymbiont
SYYVRLQYNGEVLPLFTKVDNMKIKKGTDDVDPFKASFIGGDAAFGYKMDDIRVDIEGLYSQLNKNVNNGEALTPDIVAGSLTAISGLVNVYYDIAIEDMSITPYVGVGVGAAYISAPLNDAVNGQKSKFGFAGQVKAGVSYDVTPEVKLYAGARYFGSYGANFDKSSGEKNKGGHTVLYSTVGAEA

SEQ ID NO: 21151 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNDEVLTPDTVAGSLTAISGLVNVYYDIAIEDMPITPYVGVGVGPAYISTPLKDAVNDQKSKFGFAGQVKAGVSYDVTPEVKLYAGARYFGSYGANFDKSGGEKDKGGHTVLYSTVGAEA

SEQ ID NO: 21152 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNNEVLTPDTVADSLTTISGLVNVYYDIAIEDMPITPYVGVGVGAAYISTPLKDAVNGQKSKFGFAGQVKAGVSYDVTPEVKLYAGARYFGSYGANFDKSGGEKDKGGHTVLYSTVGAEA

SEQ ID NO: 21153 - protein, 185 aa, Wolbachia endosymbiont
SYYVRLQYNGEILPFYTKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDDNDIKNVLYSTVGAEA

SEQ ID NO: 21154 - protein, 196 aa, Wolbachia endosymbiont
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 21155 - protein, 182 aa, Wolbachia endosymbiont
SYYVRLQYNGEILPFKTKITGITHKSGKDKDSPLKASFLAGGGAFGYKMDDIRVDVEGLYSQLSKDGDVAGDSAIAESLTAFSGLVNVYYDVAIEDMPVTPYIGVGVGAAYVSNPLAAKVTDDKASGFAFAYQAKAGVSYDVTPEIKLYAGARYFGSYGANFKIAKDDARIKVLYSTVGAEA

SEQ ID NO: 21156 - protein, 185 aa, Wolbachia endosymbiont
SYYVRLQYNGEILPFYTKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDDNDIKNVLYSTVGAET

SEQ ID NO: 21157 - protein, 183 aa, Wolbachia endosymbiont
  misc_feature (67)..(67): Xaa can be any naturally occurring amino acid
SYYVRLQYNGEILPFKTKITGITHKSGKDEDSPLKASFLAGGGAFGYKMDDIRVDVEGLYSQLSKDXDVADNPAIAESLTAFSGLVNVYYDVAIEDMPVTPYIGVGVGTAYVSNPLATKVTDDKASGFAFAYQAKAGVSYDGTPEIKLYAGARYFGSYGANFGKTAEDDAGIKVLYSTVGAEA

SEQ ID NO: 21158 - protein, 159 aa, Wolbachia endosymbiont
SYYVRLQYNGEILPLFTKIRGVQHIKNKQKDSPLKASFMAASGAFGYKMDDIRVDIEGLYSRLNKDADVVDAAVENNLKAISGLVNVYYDMAIEDMPITPYVGVGVGAAYISNPLVKEATDDKNSGFGVAYQAKAGVSYDVTPEIKFYAGARYFGSYGA

SEQ ID NO: 21159 - protein, 187 aa, Wolbachia endosymbiont
SYYVRLQYNGEVLPLFTKVDNMKIKKGTDDVDPFKASFIGGGAAFGYKMDDIRVDIEGLYSQLNKNVNNDEVLTPDTVAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 21160 - protein, 293 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGG

SEQ ID NO: 21161 - protein, 295 aa, Neisseria meningitidis
GVETSRSVFHQNGQVTEVATATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGG

SEQ ID NO: 21162 - protein, 295 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGSFDDADLSNDYDQVVVGAEYDFSKRTSALVSAGWLQEGKGENKFVSTAGG

SEQ ID NO: 21163 - protein, 296 aa, Neisseria meningitidis
GVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHERVDKNVNIEKYQIHRLVSGYDNDALYASVAVQQQDAKLALPNDNSHNSQTEVAATVAYRFGNVTPRVSYAHGFKGSVDDAKRDNTYDQVVVGAEYDFSKRTSALVSAGWLQEGKGENKFVATAGG

SEQ ID NO: 21164 - protein, 298 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQNVDDVKIEKYQIHRLVSGYDNDALYASVAVQQQDAKLVEDNSHNSQTEVAATLAYRFGNVTPRVSYAHGFKGSFDDADIGNEYDQVVVGAEYDFSKRTSALVSAGWLQESKGAYKFVSTAGGVGLRH

SEQ ID NO: 21165 - protein, 299 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVNDVKIEKYQIHRLVSGYDNDALHASVAVQQQDAKLVEDNYSHNSQTEVAATLAYRFGNVTPRVSYAHGFKGSFNDADLSNDYDQVVVGAEYDFSKRTSALVSAGWLQEGKGENKFVSTAGGVGLRH

SEQ ID NO: 21166 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHEQIDNVKIEKYQIHRLVSGYDNDALHASVAVQQQDAKLVEDNYSHNSQTEVAATLAYRFGNVTPRVSYAHGFKGSFDDADRYNTYDQVVVGAEYDFSKRTSALVSAGWLQEGEGESKFVSTAGG

SEQ ID NO: 21167 - protein, 298 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLR

SEQ ID NO: 21168 - protein, 295 aa, Neisseria meningitidis
GVETSRSVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALVSAGWLQEGKGESKFVSTAGG

SEQ ID NO: 21169 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALYASVAVQQQDAKLVEDNSHNSQTEVAATLAYRFGNVTPRVSYAHGFKGSFDDAKRDNTYDQVAVGAEYDFSKRTSALVSAGWLQEGKGENKFVSTAGG

SEQ ID NO: 21170 - protein, 299 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADSSNDYDQVVVGAEYDFSKRTSALVSAGWLQEGKGENKFVSTAGGVGLRH

SEQ ID NO: 21171 - protein, 301 aa, Neisseria meningitidis
GVETSRSVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEDLNIEKYQIHRLVSGYDNDALYASVAVQQQDAKLALPNDNSHNSQTEVAATFAYRFGNVTPRVSYAHGFKGSFDDADLSNDYDQVVVGAEYDFSKRTSALVSAGWLQEGKGENKFVSTAGGVGLRH

SEQ ID NO: 21172 - protein, 299 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLALPNDNSHNSQTEVAATLAYRFGNVTPRVSYAHGFKGLVDSADLSNDYDQVVVGAEYDFSKRTSALVSAGWLQEGKGENKFVSTAGGVGLR

SEQ ID NO: 21173 - protein, 299 aa, Neisseria meningitidis
GVETSRSVYYEDGKAAEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHEQIDNVKIEKYQIHRLVSGYDNDALHASVAVQQQDAKLVEDNYSHNSQTEVAATLAYRFGNVTPRVSYAHGFKGSFDDADRYNTYDQVVVGAEYDFSKRTSALVSAGWLQEGKGENKFVSTAGGVGLRH

SEQ ID NO: 21174 - protein, 293 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRYQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVSTAGG

SEQ ID NO: 21175 - protein, 300 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKKGGFFVQYGGAYKRHVRVDENVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEVKGENKFVSTAGGVGLRH

SEQ ID NO: 21176 - protein, 293 aa, Neisseria meningitidis
GVETSRSLNYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGG

SEQ ID NO: 21177 - protein, 300 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLALPNDNSHNSQTEVAATLAYRFGNVTPRVSYAHGFKGSFDDADLSNDYDQVVVGAEYDFSKRTSALVSAGWLQEGKGESKFVSTAGGVGLRH

SEQ ID NO: 21178 - protein, 295 aa, Neisseria meningitidis
GVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDNADIGNEYDQVVVGAEYDFSKRTSALVSAGWLQEGKGENKFVATAGG

SEQ ID NO: 21179 - protein, 295 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALVSAGWLQEGKGESKFVSTAGG

SEQ ID NO: 21180 - protein, 296 aa, Neisseria meningitidis
GVETSRSVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLALPNDNSHNSQTEVAATLAYRFGNVTPRVSYAHGFKGLVDSADLSNDYDQVVVGAEYDFSKRTSALVSAGWLQEGKGENKFVSTAGG

SEQ ID NO: 21181 - protein, 300 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 21182 - protein, 299 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVKDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 21183 - protein, 293 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVEDNSHNSQTEVAATLAYRFGNVTPRVSYAHGFKGSFDDADYTNDYDQVVVGAEYDFSKRTSALVSAGWLQEGKGESKFVSTAGG

SEQ ID NO: 21184 - protein, 296 aa, Neisseria meningitidis
GVETSRSVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEDLNIEKYQIHRLVSGYDNDALYASVAVQQQDAKLALPNDNSHNSQTEVAATVAYRFGNVTPRVSYAHGFKGSFDDADYTNDYDQVVVGAEYDFSKRTSALVSAGWLQEGKGESKFVSTAGG

SEQ ID NO: 21185 - protein, 294 aa, Neisseria meningitidis
GVETSRSVEHNGGQVVRVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 21186 - protein, 293 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQKGKGESKFVSTAGG

SEQ ID NO: 21187 - protein, 299 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 21188 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDKDKYTHKQSSRESYHAGLKYENAGFFGQYAGSFAKYADLKDNAERVAVNTANAHPVKDYQVHRVVAGYDANDLYVSVAGQYEAAKNNTGTVGKQGKKHEQTQVAATAAYRLGNVTPRVSYAHGFKAKVNGVKDANYQYDQVIVGADYDFSKRTSALVSAGWLKQGKGAGKVEQTASM

SEQ ID NO: 21189 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRVGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTNPATNGKKLEQTQVAATAAYRFGNVTPRVSYAHGFKAKVNGKKAARYQYDQVIVGADYDFSKRTSALVSVGWLKEGKGVNKTEKTASM

SEQ ID NO: 21190 - protein, 323 aa, Neisseria meningitidis
EVSRVKDAGTYKAQGGKSKTATQIADFGSKIGFKGQEDLGNGMKAIWQIEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTSPATNGKKHEQTQVAATAAYRFGNVTPRVSYAHGFKAKVNGVKKASYQYDQVIVGADYDFSKRTSALVSAGWLKQGKGAGKVEQTASM

SEQ ID NO: 21191 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGDFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVGATDANPVKDYQVHRVVAGYDANDLYVSVAGQYEAAKNNTGSVGEQGKKHEQTQVAATAAYRFGNVTPRVSYAHGFKAKVNGEKVASYQYDQVIVGADYDFSKRTSALVSAGWLKQGKGAGKVEQTASM

SEQ ID NO: 21192 - protein, 322 aa, Neisseria meningitidis
EVSRVKDADTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESRESSVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASM

SEQ ID NO: 21193 - protein, 336 aa, Neisseria meningitidis
EVSRVKATIGGEKVKSATATEIADFGSRIGFKGHEHLGNNLNAIWQLEQNASIAGTDSGWGTRESFIGLEGGFGKIRAGKLNTTVRDTNDAIDPWDYSNPALGMGVFTRGSIGERKVSVRYDSPVFAGFSASAQFAPRDNENPDDKYTHEVATGESYYGGLNYENSGFFGQYAGGYRKHTLGAVENAAGEKELVKRAKDGQVHRLTLGYDANNLLVAVSGQYGKNWETVGQYTSALSNGALDADVINAAVSGAGDLPVETVEIAGTAAYRFGNLTPRVSYAHGLKPKVDGEKVNFQYNHVVVGADYDFSKRTSALVSAGWLKAGKGDNKIQNVGGL

SEQ ID NO: 21194 - protein, 317 aa, Neisseria meningitidis
EVSRVKNQGVKTKTATQIADFGSKIGFKGQEDLGNGLKAIWQLEQKASIAGTNSGWGNRQSFIGLKGDFGTVRAGNLNTVLKDSGDNVNAWESSSNTEDVLGLGTIGRVESREISVRYDSPVFAGFSGSVQYVPRDNANDKDKYTHHDSSRESYHAGLKYENAGFFGQYAGSFAKYADSDAYAKRVAAGTGLAVKDYQVHRVVAGYDANDLYVSVAGQYEAAKANEVGSPNNGKKHEQTQVAATAAYRFGNVTPRVSYAHGFKAKVNGVKAADNKYQYDQVIVGADYDFSKRTSALVSAGWLKQGKGAEKVEKTASM

SEQ ID NO: 21195 - protein, 309 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTENVLGLGTIGRVESREISVRYDSPVFAGFSGSVQYVPRDNANDKDKYTHKQSSRESYHAGLKYENAGFFGQYAGSFAKYADLNKDAERVAAGTSGAYAVKDYQVHRVVAGYDANDLYVSVAGQYEAAKQGKKHEQTQVAATAAYRFGNVTPRVSYAHGFKAKVNGEKVARYQYDQVIVGADYDFSKRTSALVSVGWLKEGKGVNKTEKTASM

SEQ ID NO: 21196 - protein, 320 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTNPATNGKKLEQTQVAATAATAAYRFGNVTPRVSYAHGFKAKVNGKKAARYQYDQVIVGADYDFSKRTSALVSVGWLKEGKGVNKTEKTASM

SEQ ID NO: 21197 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTDAHPVKDYQVHRVVAGYDANDLYVSVAGQYEAAKNNDGTANQGKKHEQTQVAATAAYRFGNVTPRVSYAHGFKAKVNGVKNASYQYDQVIVGADYDFSKRTSALVSAGWLQEGKGKNKTEKTASM

SEQ ID NO: 21198 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRVGNLNTVLKDSGDNVNAWESGSNTEDVLGLGTIGRVESREISVRYDSPVFAGFSGSVQYVPRDNANDVDKYKHMKSSRESYHAGLKYENAGFFGQYAGSFAKYADLKDNAERVAVNTANAHPVKDYQVHRVVAGYDANDLYVSVAGQYEAAKNNTGTVGKQGKKHEQTQVAATAAYRFGNVTPRVSYAHGFKAKVNGVKDANYQYDQVIVGADYDFSKRTSALVSAGWLKQGKGAGKVEQTASM

SEQ ID NO: 21199 - protein, 321 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESSSNTEDVLGLGTIGRVESREISVRYDSPVFAGFSGSVQYVPRDNANDADKYTHKLSSRESYHAGLKYENAGFFGQYAGSFAKYADSDAYAKRVAAGTGHAVKDYQVHRVVAGYDANDLYVSVAGQYEAAKNNEVGSPNNGKKHEQTQVAATAAYRFGNVTPRVSYAHGFKAKVDGVKDANYQYDQVIVGADYDFSKRTSALVSAGWLKQGKGAGKVEQTASM

SEQ ID NO: 21200 - protein, 322 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASM

SEQ ID NO: 21201 - protein, 321 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESSSNTEDVLGLGTIGRVESREISVRYDSPVFAGFSGSVQYVPRDNANDADKYTHKLSSRESYHAGLKYENAGFFGQYAGSFAKYADSDAYAKRVAAGTGHAVKDYQVHRVVAGYDANDLYVSVAGQYEAAKNNEAGDPNIGKKHDQTQVAATAAYRFGNVTPRVSYAHGFKAKINGKKDADTQYDQVIVGADYDFSKRTSALVSAGWLKEGKGVNKTEKTASM

SEQ ID NO: 21202 - protein, 323 aa, Neisseria meningitidis
EVSRVKDADTYKAQGGKSKTATQIADFGSKIGFKGQEDFGNGVKAIWQLEQKASIAGTNSGWGNRQSFIGLKGDFGTVRAGNLNTVLKDSGDNVNAWESGSNTEDVLGLGTIGRVESREISVRYDSPVFAGFSGSVQYVPRDNANDKDKYQHTKSSRESYHAGLKYENAGFFGQYAGSFAKYADLKDNAERVAVGTTGAHPVKDYQVHRVVAGYDANDLYVSVAGQYEAAKNNTGVAADQGKKHEQTQVAATAAYRLGNVTPRVSYAHGFKAKVNGVKDASYQYDQVIVGADYDFSKRTSALVSAGWLKEGKGVNKTEKTASM

SEQ ID NO: 21203 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLNKDAERVAVNTPNAHAVKDYQVHRVVAGYDANDLYVSVAGQHEAAKNNMVGSTDIGKKHEQTQVAATAAYRFGNVTPRVSYAHGFKAKVNGKKAARYQYDQVIVGVDYDFSKRTSALVSAGWLQEGKDKNKTEKTASM

SEQ ID NO: 21204 - protein, 323 aa, Neisseria meningitidis
EVSRVKDAGTYQAQGGKSKTATQIADFGSKIGFKGQEDLGNGMKAIWQIEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDTSPATNGKKHEQTQVAATAAYRFGNVTPRVSYAHGFKAKVNGVKKASYQYDQVIVGADYDFSKRTSALVSAGWLKQGKGAGKVEQTASM

SEQ ID NO: 21205 - protein, 322 aa, Neisseria meningitidis
EVSRVKDAGTYKAQGVKTKTATQIADFGSKIGFKGQEDLGNGMKAIWQLEQKASIAGTNSGWGNRQSFIGLKGGFGTVRVGNLNTVLKDSGDNVNAWESGSNTEDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANALYVSVAGQYEAAKNNDGTANQGKKHEQTQVAATAAYRFGNVTPRVSYAHGFKAKVNGKKAARYQYDQVIVGADYDFSKRTSALVSAGWLKQGKGAGKVEQTASM

SEQ ID NO: 21206 - protein, 323 aa, Neisseria meningitidis
EVSRVKDAAKYKDQGGKSKTATQIADFGSKIGFKGQEDLGNGMKAIWQLEQKASIAGTNSGWGNRQSFIGLKGDFGTVRAGNLNTVLKDSGDNVNAWESGSNTGDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNTGTVGEQGKKHEQTQVAATAAYRFGNVTPRVSYAHGFKAKVNGVKKASYQYDQVIVGADYDFSKRTSALVSVGWLKEGKGVNKTEKTASM

SEQ ID NO: 21207 - protein, 323 aa, Neisseria meningitidis
EVSRVKDAGTYKAQGGKSKTATQIADFGSKIGFKGQEDLANGMKAIWQLEQKASIAGTNSGWGNRQSFIGLKGGFGTVRAGNLNTVLKDSGDNVNAWESGSNTEDVLGLGTIGRVETREISVRYDSPVFAGFSGSVQYVPRDNANDEDKYKHKLSSRESYHAGLKYENAGFFGQYAGSFAKYADLNKDAERVAAGTSGAYAVKDYQVHRVVAGYDANDLYVSVAGQYEAAKNNTGTVGEQGKKHEQTQVAATAAYRFGNVTPRVSYAHGFKAKVNGKKAARYQYDQVIVGADYDFSKRTSALVSAGWLKQGKGAEKVEKTASM

SEQ ID NO: 21208 - protein, 318 aa, Neisseria meningitidis
EVSRVKNQGVKTKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLKDNAERVAVGTTGAHPVKDYQVHRVVAGYDANDLYVSVAGQYEAAKNNDGTANQGKKHEQTQVAATAAYRFGNVTPRVSYAHGFKAKVNGVKNASYQYDQVIVGADYDFSKRTSALVSAGWLQEGKGKGKNKTEKTASM

SEQ ID NO: 21209 - protein, 316 aa, Neisseria meningitidis
EVSRVKNQGVKTKTATQIADFGSKIGFKGQEDLGNGMKAIWQLEQKASIAGTNSGWGNRQSFIGLKGGFGTVRVGNLNTVLKDSGDNVNAWESGSNTENVLGLGTIGRVESREISVRYDSPVFAGFSGSVQYVPRDNANDKDKYTHKQSSRESYHAGLKYENAGFFGQYAGSFAKYADLNKDAERVAAGTSGAYAVKDYQVHRVVAGYDANDLYVSVAGQYEAAKNNEGAAKQGKKHEQTQVAATAAYRFGNVTPRVSYAHGFKAKVNGEKVARYQYDQVIVGADYDFSKRTSALVSVGWLKEGKGVNKTEKTASM

SEQ ID NO: 21210 - protein, 144 aa, Wolbachia endosymbiont
GPISDEETSYYVRLQYNGEILPFYTKVDGITNATGKEKDSPLTRSFIAGGGAFGYKMDDIRVDVEGLYSQLTKDATVVSDNKAADSVTAFSGLVNVYYDIAIEDMPITPYVGVGVGAAYISNPSKADAVKEQKGFGFAYQAKAG

SEQ ID NO: 21211 - protein, 554 aa, Pseudomonas mendocina
MIKMFWKRLPISPVTLGLFSVITTTTSAMSAAGDANALPILAGTVQESAGQVTSVSQLSDVQPTDWAFGALQSLVERYGCIAGYPNATYRGNRALTRYEFAAGINACLERVNELIATATSDIVKKEDLTTLQKLQEQFAAELATLRGRVDALEPRLESLEQQQFSTTTKLNGEAIFAISGFVSGQDADNADIPRNTTFGDRVRLNFDTSFTGQDLLRVRLQALNLNYFSGEDGTETRLPEGTLAFNGEIGDEDPENNQVRVETLFYRFPLGKKTDVTFFANEGEVEDFVDTVNPYLDGDEGARGALSKFGSRNSVYYFVPSGAGVGLRHRFLDQLELSLGYLSSTASNPNTNNGFINGSYGAIAQLTFQPSDRFSIGLTYVNAYNNLGEDLATPGTGSQKANLGLVTDSRTSTNAYGLEASYQVSSRFFINAWAGYAKTRVLGVGDADIWNYAVALAFPDLGKKGNLAGIIVGMEPKVTGADGAIANVFTEVIAPQNRDSAQDRNTSLHVEGFYSYALSDNITITPGLIWLTAPNHDDRNSDAVLGVIRTTFTF

SEQ ID NO: 21212 - protein, 283 aa, Anaplasma ovis
MNYRELFTGGLSAATVCACSLLVSGAVVASPMSHEVASEGSGVMGGSFYVSAAYSPAFPSVTSFDMRESSRETSYVRGYDKSVATIDVSAPANFSKSGYTFAFSKNLLTSFDGAVGYSLGGARVELEASYRRFATLADGQYAKSGAESLAAITRDAAITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 21213 - protein, 695 aa, Actinobacillus pleuropneumoniae
MKKTFFYSTVASAVALAISPAIAQETAVLDEVSVVSSGSMYKMGEVPVHQAKSAVAISREDLDKQDVKKADEIGRYQAGFANQVFGNDTNTNWFRVRGEEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHTDGEWKDTDNKTVYIAPSLEWDISDRTRLSILTSYQKDSGTPSSNFYPQEGTLRALPDGSYYSRNVNFGDPVNNHEENKQYSIGYELSHDFGNGLRANSSYRYSHVENNHRGGYIYPSAYAADWSAVAPSANGYNVSGQTVFNQGKAISHSTDNRISWDFQNDWLKNTVVVGTDYRHNKVDAQYSLYALGYTANLRDYRATWNQTGTPVGTDTHIKSRQLGFYLQNQARIADKYLLGFGIRHDRARQNEYTSDQTVKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQTDVNLTENWNATLAYTYTKAESEAATGEKTRQSLIPTNTLAARTAYSFTDSVLNGLTVGAGVRYLGHSVTSKGSLYSHVRLPSATVVDLMARYNINQNWLAQLNVDNVGNRKYVAACDYYCYYGAERKVNATVSYKF

SEQ ID NO: 21214 - protein, 442 aa, Pseudomonas putida
MYKSSLALAVALGVLAQQAGAAGFVEDSKLSLSSRTMYFNNDNRDGGADNRESGQGFKLDYISGFTEGTVGFGVDAQALWGIHLDGGRGKHPDNSSFFPSDTDGSAVSQWARVGANAKARFSKTEVHFGSALAPNLPILVSNDGRLLPQTFEGGTIQSKEIDNLTINAGQLTHAMGRASSNRTGLSVNGGTQDSNKFRYGGLDYKLTKDLTLQYYYSNLEDYYKQHFLGLTHVFQIDQDQSFKTDLRYFDSSSDGKNGEAGYRFNNNGGYAKNTGEVDNKTWSAMFTYTLGGHSLMLGHQRVNDDGGFVWLNQGSVVDGNGRNEGAGGSSFYLFTDSMINQFAKAGENTTFGQYAYDFARLGVPGLKASVAYLKGEDGKNAVGGGTFSEWERDARVDYVIQEGTFKGLGASLRHGVYRGTGTSSLADQDQTRLIFNYTYNFL

SEQ ID NO: 21215 - protein, 322 aa, Pasteurella multocida
ATVYNQDGTKVDVNGSVRLILKKEKNERGDLVDNGSRVSFKASHDLGEGLSALAYAELRFSTKVKKTVKEGPNQVERTYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVEGKKRALEVGLNYDINDKAKVYTDLIWAKEGPKGATTRDRSIILGAGYKLHKQVETFVEGGWGREKDANGVTTKDNKVGVGLRVHF

SEQ ID NO: 21216 - protein, 930 aa, Bordetella avium
MALAPAPDDPGAELKPIQLDPYIVEAKAERSWRARESDGYARQEAVGNLDLMRTADDALPFTILEREQVFRSGAVTLDEFLRRELLDAVAGSSSGQKVSASSFSSLTADSTTLQLRGFGADETVILINGRRLPESVTSGANSQPQAANVNFIPLSLVERVEILPVSASALYSGNPVGGVVNIVLRRDVELTEVTASTTNALSGFDAPQSMASFLHAKTLLGGALRLRLSATFTDVMPPSESELGYIQAQLRAQPDTARMYRATPNVRSANGAPLSGPGSSSRTSVAPGADGTGGRGAFANRAGQASRELFDAPGGAAFSPNSVDFPYGQRQHSTSYYASAAYDVNSWLQVGVDAMLSRTEINRGLDVFPADLKMARNLPANPFGEPLIVSLNEIAPLLGDQYSRAQRELSSVVLGVLVRLPAEWSVSLDSQRARNRTRYRGLTGVDPNRWQSLVDQSLYNPLRDTQRYGPPGEFYDQALIYAGGRGRTVAVGDYGTWDSALRVTNRSLWFPTGSAAINLGGDFRLTELDPYTDEQRFGDGVYAAVPVRWRGRTLQRLSGFGELQAPLLPARWLPRAVRGLDFDLAARYTIADTTQETNLAPTGGLKIGFRGGWALRGSIATTNRLPTPFMSQKARDAGLRTSSVGAAQYVPIYDPLRGERYGIRASDAVNPNLRPESAMTRTVGVIYERGGVHRVRAATDFVDTQKSGELIYLDAQNVLNLEPLFPERVVRAPLEADDTHTAGYVTQVLRGNFNLAWRHSQNVNASFDYAWTACRGGTLDLYWRWVALRRYDRQLLPHSRTIDALHEPDSASPELLPNRMNFGGGWPNRSYGFRLDGRFFDARTLPSTEWRSQGASEIEPYYQFDASVQKELAGWWPWRSLRTSLQAQLRVNNVFGAEPPRYANDPSGAGVQSYSDWRGPTYSLSLRASF

SEQ ID NO: 21217 - protein, 157 aa, Wolbachia endosymbiont
YYIRLQYNSEFLPFKTEVDGVTGAKKKNADTNVTTDLYKASFMAGGSAFGYKMDDIRVDIEGLYSQLSRDTFETAPAPAIADNLSALSGLVNVYYDVVIEDMPVIPYVGIGVGAAYLSNPLAIKVTGDKEYGFGFAYQAKAGVSYDVTPEVKLFAGA

SEQ ID NO: 21218 - protein, 388 aa, Wolbachia endosymbiont
YYFNRDNKDGGNDQKDWTQGIWGNFSSGYTQGLIGVGVDAFGYLAIKLDGGDGTGGTGNMSRDADGEVNDSQGKAGGAVKFRVSKTELKVGDMQPSTAPVFAVGGSRILPQTASGIQLQSSEIKDLDLEAGHFYSATSQDRNARDGGLFATYAGEEANKIDYFGGKYGFTDNLSASLYGAKLEDIWNQYYANLNYTIPLGGDESLNLDGNIYNTKDTGDDKAGDISNTTYSLAAAFSFMKAHTITLGFQKVNGDTPFDYIGVGKNNRGGDSIFLANSIQYSDFNAPNEKSAQVRYDLKMAEYGVPGLSFMTRYVKGWDIDGTNTPANSAYAGLYGADGTHIAHNFEAKYVVQSGPANDLSFRIFQAWHFANVDEGEDDIKEFRLTVHY

SEQ ID NO: 21219 - protein, 205 aa, Wolbachia endosymbiont
SYYIRLQYNSEFSPLNTKVDGITGAQRDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAYKVLYSTIGAEAGVAFNF

SEQ ID NO: 21220 - protein, 180 aa, Wolbachia endosymbiont
SYYVRLQYNGEVLPFKTKIDGITHTSGQSPLKASFIAGGGAFGYKMDDIRVDVEGLYSQLAKDATVVSDNKAADSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAVGAEA

SEQ ID NO: 21221 - protein, 165 aa, Wolbachia endosymbiont
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPVIKLYAGARYFGSFGA

SEQ ID NO: 21222 - protein, 165 aa, Wolbachia endosymbiont
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGA

SEQ ID NO: 21223 - protein, 185 aa, Wolbachia endosymbiont
SYYVRLQYNGEILPLFTKIDGIKNAAGKEKDSPLKASFIAGGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFDKAAKDDAEIKKVLYSTVGAEA

SEQ ID NO: 21224 - protein, 188 aa, Wolbachia endosymbiont
SYYIRLQYNGEILPLFTKVDGITYTKDNSDYSPLKASFLAGGGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 21225 - protein, 184 aa, Wolbachia endosymbiont
SYYIRLQYNGEILPLFTKIEGIEYKKDTDIHNPLKASFIAGGGAFGYKMDDIRVDVEGVYSYLNKNDVADAKFTPDTVADSLTAISGLVNVYYDVAIEDMPITPYVGIGVGAARISTPLNTAVDGQTYKFGFAGQVKAGVSYDVTPEVKLYAGARYFGSYGANFDKSSGDKGKGGHTVLYSTVG

SEQ ID NO: 21226 - protein, 184 aa, Wolbachia endosymbiont
SYYVRLQYNGEILPLFTKIDGIKKTAGKEKDSPLKASFIAGGGAFGYKMDDIRVDIEGLYSWLNKDADVVDAAPAVAESLTAISGLVNVYYDIAIEDMPITPYVGVGVGAAYISTPLATAVSSQNGKFAFAGQARAGVSYDITPEIKLYAGARYFGSYGANFDKTDQDGKGELKVLYSTVGAEA

SEQ ID NO: 21227 - protein, 162 aa, Wolbachia endosymbiont
SYYVRLQYNGEILPLFTKVDGVTYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGA

SEQ ID NO: 21228 - protein, 204 aa, Wolbachia endosymbiont
SYYIRLQYNGEFSPLNTKVDGIIGAQKDSKDTNDLYKPSFMSGGGAFGYKMDDIRVDIEGLYSQLGKDTLSRTPTPDIVDDLTAISGLVNVYYDIAIEDMPIIPYISVGLGAAYVSNPAKTQVIADQKRGFGFAYQAKAGVSYNVTPEIKLFAGARYFGSYGASFDKSETVNKKASDDKKIEDKETKVTVGAYKVLYSTIGAEA

SEQ ID NO: 21229 - protein, 184 aa, Wolbachia endosymbiont
SYYIRLQYNGEILPLFTKIEGIEYKKGTDSHNPLKASFIAGGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFDKAAKDDAEIKVLYSTVGAEA

SEQ ID NO: 21230 - protein, 718 aa, Vibrio vulnificus
MTASEGKFPLSTMALAIIAASTALTAQAQDTSTNDKMVVVSSRTPKAISDIPGTVWYIESDKIEQEYRGGKTLGDILASAIPSLDVSSGARTNLGQNLRGRKMLVMIDGVSLQSSRSISRHLDSIDPFNVDRIEVLSGSTSIYGAGASGGVINIITKKAHSEELEFESYVGGTSGFNSGEDFDYKVAQSISGGNEKVQARTSVVYTETQGFFDANGTIVTPDISQGSLQFNQTVDFLTTVGVDVSETKKLNFLAQYYDSQQDSPYGLYIVGRDFVDVRKGFESDREHGTKRIMLSASYADAQFLGQQLIAEASYRKEDQTYTPYYQSSGQQITDVISLKAALAKSFDKLNIVYGIDAYQDKLDSNQALYDPTIANNSGNLVNKTYAQVGRYPGVEVSSVAAFAQVDYAITDEWSVEGGVRYQYMLNKIDDFVGYNQQKKIAAGSGTSADAVPGGETDYSVALFNLGTIYHLNRDSQVWANFSQGFDLADPAKYYGQGNYTLVGDHWQLNDSINVNQSKMSGIKTNSVELGYRLESGDVNLQTAAYYSQSDKNIKYNKTTLLIEEIEDKKRVYGLEAMLSYWIHDNIQLGASGHYVVSEVKVDKGWEDYDAGYASTSKANAWAGWSDANLNVKLQSQTMFDYEDASNNKLNGYTLFDLVGSYQLPVGSLGFGIQNLLDKDYTTAWGQRAQLIYSAHYESAAYDYKGRGRTYTLNYQVKF

SEQ ID NO: 21231 - protein, 705 aa, Xanthomonas campestris
MTRPARRTRGARPHTLAPLAAALLGALASLPAMAQETAPTQVLAPTVITGSRVEASSFDLPYSVDSVSLGADSAAGLRVNVSEVMNAVPGVVVQNRQNYAQDLQISVRGFGARAAFGVRGVKLIADGIPATNPDGQGQAATFNLDTAERIEVLRGPMATIYGNHAGGVIQLFSREGQGAPRVSAGVFGGDHGTVKVDIGAEGEKNGIGYVLDASHFETDGERRYSAAERNQAYAKLTFRPDEDSKLNLIFSSLRQPETEDPLGLTWATWKRDETAVENVALQYRTRKEIDHVQGGATYERRFGSDRLQVQAYAGERSVTQYQSIPRAAQTPITHAGGVIDFDREFYGVGARYIADREIGPGRLTLTAGIDYDRSEDDRQGYQNFIGTVLGVKGALRRDEIDTVTSTDPYVQAVWRQGDFDWTLGVRHSEVKFDVDDKFIVGANRDDSGSVSYHQTSPAVGVLWRLTPVLNLYASYGRGFETPTLNELSYSASGGFNFDLKPARSRQAEVGIKAYVGEHTRLNAAVFQIRTEDEIVVASSVGGRTSYTNAGTTLRRGLELAAETNFTHNLSARGALTVMRAVYDETTATVEDGKRIPGIPAVTAYGELAWKPLAGLTTAVEAIHRSKVYVDDANADHAAPAYTLVNLRLAAEQKSGPWTFSELLRLDNLFDREHIASVIVGDRNGRYYEPGPGRSLYGGVRVSYQF

SEQ ID NO: 21232 - protein, 743 aa, Xanthomonas campestris
MSALNSRTALASAVALAASFGAQANEPIALGDVVVSASGFEQKITEAPASISVIRREELQQKRYSNLAQALGDVEGIDIGQGTGKTGGLNISIRGMPSDYTLILIDGRRQNTAGNVTPNGFNETATSFMPPMSAIERIEVIRGPMSTLYGSDAMGGVVNIITRKVAKEWGASLSLDHTFQENRDYGATSSTSLYASGPLVEGLLGLAVRGSFYDRDESELQFDNDSTVSKRGASPVEGRNATFGSRLTLTPNESHDFSLDFERGRQVYNNDDCQLGNLDGKNGGSATDGCTTNAPLRANGYKDELRFQRDQFALSHTGRFSFGTLESSVTHNTTETFGRTIPGNPIGNSYTGFPSIIIGDDRELKSTDLVVDTKLVAPVGESHITTVGAQWWDAKVTDGIADEDFQQTSWALFAEDEWRLRDNLALTLGARYEDHEAFGGHISPRAYLVWNTTDAWTLKGGVSRGYKTPTLNQLHDGINGVTGQGSTITIGSPDLDPEITTNTEIGAYYDNLANFNANVTLFHNKFKDKIDDGTPLANCFYTANPNQPGCVSYGPGFTQENFAQSVNIGEAVTKGVEVAGRWQFAPAWALALNYTYTDSEQKSGINKGAPLTNTPEHMAHARLSWAANDRLTLWFKGEYRGERARFTDRYDNLTAANKALYDAVGDLKAYEVFHLGGSFKATENLTFSATIYNLFDKDFTSGSYYTTNTGSTAWASDYTQIGQSTTGTLEEGRRLWLSTVIEF

SEQ ID NO: 21233 - protein, 999 aa, Xanthomonas campestris
MREPRTLPRTRRLTSALLFALSAPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDALTPEISGIFSTTSADGRFGVSLSGSYQERDFGYSQVGVPNGWRSFRGDSTAYGTIPQPGAPGSENITNRPGPNDIYSVPQNLNYRVVGVERQRTNGQLVLQYKPLDNITTTLDYTYSENKIQQQRNEMSVWFNYGPSASAWTNGPVAGPVTYSEIVNPATSDLATAGSNAATRNQNKSLGFNVDWAVNDQFKLNFDIHRSTAEAGADSPYGSSNSLGVSGFYRGTSVVDFSKDFPVLQQQLGFGLNGLDPSRTLVTGSAFRNSYMKSEIDQAQVNGDFTFENYSQLKFGIGSTEVKNRSAFSNVQRDTWGGNGTAADYPDDLWIPSSFAQYFDAIDGSGNPPQFNQLFLFDFERARQAAAQVAGDDALYRISPVFTTDRRVTEKSKNAYLQWNNSWDDLRVPISLAAGVRYEETKVDAQALVPVAVGIDWVANNELPIRVANSAFASGSGKYEYWLPSLDLSFKLTDDLVLRASYGETIGRPGWGDIQGGQTLSEIARVEGGTGQEGNPGLKPLLSHNIDFSLEWYYSDASYASVGFFRKNIDNYIGVTTRNDTSLGLNTPIGGAYWNEALGNGCASADLTCIRNYIFRNRGGAPGVVRGADATGVISGQPGDPVANFAITAPANQRSASLDGWEFNLQHMFGDSGFGVSANYTMVDSGLTYDNYVIGEQFALEGLSDSANVVGFYDRDKWQVRAAYNWRDEFLAARFDGSGQPNPVYTEAYGQLDLSIGYQWTENLSLSLEAINLTDEVQRQHGRQSNQIVYATQTGPRYMLGVRYKFW

SEQ ID NO: 21234 - protein, 923 aa, Xanthomonas campestris
MAASHTSRMSSAFHTNFFSWRAPTWPPGSGPAPPPSENLMTFAPVHPARRPRHAVLMLAVTAALTSATVQAQQAGATFTQTTELDRVQVLGSYASSLERALKDKRYAPSVIDSIEAEDIGKLPAQNVAEALQRLPGVTIERDRGEGVYVRVRGLGPNFQVTTLNGQTMAVNENVRNSGQTGRQFRFDTLPAELVSGLEVIKSPTAALDEGAIGGVVNVKTFRPLQLGNAETHLSAELSHPQLADENDPRVSGLYNWVNADKSLGVLFAAAYAERSLRQDRVNETYWEHYADGIDGNGDGIADTGAIYAPSAIRPTLELEQRKRIGVASSIQFAPSEALEFNLDLFYARQQVDYDEFAIGTGWEPRNMRNLSIAGNAVTAFDYQNGQVQLSRETSGMTDENRSVRFSGAWQGNAWKLQGTGFVSRAHSWNDAPIRRTRLRTGTTVDQRVVFPTASGNNLPQWSFTDGYDPTDPAQTPGRRLEWRIIDAVDHERALQFDADRMLEGGVFSALKLGAKYRTRERRYDRTDLVNNSIAGRRFDASYFYPSLPVSDMLDGGNGQLPRQWLAPSEAPFWGDWPTAADLANSPTSEDLQNSYRVLEDISSAYAMLEFSTPLGGRDVRGNVGVRGVHTQQRTEGHANLDGAAQPVVFERSYNDVLPSLNVAYDLRPTMVLRGAAAKVITRPDLTDLSSKLTFNSSGEVLTASGGNPNLEPFEALQYDLTFEWYTSPSSALVAGVFYKDISRFVQTQFSNLDYQGRRYLLSSKVNGGKAKVQGVELAWQQVFTGLPAPFDGLGMQANYTWTDSEANYVDGDTTFQDALEVVAKNSYNLVGFYEKGPLSVRLSYSWRDDIVNSVGTADIATNNTRAYGTLDGNISWQITPALAVFANAINLTGEVQNMYVGDHLFSGYTDYGRTYSLGLRANF

SEQ ID NO: 21235 - protein, 449 aa, Xanthomonas campestris
MRTDTRRRRRATAAAALLAATGFALPAAAAPAEAAGDGASLEQLRASIARAEARLEKTRAELDRERAELDRQGALLDAEMRRIRGAGPGPTVAAQNPADATAPADTAPPSAEQTSAPITEPKPKERREARVLQTSPLQSVGGVLTPRGTLVIDPSLEYDYSAEDQLSLNGFTILPGITFGQLLLARVRQSVITPALTLRYGLTDRLELSAKIPFVYAYQETVTQSILQQSGGGTTVNVLAPSAHAAGLGDIQFGASYQFNSGADGMPILVGNAIFKTATGTSPFSVPVYTTNDPNGGIISGIQKKVPTGTGFYSLEPSLTVLYPTAPGILFANLLYIHNFGRTVEVQDPGGGPPIPADAKPGDAVAATFGIGFALNDQTTFTLSYQQEHVFGATFNHAAVKGSSYDFGTFNFGVGYQLSKSTTINLGVGIGAGPNAPVAKVLIDVPIRF

SEQ ID NO: 21236 - protein, 824 aa, Xanthomonas campestris
MRERIAMSTLHTLRLHALACAVTTCLCAPLALAQDATPPAPATPPAADSAAVNLDSVFVTGTSTATTKLKSSVSVSTVGAEAIEQSAPRSTAEIFHNIPGIRSESSGGEGNANIAVRGLPVASGGAKFLQLQEDGLPVMEFGDIAFGNADIFLRSDFTMDRIEAIRGGSASTFTSNAPGGIINFISKTGDTEGGSVGVSRGLDYDNTRIDFNYGAPFAEHWQFNIGGFFRQGDGVRDAGYTTDKGGQLKANLTRLFENGYVRVYGKYLNDRAAGYLPVPTSVRGRDGSPDLGGFPGFDPGNDTLYSRNFRTDVGLDGNNQPRRTDLGDGMHPISRTIGAEAWFDLGNGWNLSDKFRIADNSGRFVSPFPAEVTDAAALASSIGGAGAQLVEAGGANAGQAYTGTAIRTHLFNVAINDLGNVTNDLSLSREFGGDGRTLNLRMGYYTSRQTIDMDWTWNSYVQSLGRDSRLLNVVDAAGVSRSQNGLYAYGTPFWGDCCITRSYDVRYDVNAPYVSLTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQLTPSYRGDGYQFGVNLIGTTEAYTQDSNQLKMPGYTQVNLFGDYRITDALTVALNVNNLFNTFGLTEAEEATIPANGIIRARSIAGRTTSLSLRYDF

SEQ ID NO: 21237 - protein, 376 aa, Xanthomonas campestris
MKTTLLVALMACLGAMSEAAAVEVTVGGRLHLDYARYNADVRQLDNGMLLRRARLDMDGKLTSDWSFELAYDFANVYALTNTGTVKDGDFKEGFTDIALHYDGWKQADLNVGQTKVPFGLEELNSSNAISFIERALSTDAFAPSRRLGAEVSRNRDHYSVSVMGFGSSFDGRERGRGLAARATVTPIYAGGGNTVLHLGIAAVVERPTGEVKFTARPESRALDVRFLNTGDLVDVTHVGRLGLEAAVKSGPLSLQAEWMQTAIKRKGIGTDATLEGWYVMGSWVLTGESRQYSSGRFKGVPVQRPGGAWEVTARYSHLYLDNANVRGGEEDNLTLGVNYYASKHLRIMLNYIDVHSERRGKADSPQILLMRAQLAF

SEQ ID NO: 21238 - protein, 996 aa, Xanthomonas campestris
MSSRSLHRTRRHRLSAALLAVLVAPAGHALAQSENGVAPDTTDLDKVTVTGSRIARTGFVTPSPVTAITAEEIRATGATTISDLMARMPALAPSYTLGNSTRFIGTAGLGLLDLRGMGVDRTLVLVNGRRHVGSSPGSTAVDVNTIPVEWVERVEVITGGASAVYGADAVAGVVNFILKKSFTGFETRAQTGLADEGNYNRSFASFSAGTDFAGGRGNIAVSGEYSKQDRFGRGNRAIGREYLVTVPNPAYDPTRPPSERNPQNVLSGPGGNHSTSYGGTFNLGTFDFRNPASYGNRYLFNEDGTFRRNRYDGTVVSNTSCVDCDFADLNAVADLQPGFDRKSVNTMVNFELSENHRLFFEGKYSETDSEFFGQPAFDSSLRVRRQNPYVSPELGALMDSRGATQILMNRFNVDAGRRGENIERKTYRAVLGAEGNFTDNWTYDVSANYGKTTVDRQNLNNRINERWQAGIDAARDASGNIVCRTTLDPNAINPNTNRVYSALAREGCVPFSVFGNGAVSPEAAAWFNTTARSQAKIQQTVFSASVANSNLLSLPAGDIGIAGGVEYRKEQSEEITDPLAASGVTFLNAIPNSGGEYTVREVFVESTIPLLAGLPGVDRLALDLAGRYSDYSSIGSTKTWNIGLDWTIIPSLRLRGTLAQAVRAPSIGELYDSQSENFATINDPCNYLSSNSNRPGTAGDVALRQANCSALGVPVGWIDTYTANRPGVSGGNPELKPERARSLSYGLVWQPEFFEGFGMSVDYWRIDLQDAIGSVTAETNATRCVDNPGGINNSFCGFVQRAPLGGFTDPQGRIYPEHSIIGWQALNENLARSRRVGVDLEMDYRFQLGEGNTVLRLVGTRLIQSREWVFQDFPEEYDEYVTYVTDPRWRAQFQTKYNWNEWRASWDMNYVDGNLRVTPESYNSNPGSASPIKNGSYTYHNFQFGYQFPGSKIDVYLGIDNAFDKDPPRNYFGSDFTSALYDNVGRFFYLGTTVKF

SEQ ID NO: 21239 - protein, 757 aa, Xanthomonas campestris
MKRSLGMPILVGVVANGLAMPAVAQENTVHELGAVTVVSAAGFEQKITDAPASISVISQQELHSRPFTSVVDAVRELEGVDVGETRDKTGQSTISMRGMGADYTLILIDGRRQNNHGDIYPNNFGGNQFNHMPPLEAIERIEVIRGPSSTLYGADAIGGVINIITKKEYEKWGGSINVSRTIQEYDQYGDATSTDFSVSGPLGDQFGLALRGSLYDQDASSPEYDPVTDPSGVLQERELGFGSGGRTVDNEDTALGFTLRWTPTDNQRISLDYDDSVQTYDNSESQLGTHDSADRLPRAGYAQDQEFTREQIALTHEGEWGFGLSNVSLTYLSTNNEGRTLPLTADERQQYDDIVATNADCVADAGSDACLAVLGSTFLPRPERTLESSELRLDGKLDLPINDQHFVVVGTQILRGELEDGVFGLESGDAGEVFENNFWALYAEDNWTPVEPFTLTAGVRYDNHETFGDQISPRLYGVYTLSPSWTVKGGVSTGYKTPKTIDLYDGITGFGGQGTRPWVGNPDLEPETSVNSEIALYWESPNRHSANLTVFHNDFKDKIVRQDSALCSATGGQTPCVDLGDYDTVDGIVTWPMNVDEAVIQGVEVAGRYQISSRWSLRANYTYIDSEQTSGEEKGYSLTGTARHMFNGTLDWQTTQAFAMFLTVEGRQDRFRGFGSTDASGGEYWKNYEIYHLGARLALNKSVTLHARINNLLDEDFTSYDVGFVDDGSGGYDVEYYDDYNNKDARRNFWVGLQATF

SEQ ID NO: 21240 - protein, 1013 aa, Xanthomonas campestris
MFASAASTSAAAQQADGTPAPTDQAAVQATDLDAVTVTGYRYAIEKSLEQKRNANAVVDVITAEDVGKFPDKNVADALQRVPGVVISRDGGEGKNVSVRGLSSELVLTELNGNYIATAESNGDPTRSFNYTLLPSNLLGSAELYKTPEARIDEGGIGGTVILQTRRPLELEPHSGFVSAEGTWSDTSKKTDGQFSGSYSWHDKDNRFGVFVGYTQQKRTARTLNASTESWQWYGRDEGGPAVDVNGNRSDFNANWWGGTGFWNQDGNYYTGFMMPTAVSLEAKREERERKGGQLTLQFKPTDDLTLTANYFRFDLSQDSQTNTIKIPEWNIARYYGDGNWRGGRLLDGLQFDPSGTIVTGAAYSLRPGKTYYCSEAQAAAAGLPPGGWGSDDCTVPTPQITGSYNIEKSQSQTVDLGGEWRGEQVDVAFKAGRTWAKGGPELQFSLPIKPRLQNADGSWTNGNFASAWDLTGTPSMTFSPELMQNLRDGILQVDLGSTGSSWTRNTNQQQYAQIDTTWHFDGEVFDSLQFGIKRRDGGIHRNTGNNYWVCPGTDPGDYDNRYWNGRCNAIATQFSPGLLFAQDNLAGGVNASAFPAINFPGYIGYLNQTYGAMQTRSEDNFVYNVDEEIYSTYLQLNFHTERLRGNVGVRVARTGQRADSTDKVTAYNDYFFDGADGNPLACQQGAATPGGAPADTYCGTEGYWRLADSVQRTESFVVSGLDRNYTDVLPSFNLAYDLTENLLLRAAASKVIARPSYNDIAAPGSLEFYSPEYVADRRLTGGASEQGWYGSGSNKNLEPYKANQFDLGLEWYFHPGSVAGVGLFRKNVENFAVDVISDVNMMVDGQLVTVQNYSTQAGGQDAVSQGVELYAQHTLPFGLGVQFNYTYNDASKAAVRLEDGTEAGKTSMPGSAKNQTNLTVFYETDSLLLRASYNRRGELVQGLVNGLNVFEEPYYQIDVNAAYNITPALSLTASVLNLTKQEFRSHLGDDTRARFYTGGYAGRLAYLGLTYKF

SEQ ID NO: 21241 - protein, 732 aa, Xanthomonas campestris
MMWAMRTGRRTIMVAVKGIVLAATVGHAHAQPTQPVDDANVTDAMPLNALPAITVKDVREESSVGLVGKRTTTGTKTDTPINEIPQTVNIVTAQQMEMTGATDINQALRYVPGFSSFGSDGRTDWYAALRGFTPTLFVDGLQTPNTATLANWRVDPYMIESLTVLRGPTSVLYGAGDPGAIVDAQTRQADGERIREIGVQIGNYARKQTMIDVGDTLDADGKYAYRFLGVARDGNALTGPNADQRVALAPSFRWRPDSKTSLTVTATYLQDRGDISYNFLPAQGTVLPNPNGPLSQDIYMGDPAFNHYQKKQESLGYQFSHELDPIWTLRQNVRWMHLSGDDGSVFGNGLAPHSTTTMTRYAGLFQMNYSRLDVDNNAQARFATGPLEHTLLLGFQYNRQTTTESVWLALAPYLNLYKPVYTPVTTAIFSGPTSFGHTDAQTTVSTLATYAQDQIKARRWTLTLGGREDWVDMRQDDRANNSQIKQNVSAFSGRVGLTYEGDYGLSPYASYSTSFNPVIGVRMNGGGLPKPTRGRQIEAGLRWRPAGKNVTLSAAVYQINQSNVVTPAPINLDPTGTSFVQTGEVRSRGIELNAVGQITRELSVIASYVYQDVKNIKANDASLNRWPVDVPRPRQMASLWTDWTWHTGALAGFGIGAGVRYQSALAGAPDNSLTIASYTLYDAALHYDTRDWRLALNVANVFDRRYVSGCQSYAVCVFGNERTVLASAKYNW

SEQ ID NO: 21242 - protein, 894 aa, Xanthomonas campestris
MPVHHSARPVSRHARPLPARAVLCTTIACVLATAFSAQAQDSAPPAQPPATGTTTAQAPVTLDNITVIGQRASLNQAVQAKQMSDHVMEVISADNMGQMPNVTVAEALVRLPGVNGTRDRGNESLATVRGLGPRMTMGTVNGREIASSEPNRAVRWEVFPTEIVSTVKVYKTQSADLVAGGLAATVDISTISPLDYTGAGFVGTAGPVFYDHAKDVDGYSPWGNRFGASLVHKFNDNLAVAFGATYQKQKNSNSSIGSWGYTDATTSRDVDGDGTVDPTPFGAADQLKLTEQTRTGAMGTVQWRSGNFEMKFDGLYSRIEIDEDQLQNWFNGLAFSTFSTGANPYTTPGSSYTIVDGDVVAGTLANSNLQVDHVVSHYNEVKTLTAGGLNAKWNGDVWTLASDLSFSQAKRDNTWQAARFGSNPDTVSFDFRRSVTPTIRTSSDTPEYGIAGQTEPQALRDKIAALALDAGRQIDMAAFTSVEFGVRAARREKQNRRFISNQSGYDQPISAYQNLIYPVTMPDLNVPTLTGGNMDAIADVGFGGFDPATLDEQLLDHWNVKEDVREAFAKAVFSSQLFGTDVTGNIGVRLVNTKTTSDGFDSVGTTVQASSDSKEYTDVLPSATLNFLIDDQRILRFAVAKVIARPPLDELRTGRRLDDPTVTVGQLTGSGGNPQLDPFKATQVDVSYEWYFHKEALAALAVYRKEVDSSIGYRTDREVINGLDYLVSAPFNGGGGHINGVELTLQTPFYFIPHMENFGVYSNFSLVDSNLKEFSPADNPLPLSGLARKTGTFDLWYSNGTFEARVGYKYHSPYTVVYGWNAARLARLQSEGTVDLSLNWQYSKQLGFRFQAGNLTNEPLRAYTDNKPNRLANQDDGGYQVFGRRYALEATYKF

SEQ ID NO: 21243 - protein, 476 aa, Xanthomonas campestris
MQTKYLYLTLLAISSLAYFELSEAQKDTKPPKTFTKLEIIEFARIKHNFTDKEKNYIAYKDIIAKKYKVKKRPITITQTTIVDVPVAQAIEEKPKEVIKSEVSKDTKELTKEDKDIASIIASDDVDGQFNEIKNIREALLKNPRVPKWIKDSIRALSALRDEYDIDIGFSYRGVAQSDLISNSSGVGSNMDLIAMYKPNENSSVGFNLNARHQVGDNSSSTFAQEIGSLYTTSPAYSDRDILVSEFWYQYKIDALSMRLGVVDPGSFIDNSFFKSSSNYFFSSSISSTPYSLVPNNGLGIGMKYVKPSFFISGQLSDSDAKAGESMDSVLNNDLSLYSAIEFGITPKNNRYYLTLWHRERESSNAATGAIVSLNQTLDELNKVFAKYAFSNEASATQYISLGWGRKNFLDKDDKVGLAYSASESKTNQEIQNTLEMFYRYDYYHGIQISADIQILNPIYSSEDLAILPGMRLRIIF

SEQ ID NO: 21244 - protein, 743 aa, Xanthomonas campestris
MIRLHPLVVALSLALPAISLCARAAERDAGAEGAREVHDFDRLQVTATRTQRALVDVPSTVDVIDREQLDNQLVRELKDLFRYTPGVSVTSTSGRFTGANGIRIRGLDGNRVAMLVDNVPVSDTFSFGSYLNANRNFVDLETLKRVEVVRGPASSLYGSDALGGVVAFVTKDPSDYLSADKHSYVGLKFGYEGDWNGLFAGATGAFGGERWSGLVAVSHRQGQEAQNQGDDRSRDFTRTAANPQRIDGRSVLAKLVYAPSAQQRFKLTVEGNEDYGSIDALTGVDTRSPTASLRILSQQGRDHQTRARVSLRHEVDALDSVWTDDLQWQLYRQDSESLQRTNELRGNTTRRHNEHNFDQRVYGLLVNAHKSIETGTLSHEITYGLDCTWTDTRAKRDGYSVNLANGVVSNRVGQDVFPVRDFPMSETTKLGLYAQDEIGLLDGQLSLTPGVRVDYFRLSPQVDDIFREDNPGVAAETIDETQVSPKFGAVWRFSDAWSAYANYAHGFRAPPYNDVNIGFTNLQARYTAIANPDLKSETSRGGELGLRFNDAVGYFGLAVYYTDYRNFIESYAPAGVNADGLALFQSRNVDDVVIKGAEARAGIDLGMLAGWQGWSLNSAVAYAEGDNLTDGTPLSSVDPLRGTLGMAFDSDRWGAEVIGTFVARKHRPQLDSYYVPAGYATLDLMGHWEFAPGAKLTAGVFNLADRRYVDWNALPNGTLASSTVLDRFTGAGRTASVSLAVNW

SEQ ID NO: 21245 - protein, 313 aa, Xanthomonas campestris
MCMLISTICALRRSEMKQFHPWLKCLLIFPFWVCCLTACVNHEQVFLSKEKLMLAEQHPNDHLEHEVMVAQISELLLVKGLKKEERAILHFERGVLYDSLGLWALARYDFDQTLALYPKLAAAFNYLGLYLLLEEDYSASLDIFNVLFELDPQYEYAFLNRGLNFYYVGRYELAQRDFLQFYQADKSDPYRTLWLYLNELKHNPQDASKNLAQRAMGLSDEYWGTYLVQYYLGKLSVKALFAQAQQFAQMNRAKYAEILTETYFYLAKLKLNSGQINEAETLFKLAIANQVYNFVEYRFALFELLKLKQSSKP

SEQ ID NO: 21246 - protein, 857 aa, Xanthomonas axonopodis
MPPSIRSGTTAMSTDYRLSCINLGSHQLLAEAVAGKRHVDYRLFASACVLALASIPASSWADSCTSATTTINTASTDICRLAAGESVDITSSGSLTYSISAAVDMAAGAGNVTNAGDIFGTFQNATTIFVGAATTADIINHGNISNNATAQNNTVIGLLNGIGILNKIVNTGLIESTGGVTSSAVGNYFQITNGIDNSGTMRGKTASIGNMVATSVIGGIRNTSTGLIEAIGANGYGIINNGLITDGIVNSGTISGPLAGIFNTGTIYSNTDGYAIDNRGGLILGGIANQGTLDGNVALNTAALVLSGTTARVTGDISGAAASSITINNSFTAEAAANVGTITVNNAATLNFLTNQNWSGSNAFSNNGSVVIGTAATPGVTLTTANYTQSATGLLQIGASSDSNYGKLLVTGIANFTPDARINVDVATVNTLGINQVLARVISAGTLNASTFNISDNSALFNFRQVRNGNDIDLRVVANSGQGTGIRDAVIEQRTWSALDAARVLDTQLNNGVTGDMGNVINAFGQLPDNRAVARAATQTLPLASGHQAILGTLGTFQNVIQNRIGGNTGLSSGDTLKDKQIWGRVFGSRADQDDRKGSSGFSADSWGLGFGADAEVAAGSRVGLAYGYAKTSVNGNTDLAGTAQDSNVSSHLFSAYGSKELGQDRSISWQADLGVSDNDSMRQLNFGGLNRTARADFRTYSAHVGAALRQQFALSETTSLTPALRADYSWLKSQSYNETGADALDLNVASQKTDALVLGADTYLQHRFSATSRLDAHLGIGYDTINKPGAIVAAYAGAPGLSFVTSGIDQSPWLVRGGIGYTHTTANGTEVSLRYDAEGRSEYLNQSASVRAKWMF

SEQ ID NO: 21247 - protein, 1012 aa, Xanthomonas axonopodis
MKNHRTVSALPTRSLLCCALAASLLAANPAMAQSSNATLRGQVAASQAGTTVTATNVATGTTRRVATGPDGSYALVGLPPGTYKVDAGPGTEKTVTLSVASSVSLNLGGGGEAATPADGTATTLDTVKVTATSLQEVKTSEVGTNVSLKQINTVPQLTRNFLEFADTVPGMQFETDPNGNSRIRGGAQASSAVNVYIDGVGQKSYLFGGVSGQEQSAGNPFPQLAIGEYKVITSNYKAEFDQVGSAAIVASTKSGGNEFHGEIFGRTTNTDFRARQADERASAPNADGTKRQTHQDEYGMAFSGPIVKDKAHFFVSYEGKGFEVSANPVSVPDTFSALSDDLPAGVQSRLGSVTRPFKEDLYFGKIDWDVGENDRLELTAKYRDEKSRDDVGDRNTAIAGKNNLNTEERYDLRWQHFGQTYVNEARISYEDVLFNPNAFTLGNQNIYTRGVAEDDVLIRDNATSGLAIQRKGQKGPSFQNDLTLNSIDWHGSHVVKMGVKYKEVELTQSENSTVNPSFYYAVADGLGTSAIPYQVKFNLPFAGAAPSVTTKSKQLGLYIQDDWDVNDKLQLNLGVRWDGEKIPSYLDNVTPPEVVAALNGPGTDPTVSATYAEQLAKGGVNINDYISNGRSRKQDTNNFAPRLGFSYDFRGDESLVVFGGAGRSYDRNLFDVLGLEQVKSALAQYTLRFAEAAPGCTPAPGTCVNWNPAYLSDPGSLGSLVNSGVRNGEIDLLNNDLKTPYSDQYSLGLRTRLGEWNTSATVSYIHSKEGLIFTLGNRYPNGDFFQAGTQPWNENPPGFGSLLIGNNGVETKTGQLLLSADKPYSQESGWGLTAAYTFSRARGNRGNDDRYGFDAATIANYPFLDLNAVPRHRLVLTGIYDLFWGISASAKLTLATVTPRNEAVSFDQYGGQPSENIRIVSVDAPGGKFIAGGDIFGTRQLDLSLSKDMHVTEALTVQVRGDLINALNFRNYDQYAIDWGQGGIYAPRASINQYGALSTPPRTMFLSARIIW

SEQ ID NO: 21248 - protein, 745 aa, Xanthomonas axonopodis
MKTYLIINFLFLSLVISAQEQLKGIVLETSSSKEMPLPGANVYWLGSSVGTITDDDGTFSLPYRFSYNKLVISYVGFKTDTLTVTENKYIKHVLQASEELDVVTVTSRKQATAKSYLKATNTLFVSSDELLKAACCNLSESFETNPSIDVNFADAVSGTRQIKMLGLKSPYILIATENIPAIRGASQAYGLSFIPGTWVESIQITKGTGSVVNGFESIAGQINAELVKPTKDDKLFVNFYGASSERLELNTHFNTKLSDKWSTGLYLHGNTHQRKHDVNDDGFLDMPLYNQINVMNRWQYTNAEKGVVSFINLRYLNDEKQAGQVDFNPNRDKGTTNFWGSEINTERFEITTKLGYVNPEIPYQSLGFQTAYSHHEQDSYFGLNLYDIEHNSFYSNLVYNSIISDSRHKVKTGLSFTYDHYDELVNTDIYERTENSFGGFFEYSYDDLDKLTMTAGVRVDQHNRLGFFVTPRLHLRYSPWEKSAFRASIGRGKRSANIFAENQNMFSSSRQINILNSGGKIYGLDPEIAWNYGVSYLQGFNLFDRKADITLDFYRTNFQNQVVIDWENPFEVNFYNLEGDSYANSFQFEFNYNAFEGFDLRTAYKFYDVKTDYTSGKLEKPLVPKHRLFANASYETKTKDNGAQWKFDATYNWLSEQRFPSTDLSVSEFQLDEYSPTIGTLNLQVTKVFSPKFELYLGGENVTNVRQSNPVVSAENPFGANFDSNFVYGPIFGSMYYAGLRFRIK

SEQ ID NO: 21249 - protein, 802 aa, Xanthomonas axonopodis
MSSTAAPFRRTLLALTIAFAGQVGLAHAEPYQLPAGPLAATLNQIASQAGVTLSIDPALTEGKRSAPVEGDLQAVDALNQALRGTGLQLQSNGAGVYSLVPAAESAVALPDVTVTASEQAAETAWGPTRGYLASRTATGTKTDTPLLETPRSISVATREQMQDRKVQNLDDAVRYMPGVIASSYGSDSRADWMKIRGFEPIQLLDGLPLPKGSYTMPKLETWNLERVAVLRGPASSVYGQTPPGGLVDAVSRRPQAESSHEVQVQVGNYQHKQISFDSTGKIDDEGRFLYRFSGVGRDSGTVIEHMDDQRFNLAPSLTWNIAGDTRLTFLGQFNRDDTGGTSQFLPLQGTKLGTPAGKIDYNKNLGDPDWEFYDKTFYALGYAFEHRINDVWQFNQNLRYSKLELDNQIITAGGWATAVANDGTVARGANVYDENISHFAMDNNFQADFRTGALTHTLLLGVDYLRVNTDYRWLYGSAPSSNIINPIYGQDFSGVAYTAFQDYNQKRRNAGLYLQDQIALDAWRLTLGGRWDRLDTDSVFYNANDAKDSRRDSQFSGNAALSYVFDSGFTPYLSYAESFQAEAGGNGGAAFKPSTGKQYELGIKYQPPGSDMLFTAAVYDLKRQNIVTTNIAGASEPVSEVEVRGLELEATGNLTENLSLTASYTYTNSKMTKVGDPRDKNRALPLTPEHQASIWADYDWNQGMLAGFGVGFGARFVGSTDNIAVGNLGFVRDASDGHSSAYTVYDAAVRYDLGQLDASLRGASVSLNANNLFDKEYLATCDGFYCYAGDPRRVTASIDYKW

SEQ ID NO: 21250 - protein, 88 aa, Xanthomonas axonopodis
MGSPVGLNGAVIYTGRQFVDADNKQPIPDWTRLDLGARYTTAINGRKTVFRANIQNVTGTTYWSSVASFGTFFLGAPRTYLLSMTVDM

SEQ ID NO: 21251 - protein, 417 aa, Xanthomonas axonopodis
MTCSSRRLLPVAILLALPTVAAAADASDVFTPKLAYTGEAAATLDGGKRSGTAYAGQLMFGAHVDLDAAFGWRGATIKAYGINRHGTNLANSSTGNSTSVQEIYGGQGTRLANLTLEQKLLNDRLVLEAGRSVANIHHLGSELCQYFQGNSACGNPTYVFRTSNFTWWPVSSWMADATAWVTPDVYVRVGAYQVDPSQAEDGQHGLKWSTHQATGWIVPYTLGWRSPASARLKARYELGGWQDNSTYLDPLRDANGTPALLSGQDYANRRGRSGVFARFEQQLTGDGAGRGLTLFGAALKGTSGQLIEDHFLQAGVVQKGTFAGRPQDSIAFVVTQQKYSSIALEDLRLARAAAGGSGTPHGSQVMMELSYGIQLTPQLRIAPNLHYIVHPDQFNEPARQRDLPNALIAGMRVDWSL

SEQ ID NO: 21252 - protein, 247 aa, Xanthomonas axonopodis
MRETGEVVPFAGVTYDLNDNFSIYASYTKIFQPQSVRDENNAVLDPDEGDSYEAGFKGEWFNGRLNASLAYFEIRQDNRAESTGVRNVEHNYIIYEGVKAKSKGIELEVTGELMPGWNIQAGFTHQVIREDETNEKLTTYQPENQFKIYTTYRLPGALNKLTLGLGANYQGTTWSDENDALGNPHQYRQEAFWLLNAMSKCQITNNLSATLNVNNLLDKYYYSNYGFGNGKMYGEPRNMMLTTRWDF

SEQ ID NO: 21253 - protein, 768 aa, Xanthomonas axonopodis
MPVAVSLYEQRGILIMMNKILFPLVAGLLLLCPEPGLAQGNEGSIQLLDHSTQEPIERARYRYSSQNGSTDNSGVITIEYVENDTLFFSHVGYGEWFVTDSQVRAAFKKGRLFREQRLIAKPVTIIAVRPKPGDVEKIGLDFNDRLSHDAGALLNQSAAVSSIRKSGSYGFDPVLRGYKYDQLNIVVDGLLCSAAGCPNRMDPPTSQIPPNMIEQVEIYKGPHSFRYGTGFGGTIVFESNPVRFSREQDLYGRMSGGFESNGEVYRSEGVVGLRDQTYDLGLFGSFSKGDDYTDGDAVTVPSSFQRASMGGRMGLKLADNQKLTVTATHNNARDTDFPALPMDLRSDKTWLFNAKYERSYQGGDFDNWETGLFASFVDHTMDNLGKDLHPRMLDATTEANTVSYGGRSEGTWVFENGRLYSGIDVRIERAEGERTREFLMGPMAGKTVHDNVWNGGQIAKPGIFGEYYHSFPGFDLIASGRLEYNDARATDLSQDFAAKNPEIEANDINPNFSIGGIKHVSDELSLGLWLGRAQRSGSITERYINSFPVGRDPYEMLGNPALKPEINNQIDLTLAYLTGNTSLDIGIFASLLQDYISSEIDPSLKPAMPSSPGVRRYVNIDDAFMTGFEVIWKQRLFAGLKHQASLAWTYGEDRVRNEPLPEIAPLDFRYTLWGSYLDNTLMPMVTLRHVTAQDRVSTAFGETDTPSFTLLDVGVTYKINKSIGVTAGVKNLFDEAYYEHLNRSIKGQSRPIFAPGRNVYLTLFADMM

SEQ ID NO: 21254 - protein, 228 aa, Xanthomonas axonopodis
MRSISILSLAAVSALAIAPSAFAQDTTYTGDASSTSSSTMSSNGDTASGKHWAVVGGVALLNPKNNPAPGLDVDGGPAPTLSASYYVNDNWAVELWGAADKINHRVNADGVGKVGTVDQQPIAISGQYHFGEADNVFRPFVGVGYYESNFSNEKIDAASTSGDHVGLSTAKGVIGTAGVDMNINSTWFARADARYMRSRPELRVAGQGTGSELKLDPWTVGFGIGARF

SEQ ID NO: 21255 - protein, 431 aa, Xanthomonas axonopodis
MSVNKRFLTVSIAAALVSSFNVQAAGFQLNSQSATGLGRAFSGDAVIADNASVVAKNAAAMALFDRPAMSLGLTVIDTDIKVKNTSLAVTSPLGTQSFGVDDASIGGVSYVPNLYYIHPINEKIAVGASLYSNFGTLTEFPNGYGGAVPADIFGGTTEVKSLNLGLSASYRLNKQLSLGAGIDVIYGSGKFTRGRGLSPLPSSVTGTSDLVDIDADGFALGFNLGSVFEVDDNNRFGLTYRFSPTLEAKGDMTYIPNASIGKPYDLSGEKLKMPLPDMAEFSGFHKLNDKFAVHYSIQWIGWSSFDKLETTGGTVIKDYEWQDGWHYAIGGTYYLNNDWTLRAGYMHDTSAQDQMTSISVPDSDRNWISGGFTYHLDSKSNIDFGLTYLMGKDVDVKEQSALSANPPTLGTLTATTRANAWLYGIQYSRSF

SEQ ID NO: 21256 - protein, 665 aa, Xanthomonas axonopodis
MAHAQSADNKADTSLSTVVVTASGTAVDIKEAPASISVITREDIERKPVTSIGELLSTIPGVTGGLSGTGAQSKIKLRGLPEKYTLILVDGKRQGNSAGINYRDDLGSQDLDWISPEMIERIEVVRGPMSSLYGSDAMGGVINIITRKIGKRWSGSTTLNYSKPSDGDRGDTRQLGFNISGPLSDKFGLRLGGNYTDRAADESTGGFPGTYQSTAGSRKQNLNALLNWQLTPDQVIGIEAAQGIQRATGSDARTASGDQVVYPWGLSKLEQTKFGISHDGRWGDLTSKLNLVHNKYEDKGDTIGNNSKETTLDGRIDKPLKLWGLDQAMTLGMQWRRESLDNRDTIGLAPIDYAGRPVSGSGLSATTWALFGEDQIFLRDNLALTLGLRMDHHQKYGNNWSPRAYLVYHPASEWTVRGGVSRGFRAPNLKENSASAATQSGGNGCRSLAGMGWTSTSVNADGTRGCYMAGNPDLQPETSTNFELGTSWDRNGWALGATYFHTNFKNKIDYQPLGFYNGFWWTRMANAQRARTRGLEGFVNVPLAKGLTWNTNITKMFESKNLSTGASLLAVPELSIYSSLQWQIRQGWSAMFSARHVGKEVVTTGTATTFAKAYTTFDVSMNYNVTDTLTLRAGIINLADKETRTIGANYDNGGRTYFVGMTARF

SEQ ID NO: 21257 - protein, 167 aa, Xanthomonas axonopodis
MKRLHKRFLLATFCALFTATLQAADVTITVNGRVVAKPCTIQTKEANVNLGDLYTRNLQQPGSASGWHNITLSLTDCPVETSAVTAIVTGSTDNTGYYKNEGTAENIQIELRDDQDAALKNGDSKTVIVDEITRNAQFPLKARAITVNGNASQGTIEALINVIYTWQ

SEQ ID NO: 21258 - protein, 652 aa, Xanthomonas axonopodis
MAAPFTPRLILVAGAAAALALPALAQETVVLLDPITLRALDADGSAADRGASQYVAAAELERARMGDLKDLFTGIASVSVGGAIPVAQKIFINGVDMLNLSVTVDGVEQNNRAFHHVSANAIDPGLLKFVRVDAGVAAADAGPHAVAGAVVMETVDAADILEDGRSFGGNVRLSYGDNGRTFGRAATLAGQMGGFEWLGYLKSATGDDYQAGGGQTIRGSAADLQSVLLKLAHETPGGHRIELSGQRLRDDTLRPYRANIGHIEGGAPLPELRRYDTTRSSWSLSYENTQAGGLWDPRFVIGRSESRVHVDQPTVMPPYVSKGDSDTFSAKLENRFHLSDANSVTAGIDWYDRSSTYSDPFGGLDENARNIGLYAQARLEPVERLDLSFGLRWDRQDFTGTSGWKDTNSGFSGNASLAYGLTDALVLRAGASTVFGGIAIEDNYIFNGAWDYDTLRPARARNYTLGFDYEAGDLRLDGELFLTQVDNARGGTYRGIENFDFESRGYNLGLGYGWNGGYLRASISDSRVSVNGNPASSYEALDFGAPLGRVFSIEAQHTPQGSAFTYGGSIEAAAKYDRIEGDSDRTIPGYAVLNLFAEYAPEQVEALVLRAEVANLFDKDYADRATYGGDYATVTPLREPGRTFSLVATKRF

SEQ ID NO: 21259 - protein, 399 aa, Xanthomonas axonopodis
MSVAGEIAATRFGAAAFKRANAAIGDGRQRHDQEFNGDRIEPTQQAQLFGRASDWALGVDYNTNQQTSYPLSKGAFDTIDPGGFEPGHFLDIPGMDPPRSKGRSTWTDTTSVFLENRRRLTERLALITALRYDHIDFEVVDHAAQARLDKRWDAVTCRLGLVYGLTSNVSLYNQYSTSAEPPGGTLTGASVSQVGDFDLSTGRQIEVGSKFDFLDGRGSATAAAYRIVRKNISVPSSTVPNTTEQAGQQTSTGIEIATSFKITPKLLAAGNFSWVRAEYDEFNENIAGVVYSRKGKNPANISDRVANLWLIYDVAPDWQLGADARYVSSVYANTANTTWVPSNTVYGLPMTHDLDKHMQLSARLRNLNDEVYARFIHQSNPQYYLGEPRSLEIAVQWSY

SEQ ID NO: 21260 - protein, 744 aa, Xanthomonas axonopodis
MSHRIDKARAFWACSTAISAAAMLAAAPAAAQDNETDESASSGQLGSIIVTANRREENLQDVAISADVLGQERIDNIFASAADTTALAGTVPGLNVESSNGRVAPRFYIRGLGNTDFDLAASQPVSVIMDDIVLENVTLKSFPIFDVERIEVLRGPQGTLFGRNTPAGIVKIDTVKPSTTDTSVNIGLSGGSFGTITGQAAVGAPIVDDTLGFRVSTQLQRRSDWIDNGFTGEENVLGGYTDFAIRGQLLLTPDEANRFSMLASVQFRDLNGSSTFFRANAIDVGDNDLRDDFDRQTVFYDGGGGNQANYQQFGTSLKMDYEFDGATLTSITGYYESEGSSRGDVDGGNLVTGPGFIPFPSDTQDSIDLQQFTQEIRLASNGDGPLSWQVGGFFFDSDFDVTTVGFTFPPPVTVNHTNEAWAVFGQLSYQLTEMLRVTGGLRYTDDEKDFFVVSGAAPQPVSVQDDNVDWDISLFADVSDDTSIYGRVANAFRAPTIQGRDVAFFAPPSTAGSEDITSFEVGFKSEFADRTIRINGAVFYYTVNDPQFTAVGGGGNLVQLINANEGEAYGFELDTAFQITPDFVVTLGVAYNDTEIQDPNLEVGTCAQCTVTDPTRTAPGAFGPVTFANVDGNPFPNAPEWSGDFTAEYTLPVGANDEFFVFTDWTYLGDTNFLLYESLEFNADSRIEGGLRIGYRGNGGEYEVSAFARNITNEVNVLGVVDFNNNTAFVNEPRVFGVAVNFNY

SEQ ID NO: 21261 - protein, 824 aa, Xanthomonas axonopodis
MRERIAMSTLHTMRLHALACAVVSCLCAPAALAQDTAAAAPATPPAADSAAVNLDSVFVTGTSTATTKLKSSVSVSTVGAEAIEQSAPRSTAEIFRNIPGIRSESSGGEGNANIAVRGLPVASGGAKFLQLQEDGLPVMEFGDIAFGNSDIFLRSDFTLDRIEAIRGGSASTFTSNAPGGIINFISKTGDTAGGSVGVSRGLDYDNTRIDFNYGAPFAEQWQFNIGGFFRQGDGVRDAGYTTDKGGQLKANLTRLFDNGYVRVYGKYLNDRAAGYLPVPTSVRGRDGSPDLGGFPGFDPGNDTLYSRNFRTDVGLDGNNQPRRTDLGDGMHPISRTIGAEAWFDLGNGWNLSEKFRVADNSGRFVSPFPAEVTDAASLAASIGGAGAQLVQASGPDAGQAYTGNAIRTHLFNVAINDLGNVTNDLSVSREFGGDGRTLNLRMGYYSSRQTIDMDWTWNSYVQSLGRNSRLLNVVDAAGVSRSQNGLYAYGTPFWGDCCVTRSYDVRYDVNAPYVALTFDSGKFSIDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYEGFTLNGGLTWTDAEIARDQITPENAGNVPRRQADVVWQLTPSYRGDNYQFGVNLIGTTDAYTQDANQLKMPGYTQVNLFGDYRVTDALTVALNVNNLFNTFGLTEAEEATIPANGIIRARSIAGRTTSISLRYDF

SEQ ID NO: 21262 - protein, 779 aa, Xanthomonas axonopodis
MSNDTALGRGGALCCVLATVAAIESCSTASAQSNSDTVLPAVTITEPARQPLRSQPNRAFRASAARRATHQSASRTPAVTPSAALPATAPGTMNAEGAPGPLNLGIPNAAGSLVGLTPRETPATVNIITQRDMQEKGLRTMVETFNSVPGVMSGNLPGEPGVISMRGFSRAATGYAVDGVRAPDPLIVSRDFDTFSFERVEILKGPASVIQGVGALAGAVNLVTKQPKLGQAGAQGLLSYGSFNSLRTGIDINAPIGSNAAVRSTLSYGQSDGFINDTRSRKVGATTSGTLAPTDRLTFTSSASFFHDEFRTPYQGTPLIARSLARDPTNLVSAPGGLVIDRSIRNQNYNVENGLMTSDTVWLRGGAEYKLTDNWTLRNDLSFFKSDRYWASSEDFTFNSVSGLLDRSTTKITHAHQIWSERAAAAYDGIIGGFRNRFAAGLEYTDTDFDSSRRFGSATPVDPFNPDRGYFPADTAANFPTRQDFTSGLKTFAAFAENAINLTPDWLMLASVRHESMKLDRRIDDLNTGTVTRFEKTFDNLSWRVGTVYNVTSGTALFGQYNRAAIPVSGLLLSNLANGRFDLSTGSSIEGGIKSSLLDNRLVTTASVYQIEQNNILTRDPTTPALTVQGGSQRSRGVELDVAVSLTPQWRVNANASFIKAEFTELRSATLDLRGNRPINVPAQAFMVSTSYRFDPVPLTIGASAQHVGSFYTDTANTIEVSGRTLLDAWVAYDIGGGTLRLRGRNLTNAFYANWSGYSPTQVYLGAPRNFDLSYNVRF

SEQ ID NO: 21263 - protein, 390 aa, Xanthomonas axonopodis
MRLNLFVLAVAAAIVPAAANAATSIENWPTKYTFGDGTELGLTGNYVYDDNNFSGDDRLEDRNDFRRKEFGATIKKKGVYDAMVSYDFKSKLWLDVFYRFETKALFGQDYGRVRLGYMKVPVGLEAVQSSRAGSFMELGLPIQAVFEGRRTGAEWTLERQQYLLQAGAYGGKDLQGDNPGTTQAVHVAWTPFKAEGDVLHLGIAGSIETPRGYSDGRGVSFSPRVRLRARPEAGLTDVRLIDTSTILDVDHVIRTGLEAVWIHGPFSLQSEALRAEVARNENKPNFIAQGQYIYGTWTLTGESRSYAGGVPGNIKPMHDYGAVELTARYSRLNLEDNNVHGGRQHDTTIGANWYLTSHFKFQANYSWVDASRNGVHATPHVMELRAQVQF

SEQ ID NO: 21264 - protein, 201 aa, Xanthomonas axonopodis
MTMTRLKISKTLLAVMLTSAVATGSAYAENNAQTTNESAGQKVDSSMNKVGNFMDDSAITAKVKAALVDHDNIKSTDISVKTDQKVVTLSGFVESQAQAEEAVKVAKGVEGVTSVSDKLHVRDAKEGSVKGYAGDTATTSEIKAKLLADDIVPSRHVKVETTDGVVQLSGTVDSQAQSDRAESIAKAVDGVKSVKNDLKTK

SEQ ID NO: 21265 - protein, 390 aa, Xanthomonas axonopodis
MMNLKKCALHTAVAMACGLGAQLANAGATISFGEDKYISAGFGFITSYNSVEDAAANGSDRSNDFTLDSARLYLSGSFNKYIKGMLNTEKSGGGSANSNFEVIDANVQFQLTPEVAIWAGRFLSPSDRANMAGPYYSMGGGYWANIASRYGWNGGVIGRDDGVAVVTSFMEDHVAVSFGAFEGDNIFRFSGVGAQSEANGTKDKLMYAGRVQIDFWDAEPGYYGTGNYFGAKDILAIGIAGRMKKDGVVSTIPGVVGDYKSYSVDFLLEKKDVGPGTFSAEAAYYYYDTDDVFLGEQGKAYSAGLGYLFNDPVGWGKIMPIVRYQKFDADGLTTAASVNTRTSADTKRFEIGANYVIAPYNSVITATYGKTDTPAASSDNFFRLALQMQF

SEQ ID NO: 21266 - protein, 790 aa, Xanthomonas axonopodis
MPIYRYPSRSLTALAISVALYSSIASSMAAAAEDTSSIEVIQVSGKAINDKGMSPKNSTVDGPFGDGIALKDIARSVTPITSEMIEQLNIIDLSDIQKVSPNSYSASGFGASSLPTIRGQLGELYQDGVRRQAGNNGFGVPMSFNAVEQIDVVKGAPPVLLGTSQRNGGFVNIHSKVAPTDDQFAHLTLSGGSWDHYRAQIDVGTDIVPNESGIRLSAEHIDNGSYYDYSGFKSDSIFVAFRLLPDDVSTWDINVEYYDVEFTDNAGINRPTQALIDNGLYVTGQGVQPNGSTIAGANAIVSPTGLVEIDRSQVLTDPDNINNAQTFLLHSTYVRELSDKATFKNITYYQHLEREEIAQNSFVEIIDGADTAQNRVELAYQWNDAQSTITAVDIRYNKVLGYSQFTTEADLPIDLTGPIENRRIPLTAEQQGRLVELRPGVFVSPGAQYDTNADGSGDFSLSDTTDSTSWQTGLAIQHNSQWTEKFSTSVGYRADVYNVDARDAIAPKGQVAASDSISEMLESGQVSLSYRLSDDITTYASASYNESTSNSMAGGTTLGANNQISSQNFATENTLTEVGIKYSPTDSAWYVDAAVFDQKRSLRNRDGSNTGIRTKGFEAQAFYDADPFWLSAGYSYLDARYDDSASSQDTVQVADTFDNSRPDIIAGTGIGAPNFASFAASDRRVQGLPEQTFTINGGMSITEKWKAGFSGLYTKSYPLDYLATVYIRDQYTLNVNTRYDFTEQTSLRLDVNNVTNQKNWRPVFEGGYFGSTLVYPELPVNATLTLQHSF

SEQ ID NO: 21267 - protein, 90 aa, Xanthomonas axonopodis
MTVKQTVEITNKLGMHARPAMKLFELMQGFDAEVLLRNDEGTEAEANSVIALLMLDSAKGRQIEVEATGPQEEEALAAVIALFNSGFDED

SEQ ID NO: 21268 - protein, 710 aa, Xanthomonas axonopodis
MNRPSLALRLALVATTALLPIAAHAADAADADADAADASQQIIVTGLLERTNSGTKTDTPLTQTPQALTVVTDDVYLAQGALSVSDTLRYVSGVIANPYGPDSRVDGAFIRGIDALQFRDGMRDIFSYYASIRADPYNFSRVDVVRGPASVLFGQGSIGGLINLASKVPEFQTAGEVSLRYGSFDRKEALADLTGPLTDGLAARIVARVRDADTQTDHVPDDRVMVSPSLRWQPGEDTDVTLLGLYQEDDGGSTAQFLPLVGTLYPNPNGKLGNGLFIGKPGWDRYDGRLLQGTGIVEHRLNDQVKLSLKARYIDSDVTYLTHYPDSYANPDDPYLDPAKRIIGLYADGSYARMNIFSTDNNIQFKFDTGAGIEHLVLAGIDYSWNRVRKTGGFDYEFIDIYDIDYAALSNFGGGLPTAFTSSEDTRQKQIGVYIQDQVRLWDRVSIVVGGRRDHVRTKAAGSPAEKENATTFRAGIIAEIVKGVSPFFSYTESFEPISGTTITGDPFKAKTGRQFEGGVKFHPDARTLVTLTAYDIREHNRPVEIVIDDGSGGTIRGQTQIGTMTSKGFEVEASRDLPGNFQLIANYSYNKAEPSDTGVQLDNVPKKSASLWGTKTLAVDPDTSLRLGGGVRYVGVNYSRTIGATSTRIVRTPSYTLFDALAEVSWRDWSFAINATNLFNKKYYAACLSRGDCFIGAERNIFATVTRRF

SEQ ID NO: 21269 - protein, 523 aa, Xanthomonas axonopodis
MRIAPKLVRAHKLTTEINIFFKLSTKTLIMKQLLLTISALLFATAVCAEGYQVNTLSAKQLGMGHVGTGMKLNSESIYFNPAGTAFQTSRFSFSVGITGIKSNATYLSNNDYRGNPQIQAHSDNKISTPLYAYFNYKATKNLAVGLGFYTPYGSSMNWGDNWVGAHLIQSIDLQAYTLQPTISYKFWDKLSVGVGMTITWGTFDLSRSMFPVGEATNNTIAGLLTAAGQGQYAELFTQAGDRSLVSARIKGDAKTAIGVNVGILWDITPEWTLGFSYRSKVKMKVASGTANLLYASPEIGQVLQATGMIPDLSSACVETELPLPANLAWGVGFRPTPKWEMAFDIQYVLWSAYKSLHVDITDPTTGASVYDLPTSIKNYKNTVATRIGVQYHACKFVTARLGMYVDESPVRSDFLNPETPSMTKVSYTAGVTINPCKNVSIDLAYGYITSADPERTGSCDYYNSLTYKAVYAQTYGQLIAGGMAPEQAKIQAHTTANDKAIQPFSGNYSLSAHTFAIGVNLKF

SEQ ID NO: 21270 - protein, 204 aa, Xanthomonas axonopodis
MNTLTRTALAIALAASAAPALAQSAGHWTTGYGAGYVSPKSNSGTFGGTQAEIKGAPALSFTYEYFLRNNLGIEVHAAVAGKHDLELQGIGKVGSYWTVPPSVLLQYHINGYGTVSPFVGIGINYTTFLGEDTEPTVTSGDLRFDDSVGATAHVGVDFIFNDRSGLRVDARWTDSRSNVDLNGARLGKARIDPLTFGVSYLVYY

SEQ ID NO: 21271 - protein, 409 aa, Xanthomonas axonopodis
MHPTPRLAAALLAGSGLGWPLLAQADLVEDSHASLELRNFYFNRDFRQSGARDNADEWAQGFLLRLESGFSEGTVGFGVDAIGLLGLKLDSGGGSGGTGLLPADGSAGGSQDDYAKLGLTAKARVSNSLLKVGALHFKSPLVSANDTRLLPELFRGALLDVQEIDGLTLRGAHLDRNKLNSSSDYQVFSANRIGGRSDAFDFAGGDYRLTPALTASLHQGRLKDIYRQTFAGLVHTLDLGGQRSLKSDLRFARASEDGGFRELDNRAFGALFSLRLGAHAVAAGYQRISGDDPYPYIAGSDPYLVNFIQIGDFGNVDERSWQLRYDYDFGALGLPGLSFMSRYVSGDNVARGAANDGKEWERNTDLGYVVQSGPLKNLGVKWRNATVRSNFANDLDENRLILSYSLALW

SEQ ID NO: 21272 - protein, 686 aa, Xanthomonas axonopodis
MRPCSHGEGLVMRLRLLKAMWYAPSLALVWEPACDVQAQDAALTLGKVQVSEHAQRSPSTARVLSSVDVIGGELLHDQHVDYSWELLMRAPGVQVTQFRMGTDAGRFSFRGFNGEGRINAVKLLIDGIPSNDNAGAMPYLDAVFPQDISAIEIVRGTNDARYGLNAIAGSVDVLTRTGGNDGRLSVTAGSFDAREVQLSKGFEQGAWSQNYVLAWRDSDGYRDHADARKRSVAGKWFYTDPDGAFRAGLTTRYYDNHALEAGYLDAATARAAPRSSPDYAQNDRSERRLRQTALHADGALGEQAQWSAKAYQNDYRNQRWVRFSAAGLQQERDTDETHRGLLLRSNWQPDWGALQANLEAGVDAQWQDNQSQRYRTVARVRGAQLRDWDYDLRTRGAYVQAVLTPIARLQLVPGYRIDRVDGQLHDVLAGSVAPVYDYGTIKQPKFSASYRVGEQSSVYANWGRTFQIGSGDGAYRRQPGNLGPSINDGWETGFKFAPSSLLDGRLAYWEQRASGEVATVLGVNGVVGIGDVANVGRTLRRGWDAQLNLQPAEHWRAWVSYSRQKASIATPDPSAPATRGKEIENVPHWLATAGLEWQVSSSVQVSAWGNAQGDYYLERTNTLGRTGGYALLNLGARWAVDARNALSLQLRNVTDRAYVYAWYDSGSSGYSPGDGRALSVSWDWSF

SEQ ID NO: 21273 - protein, 702 aa, Xanthomonas axonopodis
MNKLCLSLFTSVFLISDAISQNVELDSSIVSASGFSQDIKEAPATINVISKKELQSKPYRDVAEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTHGSGQRVPGDQAQSPTKANNFNIGTRVSYLANDYNTFIFDIDFSRNHYDNKQAQLGTITKPADKNKGSLTGGYTDIMEVDKLVTYLSHEGIYENFSITSTLQYNRVSNNGREVVGQAKQPFLGENRDIVAEDIILDTKSVIPLGQNHILSAGGEYRLEKMQDKIANPTNFDQYLLAIFAEDEYSIKDDLRLTFGARYNHHEIFGNNISPRAYLVYNPTDELTFKGGISTGFRTPYANRLINGTYNYSGQGKFPIYGNPDLKEETSLNYEIAAIYNNDLFYVSATGFLTNFKDKISTQKYDKNSMIPGISKCEANACYRAINHGKVEYKGVELGAGISPLDNLNVNLAYTYLDTEVKEAQDRSVIGKPERNSLKHNIMLKTEYSFYNKFTPWIKGEWQIDRYMGDTNINREYYKDIFLASMGVRYDINKQWSINAAIYNLFDKSFTNSWESYKITNKTKTIETAWVNTYNRIEEGRRMYISINGSF

SEQ ID NO: 21274 - protein, 770 aa, Xanthomonas axonopodis
MAMAGALAQPALARDLRSFDIKPGRLSEAIVALGVQGGVSIGLPSASAQNLPVPGVRGRLSVDRALRRLLAGSGLHAVRIDDRSYTIAADRAKPRTAPVAAPAGPVAAPPDIIVTASKRDIRLRDFPGTIAMIDAAAAGLNGNARYGTQALVDIIPSLSSTHLGPGRNKLIIRGVADSSFTGPTQAIVGQYLGDIRLNYNAPDPDLNLYDMAGVEVLEGPQGTLYGAGSLGGIVRLVPTPPDLSQAAGSVAAGIGKVEGGGPSNDLAGMINLPISTGRIALRAVAYRSVDGGYIRDAERGLNHVNRSKAAGGRITLRARLGDWTIDAGGTLQDMQNRDGQYAERDQPRYTRRSAIAQPFDNDYRLGQIVVTRKWNDITLLSATGIVGHDVDEQFDATRARDTSPRLFHQHSQITLFSNENRLSRQNPDGTGWLVGTSFVSNSERLIRDLGAATAPARIAGVRNSVRQIAAYGELSLGLGPLIVTAGGRLAHSRLTGELLDDGKDKNEPNRSEVEVLPSIAVSWRPTPRLTTYLRYQEGFRPGGLSVAAGSGGIVSQRFLGDSIVTIEGGARFGHPVQDRFSAALSLSYSHWEHIQADLVNGAGLPITANIGNGRILGFEASLRWAPFAGFAAEGGLFLNDSELTSPSAGFEDAAHAELPNIARVGVRGALSYDRPIGGGLSLSLTGSVRYFGHSQLGVGSLLAIEQGNYADTALGLRIGTERLGASIDVTNLFDAAQNRFSLGNPFGVMDRLQVTPQIPRTVRIGVDARF

SEQ ID NO: 21275 - protein, 811 aa, Xanthomonas axonopodis
MTRPTLSVIGLAVAAVLSANAQAQQAAPGATTLDTVIVTGTRASDRTVLESTVPVDVLTAEDIRKAGVVNGELGSALQALLPSFNFPRQSNSGGADHIRAAQLRGLSPDQVLVLVNGKRRHTSALVNTDSKIGKGTTPVDFNSIPINAIKRIEVLRDGAGAQYGSDAIAGVINVILDDNPERGELEASFGAYNTDVEPINRRVTDGQTSYASAKVGTLLGDDGGFFKVGLELKNREATNRAGFDQIPPFEEQTPANLALAGQRNYVLGDGATKGLNAWLNTKIPFSATGEFYAFGTYNQRDTEGANYFRYPDSSANWREIYPNGYRPISEGENRDLQIVAGARGQWGDWDYDASLDYGRNDFTYRLRNSLNASLGPGSTTRFKTGDFAFAQTVGNFDLTRVFDAAGATHTFGTGAEFRREQYRTHAGDPASYAAGPFTDRPTGSQAGGGLTPQDEADLSRNVASVYANVSSQFGDKFSTDLAGRYEHYQDFGSQWTGKLAARYAFAPAFALRGAVSNNVRAPSLSQIGYEATSTGYDAAGRLTQGRLLSVNNPIARALGATDLKPEKSINASLGFTSKLGDHFDLSLDFFQIDIDDRIALSEDITGSSLTDFVQQNFGVTGVQSASYFLNAADTRTRGAELVANWRQYAFGGDLLLTGTYSYAKTELKNVIATPSQLLALDPDYVLFGVEESNTLTDAAPRTRASLAANWSNEHWNLQSRVNRYGSATRVFDFGDGFVPRQTYGAEWQLDLEAEYRLGTQWTLAIGGQNILDNYSDRSIDDIAYFGNLPYDVLSPIGSNGAYWYGRVRYSF

SEQ ID NO: 21276 - protein, 783 aa, Xanthomonas axonopodis
MIARFLLSVSILPIVAGAAAAQTIENDEFKSETGPAVQDVVLVTARRVEEDIQSVPIPVTALAGEFVTNSGASNIGGIDLLVPSVQFYTTNPRNSAVNIRGIGAPFGLTNDGIEQGVGLYVDGVYFARPASATLDFLDVEQIEVLRGPQGTLYGKNTTAGAINVTTRKPQFEPNARVELSYGNYGYLQARGALTGPLTDTIAASIAFSGTQRDGVLYNTATQDDLNDINNIGVRGAILFAPSDSLSITLSGDVTRQRPEGYAQVFAGVIPTLRPEARQYAAQAAYFDYAPPSLDPFDRVTDLDSPHRSYQDLGGASLTVDWETAIGDFTSITAWRYWDWGPSNDRDFLGLPIVTVSQNPSKQFQWSQEFRLAGDITDSLDFVVGAFAFNQVVKTYGQQENGAAAFRFLLNPSTPGYDTPGLLDGYGFTSDIRSEHSSAALFGQIEWHATDRLRIIPGLRLNYDEKDGHYRTTLYGGLDTSDDPALRALQRGVLSAQDYASSGDDTNVSGQLTVAYAVADNINAYATYATAFKTFGLNNNGLPTSDGQPLVELATIEPEDVRHIEIGLKTQPFPGVTANLTAYETTINDYQVNVVNGQSGVLRGYLANAEEVRVRGVEFDANARLADWLSLYGSLAWADGEFVSFENAPPPLEQAGGSIAVVDASGTRLPGLSEWTISVGGELSQRGDLLGRSGEFYLAADAYYRSEFSSSPTESAYLNVDGYTLLNPRVGFRGDDGWEVFAWSRNALETEYFESLAAGQSSSGYYAGALGDPRTWGVTIRGEF

SEQ ID NO: 21277 - protein, 626 aa, Xanthomonas axonopodis
MMSLSSVSPCRAVLAVCLSMCVAALAQAEAAVDLDQVVVTATRTAQTQDQTLAPVTVIDRAQIERRQINSLQDLLRGEAGVSLANNGGPGKQTSLFLRGTEADHLVVLVDGVRVGSATAGGAALQDIPFEQIERIEIVRGPFSSLYGSEALGGVIQLFTRRPEGRFVPTFSAAAGSDNALRYSAGVAGRSDGDLGERGGWYSVNAVHDETDGINAYLDTRSSSYDPDRDGYRNDSLNVQGGWRFNRQWDADVHALRAQSRNEYDGSAFGGNLSKGVQQAVGGRVRYAPTDAFKLTASLGSSVDFSDAYFDGTYVSTYDTRRKQGSLQADVDAGPGLLTVGFDWQRDAIASSDTYDADSRIDRAAFAQWQQSFGTQSLQASLRRNDNSQFGGKTTGSLLWGWDIAAHLRLTASYGTAFKAPTFNELYYPDYGNPLLGPETSRSAELGLRGNYDWGTWTLSAFQTRIDDLIAYDAGLVDATHPFGQPNNIDQARIRGVEAGYDTELAGWTVRSALTWLDPRADGDVNHGNWLPRRARQSGRIDADRSFGAFGVGASLFGAGKRYDDLANSDRLAGYGLLDLRVSYAVNADWKVSLSANNVFDRQYETARWYNQPGRAYLLTLRYHPAQ

SEQ ID NO: 21278 - protein, 713 aa, Xanthomonas axonopodis
MSTFRFHALAIAIAASTLTLPQLARASDTPTTDALDASGGGTPIRALDAIQVQGSLLGRSKPDDVQRYAGSRQVIDREQLRNGGNRSLDDALQRVPGIKIFDETGTGALPQLMLRGLYESRSGRVQVLEDGIPLALAPYGQTSLSLFPVGLNQIDRIDIVRGGAAVQYGPNNVGGVINLVSKEIPSAWSTTLAHKVTAGGQGRFLQDSALSSGGYLTDNFGMQVDANRTYGEYWRAHSDTDISNLRVRAEWWLDDTKLLKASVQRYLVDMDLAGALSPDDYRRDPRQSTRPLDSFNGRTTRASLSYEQLLGDWGPMQDVRLDWSNFSARSSRNFIVGMRQASTETWRSDLPPQLRQTAPRNFRVVGSEPRLSWSMGDAGGVRQQWTAGVRAVREDIDFLVGNLRLRDGLFSTVRDWRFEDRALAAYVSNAITLPGQRVTITPGLRYERLDSRYFNRATGVSTLNQTRDVLPGLTLGFQANEQWFFYADGQRSMRAPQVTQIIFGNNLDAELAWNYEAGARYQPNERTRVRLGGYLIDFDQQIQLDNTTRVFRNLGKTRHQGGELELQWSPEQLRALTLNASYAYLDAGQESGAFRGLRVPYTSRYQITLGGTYALGHTTVALSGYYFSKAFSDAANTVQENAIASVGQLPAYMVWNTQVSHTMFERDGQKFSASLAINNLFDRQYWFRGVDTSPWGRQAAPARTVTAGLEYTF

SEQ ID NO: 21279 - protein, 342 aa, Xanthomonas axonopodis
MAEQTSRLAIIIDSTGAKNNADNLTSSLVKMTQAGETAANSAGKVTKATEDEKNALAKLKAAIDPVGAAIDTVGRRYSELKKFFDKGLIDKEEYEFLVRKLNETTEELSGVAQAQREAEKAGKLAAAQQEAQAQAFQRMLDKIDPLAAALRNLEQQHDELNAAFASGKINGSQFENYSRKIQETRRELTGEAQAEREAAKAHDEQVVALQRLIAQLDPVGTAFNRLVEQQKQLNEAKAKGMLSPEMYEELSGKLRAMRSELEVTQSQLSKTGMSAKQTAFAMRMLPAQMTDIVVGLSTGQSPFMVLMQQGGHSAMQETRIASLPVTAIPAGMKIPCVTAGSA

SEQ ID NO: 21280 - protein, 435 aa, Xanthomonas axonopodis
MDAAMTKARLSLFLTLFLAVIPPAWSQTSSSTPVAGPQEPTPSGPASTAEPVPAPAPPQPPPPPANPAPTITAEPGRGILVKGPGDRYSFGIRARIQFRDTFLHFDQSDTNEINIRTLRLTVHGNVLSPDLRYTIQLAFGGNDFETGSSSPIFDAFVDYTRHRDLNIRVGQFFVPFDRARTIREFALQMVDRQQVVRELTLDRDVGVMFSSTNLFGLHEWLGYNLFIGGGDGRNRFAAYEAGPLAVLRLTLRPFGTFDDDQEGDLTRAARPRLALGLAGAYNYKTSRRNSTFGTAFTAGTVNYTNLAADLVFKYRGFSLLAEGLWRKASEDVLEGTVNGTVTREPTRSGYGYFVQGGFLVNPTVELTARWEELFARHGTDPQLQQLVQTQGKQAGGGVNVYLNGHAFKLQGDYFYIFGPEGEPRHLARIQLDASF

SEQ ID NO: 21281 - protein, 772 aa, Xanthomonas axonopodis
MNTPPTTRLALAIITAIAAPAYAAETHDAAHDTPTTLNALQVIATPRGAAVAPTQVVGPNRYIIKAEDLDAMVTGNNGLAMLKQVPGASYTATDGLGLDISATSLFVRGFRMNEMGITFEGVPLNDNGFLSLTGTSVVNVGVPDGIGAITVSPGGAPVSVFSSSVNGGSLEYRLRELQDTSSLRVKQGVGSNNTLVTTVSGQSGQLGEHGPKVLVDLQRVSADKYQGEGTQNFLRGDLKLQQDVAWGDFTVFLSDSKAKVWGYNNISFDMIRKLGWKADIFYPDYAWAWYVASPENADKSCGAYTCGELSELIPYDTGQITRDRVSSINHRFQITPALSGNVQLYNANSHTQATLTDPTVPSPNGAPFSEQVQTPRVNRLGGMLNLQFETGAHTFTAGFWQEKSKAAAKTEWYQQPLLGEGPPLKATGPFDVYGPAFKTDNASSWVTRSRQFYLQDDIVLNDTLKLGVGFKAVDFRTSGGGLGDAKDRPVNGTLRAKSNFLPHVSLFWSPTESTDAFIDLANTMNGYRVAQRGNIGYTASAWTITDQEEFDRVAGTLRPEKNWNLTVGASHRFDRLTITGDVFYNDIRNRLLSAAIGTQFAQINTVRLMPKMHVIGADLGITADLTDHLQFYQGVAVARSYYDSDFVVGDTVYPIKGNAQPGYPQISLVSDLSAHFGDWRFGATSTSYLRQPFTYENDIRVPTFWQVNTYAAYRFGADSAVPGLELRLDVSNLFNRHNIGTATIAGSSFSGDYQTLQRSAPRQLMFSTSMAF

SEQ ID NO: 21282 - protein, 406 aa, Xanthomonas axonopodis
MDSMGRRVVVAALLCAATVTGGVHPALGSGFGIFTQGASALGQADAVVAHGDGPSALFFNPAQINGLAGTQLEFGTTLIFPHREYKDSSGDVSHTKDSVFYPSSFYLTHAFNDSISAGLAVFNPFGLGTDWGGDWPGRYIATTSKITTYNINPVVSWRIAPFLSIAAGLDIVQLDATFKNKIFTPSGDVKQKFTGDGTGLGYNLGLFIDAGKGITIGASYRSEVKIDIDGKDEFSPAVYPDMDGKTSLKLPQQVLAGVAWQASDRLVVETGMRWEDWRSFKQLRISLDQPGGGSTVATYPRNWHSTFAVNAGGKYRFNDSLSIMAGYLYGWNPVPDSTFEPAIPDSDSHLFCLGGELRRGSMTLSLGYGYQLQKGRSKSTNQYGSVANGDYDSDLHLLALSLGYRF

SEQ ID NO: 21283 - protein, 880 aa, Xanthomonas axonopodis
MKYSTTLLPSAIAMSLAFAAQAQDSAGAQATDLDAVQVVGIRASLEKSLDTKRNNTGISEAITAEDIGEFPSTNVAEALSQIPGVTLDRRFGQGERVSIDGTDPSLNLSFLDGHPLAQAIWLYGEQPSRGFDYTLLAPQILGRAEILKSSEARLTEGSLGGTVLMHTRQPLDLKVNEVAASIGYSDSDQASQDKPNAALLYSWKNAAETFGIAVSAQHYEERVDRRGMEVFGYVPARTFANAAGGVPADADVPNSINAAWFQQDRERDSAVVNLQLTPSDALEFNLSGLYINENFDNYNQSMYSFLTWNPGTVAAVDQLGGVRNGVVTSGHSSANANASPLGGTVIYDNNVRESEVTTKGLDLRGAFRGDVWGLNGQVGQSKSENNDLSQYFIEPFYNGGFSWDTRRGIRFDDPAAARDPANWGSAGGWFGNNGIFSTESKDTYGQLDFNLQFDGVFNQLLFGVRHGKHDERFELNVDGGVTPGKLADVGTIGLTDLQDFYPDHGQHVQAGRNNVLNWIRNSPIDDNAPDPASYLNNSWALEQTNNAAYAQLNFSGGGLRGNLGVRYVDSKTEGSGFVYSGTPSLANADSLWQTRTRKEDFLLPSLTLSYDTSDDWVFRFAAAKVIAWAPYNQMVNNTFLNDTTLTGSGGNAELSPYESWNFNLSAEYYFAQQAVVAWSLFYKKINNYIDTSASVERQYNALRDTAPQSWAQLVGSNGCTADGYCDYSIQRPRNAGDGKVKGFNISFQQPFGDSGFGLTANYTYAAGENNTGDALPYQSRNSIAFSPYYEKGPLNARLTYNWRDSYLAGGYVAGAAPASVDDYAELCASVGYAFSPNWSLQVDAQNLLDEQYLQYLGDKDHLTGRYRSGRRYMASLHLKF

SEQ ID NO: 21284 - protein, 713 aa, Xanthomonas axonopodis
MCSHPQTFAALHSALNSKPQLRHLGNTALKLLLLCPAVGMAQQSLPEVTVRENRLPSHELQTSQPSTTASHVNVPVLDLPASVSGVSSLQMDERADYRVSDAVTRTVGLSTSGAPGNGGLSFSSRGFNGVNSIGIAEDGIMLGVASGTVNYPGDSWGYERIEVLRGPASLMYGSGTTGATMNAIRKQPSRERSTEVLLGAGSHGKAYAGIGAGGALGETLSYRLDAYGDRTDGERELGKASSGKLMSALRWTPRSDLTLDLSADISQQKPERYFGSPVVDGQIVKELRNKNYNVLDAIDQFKDQRFRAKAQWRASDALTVRNELYHFKSDRHWKNIEAYDYQPATGQVGRSDYLEIGHDVQQTGNRMGLDLKAASHQIAVGWDISNAQFTSTSNSPYTGKSTVSAFNPQHGYWDSPDAYLPRINSSLRQNALYLEDAWKISEQWLLMAGMRRDWYAFSRNNIQDGSGFDKPLNGTSWRLGLTHKFDALSSAYVQTSTGHDPVTSLLAIAQSQTGFSLSQGRQIEVGYKQQLADGRGEWTVAAYRIVKDDIITRDPDRPALSVQGGKQSSKGIELTGLIHASKTLRFEGNIAYVDAKFDRLLEGSKGVDRAGNRPSNVPRVTANLWGHYRTGPWQASLGMRYVGDRFGDNANTVRMPSYVVTDAVLSWDMNPRTTLRLVGRNLTNRLYATYAYSGNQWLLGRGRSVELSALMRF

SEQ ID NO: 21285 - protein, 913 aa, Xanthomonas axonopodis
MHSRTTTLAFCITAALYYSGAAMAAGQEQQAAPQAAPNAPSSTTELDTITVTGYRASLEKSQAVKRSANSIVDAISAEDIGKFPDINAAESLSHLPGISVDRQFGEGEKVSINGTDPALNRVLLNGQTIASGDWGGNPTDTSGRTFNYTLLSPEIIGLMEVYKTPEARIDEGSIGGTVIVHTRKPLDLPKNTIRGSIGYNYNDRSEEGNPRGSALWSWKNDDETFGALISATHDKQDLARAGIEYFGYTTGANIPASATITGDGSDVATARVPAGISSAFFQQTRERSGLQGALQWKPNEQNEFNLTGLYIKGKYNNFSQARYVCPNCSSPAADGSLDANGNQVQINNMRLIDRATVQDGVVTSANFADNGLAQPYSQLDTIYRESTVTTKSLNLRHDWSGEKWVFTTQGGYTEATGGKNPEYLMKYLMQDGGYNYAFDGRNTAVNYENGGAANWVLPGNPAGLAPGQVGNVPGTGTPIMQAGGIAYQKSKDDEKYFQWDASRDLEWGPFTKLQFGYKYINHNNGVEARGNRINSTDAVSLTQFNPGRTPSSLYDGLGASGDLTNWSTASLDSVRNYLLSQPQGPYLTDFGASFQVKEITQNVYTQLNFESGQWRGNVGVRLVDTTNKSEFWQSNDGGANFDRVAETNDYRKALPSFNIAYDVTDDAVLRFSAAKVIARPRYADLAGTFTINSGTGDLTANGGNPDLKPYESTNYDLAAEWYFAPSSMLSGEVFYRDISSYIVSTTTTQPLNPAPPARPGDYQVTTPVNVSDAKVTGVSVNYQQTFGLGFGLQANYTFAESDSSSGLNLPYLSRDTYNVIPYWEHGDWTVRVNYSYRSKYFTQIGRLQSRDFADAYKQLDLNASYQITDYMGITFGATNLLDSTYRVFSNTRDTPTAFYKNGRGYQAQLNFKF

SEQ ID NO: 21286 - protein, 1131 aa, Xanthomonas axonopodis
MDPIGLYCLTGRSPRSLRKESQLNVGGEHMSRKPNLAVLTALVCLALAGSALYAQTSFGRISGSVTDPTGAAVPGATIKIINTETQTARTVETDSNGLYAVTNLPVGPYTLEATQKGFQTKQLTGITVIADGRLTADFKLAVGDISQTVEVTAQSGEALNTTSGDLSRVIETKQVENLALNGGNYVELMTLVPGAVVTNPDQFSVTTSLSATNQNINGNRSDSQNLTVDGAFNLVAGSNGSLMNNVNSNFIQEVKIQSSNAGAEYGRTAGVAFNIVTKNGTNQFHGSTFETFRNDKLDARNFFSVQKTKLRYNDFGYTIGGPIKKDKLFFFWGQEWKRLRQNANPSRVTVPSTAMLNGDFSSVAQIFFPGTKNPIPGNNIASLMTPDGKAIAGVFKGQEKLASAFTDANVANNAILQPDNPLNYRQHLVRIDYHINDKHSLYGRWVSDRNSLVDPFGTFSGANLPTTPTLRGRPGESFLLAETWLVSPSIVNEFRINASWASQNIPPYGDTWQRATYGFQFPYVFPAGTGNFRNGIPDVSVSGYANFKGPSFALHSPSTDSQVADSISWIHSPHIVKAGFVMIRDRVDQNGRSSYTGNLTFNSSGNTNTTGNSLADALLGNFRTYSEASADPMGFFRFSQPGAYIQDSWRVNRKLSLDFGVRWEWLQPWYTQANNMANFVPALYNPAQAVTVTSAGTVVPGSGNLYNGLIRAGDGIPSSEVGRVPGSTSSLFGSIPAGAPRGFFQAQNMFSPRFGFAYAATSKTVIRGGYGMFFARPQGNMIFSQLNVPPILLLSQFENGNLANPGGAAGVTAVNGNITAINPNVVNGYSEQMSLGVQRELPKGIFAEVSYVGNLGRHLLRQPNINQIDFALNAANAALPSAQRAANATLVPYKGYSNITQYNSDSTSNYNALQVYLNKRKGNIFFTAGYTYSKALGDSSGQGDNPENYLDRHYNYGPLSFDRRHAFIGTYVWSLPRLGTANPIVRTAFGAWQLNGVIRLQTGQYYTVTGNTSIGGRRADYVGGDVLVSGSAQTINNWVNRAAFANAPDNRFGNAPVGNVEAPGLQTYNLSVSKNFQIKEKFRLRYQADFFNAFNIANFTGLNTNLASAAFGTLPTAYPPRNIQMQLKLTF

SEQ ID NO: 21287 - protein, 218 aa, Xanthomonas axonopodis
MNSFAVAGGDIVPAPVVQENDDAGWYAGLGLAYDRVYSIDKGWFDNSVPTQDEVGNVVGIVGYDFNEYIGIEGRISQSIFEEDYADLFTYSIFVKPQYRFRDKDDLENDDGYFTIYGLLGFGGVNVDGTDGDAPAHPDMFGQEILSDTSFQWGFGISYTFVEQPDDERYALKDTWSVFIDYTSLIKDADIHSTLYGYDPKIYDKLSVDGITAGVTYHF

SEQ ID NO: 21288 - protein, 535 aa, Xanthomonas axonopodis
MRLSMKRLFSALLLAPAIAGVAAGAANANGLSTEQLQKIDAVTPNGITSGQITSITELSDVKPTDWAYQALQSLVERYGCIVGYPDRTYRGSRPLPRYEFAAGLNACLDKVIEFAASKEDLDTLKRLTEEFQAELATLRGRVDSLEAHVKELEATRFSTTTKLQGEVIFSLDAVANTAGNERNQDGAVSFGNRVSLNLNTSFTGKDLLLTRLRARNIETIQQRLSPGFNPSGSRLDYDGTGSPGVPNSANTFFLDKLLYRFPVGDVSFTVGTAGVQPQDYGLSDATFFSGPANTKAFKYVGAGVYADTRDADTAGVGFNWKASKNFSFQAGYINRNSADVSTVNSGGVFGFTPTGTGTNSWDVNAQVKYQTDNNKFRVALAYALRNGRYATDFGTTNAFQPFGATNYNSNNLALSLGWAISDAVTLSAGYGIGFVNEQGTNQNATVQNYAIGLTFPNLFADGNEFGVAADQQPWVSSASNRSSEDTGSFGVETYYKIQVTDNISITPGTYVFNNTNGQQNGGTTYVPFLKTVFRF

SEQ ID NO: 21289 - protein, 970 aa, Xanthomonas axonopodis
MRFSSLAYQSRFSAGVSTAALIAGALLVSATPAAATCDSNNPMSGTSVVCEGPVPDTTGVQGPGSTNVDVSVTGSGGIAVIGDGLSGSAINLSDSAQVVVDRGSPISLTDGKSAISVGDDSSVSGGEILTSGKGTGIEIGDNGTIEVGSILTDGKNSAGISAGDSLTLLLSGGASIETRDEGAGVSAQRNLTATIDGSITTSGSFSPGIQANAGAKISVGKTGTITTAGAEADGILIQANPTDAPITEIADITVAGNIAATGGDVEGTARNGSHAIALIANDSSAEDGVANFGVNASAIVNVLPGGRLFSELAAAIGECIIDPADEQVPIDTRLTIGGEIETGVPGGTAVMLRTGSDTVIITPTGKVVGLVDAGTAEGAISGLDTDVDTFSLGGTGAGTFDVSLLDGDGAVDGDDQYVNFEAFSKIGASDYSLTGTNTEIQRIGVAGGKLRVNGSMPNTAFAVNGGVLGGDGTVGSFVANSGGTIAPGNSIGTLNVAGNATFQSGSVYEVEIAADGTGDQVRADTATINGGTVDVVTLDPYTAYTDGQRYTIVSTANGRTGTFDSLQTTRPSSTTPALHVERRHPRLIRALQFPDVARTFNQRQTANALMQLDQTPGSASNGLYNALLLLDAPTARDAFDQLSGEPHASMKTALIQDSRFVRDAAQDRINGAFGMNGGGDMVQPLGFGPGVPVIAGSGGADVEAWTRFYGAWSDVDGDGNAAAADTDTSGFFVGVDGMVSDTVKLGVLGGYSSTDLDVDARNANGSTDSWHLGLYAGTELYGLIVKGGAAYAWHEIDMVRSVSFPGFSDTLVSEYDAGTGQVFGEVSYDLALSTATISPFAGLAYVHHRTDRFTETGGAAALTASGIDLDTWFSEIGVRGSMLIGTDLSLRGEAGWRHAFEDTTTLEAFRFATSPAYLVKGVAIDEDVGFIEVGADYRLNEWATVGTAYEGQYGSDTTSNSARADLTFRF

SEQ ID NO: 21290 - protein, 252 aa, Xanthomonas axonopodis
MPPDPWWAVSRCQCRHESSRFAPGSLVGGVSPENVWDLSAGVRYSRERGYVAADLFSDYITNMPVALPFTSGTTTYTQYENVGQARQQGVEAEGKLVLGAGFNLSGNFTYLWGVLGNTPVGSLNFAGDMIPFVPLDMGNLALSWDHGPWHITVDERYTGMMNVIDFSGGPTGTGNPMINVPGYFTTDLYASYDLPVVKSWYKSASVYVDAFNLLNTNYYNPAGLEPGPNNLETLFIYPGEPVNVFAGVRMTF

SEQ ID NO: 21291 - protein, 447 aa, Xanthomonas axonopodis
MTSGLSGPTTSDAAAVYWNPAELAGVQRPELVLGAGLIVGHATYQRERRGTYQTPDTLQFKLPLDPANVDASKRGRAEEVSTTPIAPTGNAFLAIPALPNRLTVGVGLYVPYAAALSFQDGAQRWQLRQAFIVSTSLTAAAGLKLTDQVSLGAGVSYVSGLAELSKVQDFGSLKEFHDGLDYLKQDNDFGPNTPSELRELDVLARSISIKEALSHGASFHLGLAFNPNKDLRFGLTYQHSAAMRYKGKFAIDMDHPFFTQDLAEQGLRYKPLVEGDVELSFTLPKRLTAGVGYRVNDKLSLDGLLSYVLYSDIEAFVVEASSPDLAQPKLGITDRVTVTLPRRWNDTVWAEIGAKYKLSEAFLATASVGYQSAASPDSTIDVASPDNHRLIGDVGGVLKLSDRVSLSGDVRVQGILPRTVTGSDYDLGNGEYSLVLATVGGHLKFVF

SEQ ID NO: 21292 - protein, 1015 aa, Xanthomonas axonopodis
MSNQFRRQVLKRTALAVVLGACLANGAVYAQSTTGSIYGSAPSEAGSTIVVQSDTGLSRTITVDANGRYNLGSLPVGAYTVTLKRGDQVVDTRKNVQLRVGSGTEVSFADAGSSSTADATTLGAITVTAANAPKIDVSSTSSRSVITSQQLAILPLGRSAEAIALLAPGAVAGSGAFDNGSRSVVSFGGAGVTENAYYINGFNVSNPLSNLGGVSLPYGAIDQQETYTGGYSARYGRSTGGVINQVGKRGTNEWHFGAQAVWEPKSLASSPENVRFPNNTLPDRFEYTNPDQPGTLYRSRKDDGATRTVYSAYAGGPLIEDKLFVFVAGESDKTEGVSTNSSAASVLGRNNYAYSAPKFYGKIDWNINDSNILEYTRIESTDRRAGYYTDFDYDTLSGGGRSGTFADTYKIKDRYDIFKYTGYLTDDLTLNATWGRSRQDNLQSNPYVSALPYLQNVTNQNPALTGGTPITNDQASNRTKANLPQNKTRSLRLELEYRIGDHDLTAGVDNMYFNASNEGVRTTGPGYQWLFARQSDPTVDIRPSLGVGPSGGDGYYAQRRIFTTTTSMAVEQKAYYLEDRWQVSDNWLVLLGIRNDKFTNFNSAGQPYVDSGDQWAPRLGVSWDVFGDSSLKLYANAGRYYLALPNSVAVRGASASTYTDEYFAYSGLDANGEPTGLTALGPGPVSSNGEYGQTPDPNSFAPSDLKSQYQDEFLVGFEKTLGQSWNSGAKVTYRKLQTAIDDVCDTGRMADKLEASGVSASSVAIPGCVMFNPGETNTYNLANVDGSGRTQVRMSQEDWGFTSGAKRNYVSVDLFLEHPFDEKWFARVDYTWSHLYGNTEGQVKSDLGQADVSKTQDWDSAELMYYAGGNLANDRRHQFKAFGAYQFTPEWMASATLRVLSGTPKSCLGYFGQGEQDPIGYESAYHYCAGTPSRPGDAGRTPWLTNLDLGVTYRPAFADHKLAIGLQVFNVINDRDATRAEAVYGDDRFTVSNTYGMGTYFNPPRFVRLSASYDF

SEQ ID NO: 21293 - protein, 799 aa, Xanthomonas axonopodis
MSSRTPRHPLGPLSLAAGLTLVCSAAHAQGDTGHHHKARRHPVSKNDAASAQTPKALPPKAPTSGSALKTTDNSIVATPEETEHLQVIGSPMNTLQTPIGIGRMPEDVMHTPQTINVVPKLLMEQQNVKSLDEALRNVPGITASVGEGEGGMAGDQFLIRGFQAQNDIYENGLRDFGVYTRDSFNYDHVSVIKGPSSEVFGNGTTGGAINITTKVAHLGDSYSGGFSGGSGAYYRGTLDFNKQIGDSTAIRITGMGNENNTVGRDNVFSHRWGIAPSIAFGLGKRTTFTLEYFHQTDNRVPDYGVPVVTKPGTSIAKPLTEYGLNRNNWYGTTYDQDASNVDMLTARLKFDLNKNITFYNDARGGMYSRYFSASQPGCDTTCATEYFTDPEAATINRRGHLGGPEPYQQNDWSVQDVFSGIAKFSTGSIRHQMIAGVDISHVYDRRTNYAYNFNGQNGTKTDTTSLLHPSATQPGLLLGSLGQYSGNLVNISGVGHAMYKTGDATDVGAFFSEQMWLAPWFSIRGGFRWDHWDSHYSANGGTAGAGVSYGQTQDTFNPTVSLMYTPNSNIMVYFNWAQSTTPLGLYVTNSSEPLKSTTQGFSPERSSLYELGAKYNAFHGRMGFTASVFRMEKGNALMTDPSTGDVSSSSDRQRNQGVELSVSGEILKNWTMIGTYAYYDATTVSSLTAADVGKRIQYAPKNSATIWSTYTIAPNRPWNVTFGGGLTWRDGVYLNATNTAAVPATVEWDAVISHNFGKHWRVAMNGYNLDNRLNYSNLFSDRATPAVGRSFLFNLSANY

SEQ ID NO: 21294 - protein, 1074 aa, Xanthomonas axonopodis
MTHPRYLRMSKLTLGLVAALAAAPVFAQSTSAGVAGLVTGSGGQPVPNAEVTITHVESGTVSRATTDASGRYNARGLRVGGPYTITITASGAGNTTREGVYLNLDKVNQVDAALGGDLATLGTVQAIAGNYGSAIFSANKMGTGTNVTREEIESLPSINRNLQDYVRLDPRVAQTDKARNEISIAGQNPRYNAIRVDGISTNDAFGLESNSLPTPRQPFSMDVIDEISVDVANYDVTISGGTGGVINAVTKSGTNEFHGSVYGTYRENDWSGKNQNNIRPQLFDNEATYGLTLGGPIVKDKLFFFANYEKYKGKGVFTGNSGYGPAGSGASNEVGITQAQVDQVIDISRNVYGFDPGTLALPALDSDSEEKGFKLDWNISDKHRGSFRYGKSEQSTANLNGFGNNQLALNSYHYVRDFELETYTGQLFSDWTDTFSTEAKVSYRDYSAVRTAASQLPAIAVRFGNNTLNLGTEANTQANELRTETWNAFFAGTLFLNDHTVKFGFDYEDNDIYNLYGPRVFGSYTFNSVANYQANLPNAYRYSYSPTGIDNIAAKWGVRNVGVFLQDSWAVNSNLTLNFGLRYDEPMVKNSPQFNQAAFNAFGLRNDETIDGNGLWQPRFGFNYTFDADRPTQLRGGVGLFQGAAASVWLSNPYSNTGLAYTDYNFNNASNSGIRFTPDINNQPRGTSGATQSVDFVDKDLSQPSVWKANLAFDTELPWYGIVASMEGVVTKVKEAIYYQQLNLGNPTAVGQDGRDIYWNANGRNPANWNSLGNACLRETGVAAGSSCVNSGTDIRAGRNMSFNDAIIARPTDQGGSQSFTVGLNKPFNDSDWSWSLAYTYSNAKEVSGLTSSTSGSQLLNTATFQANEEVNATSAYEIKDSFLGTLQWKHNFFGDFATKVGLVYQGRSGRPYSYTFDNDANGDGRSNDLLYIPAARGDVLFRNAAEENAFWNYVNNDQYLSTHKGQVAGRNAVRNSWVNQFDLHIEQELPGFFDGNKAQIWVDVMNVGNLLNKKWGRVDEYAFPGFKGVAEYGGIDAATGKYVYRFNEPDAATVYDDKGISRWALQLGFRYQF

SEQ ID NO: 21295 - protein, 678 aa, Xanthomonas axonopodis
MTSRGVEKAPKNGLFCKKTQTNALNLLLMSTALTCSTAAVAQENNLLDEVVVTASASEVTYKNAPASISVITAEELENQGAKDVRSLLESVEGLTFNRAGNQSKVQIRGLNENYTLFLIDGKRVTSAPNAFRGNDYDSGWVPLEAVERIEIVRGPMSSLYGSDAIGGVVNIITKKETDEWHGSLTTEYTLQENRKSGDYGRTGFNLSGPLLKDKLFMRTYGSWDFRRQDSGSLNPDLPSGRANPGFARSDNKYIDTTVTWDVNEENSLDFNGGYSKRQHDLTTLDRYSAGITHHGSYEFGETELRAFGDRIENSYGHGNTSGKNEPNTAYNFTGDGKVSFDADFVVPQFITIGATYQHQSLEDKHVLTGEGGSYNSIWQASTFLEDRFEISDSFEVTLGGRLDRHEKFGWNVSPRVYGVYHLTDALTFKGGWSSSFKAPTLLQLSPGWQQISCGGNCYLVGADDLNPEVGSSFEAGFKYDEVKWSAGVTGFHNTIKDMIPFPPARTPDAVAAKNFSNYVGETPDGKPIFKFQNIEEARTMGIEASLTVRPIDKLTVFANYTYLDAKNISANNAPLAFQPKHSANIKLDYAFSEKLSFALSANYVGEQYTWIPADGNTTFASKVDGYITADFSGRYDVNENFTLRAGVMNIADNQILKEDSDAFNVDGRRYFISGTTRF

SEQ ID NO: 21296 - protein, 938 aa, Xanthomonas axonopodis
MSSSRPAVVPKRRVLQTTRLVNALLFALAVAAVPAAAQQRGDGADEATQTLDQINVTGTHLRRVDAETASPVVVIDRQRIEDSGQNTLGQLLQRLPMMAGFQTGPALNSNFSHGRALVSLRNLGPERTLVLVNGHRMAGPASSVASAPGVDVNAIPAAMVERVEVLTDGASSVYGSDAIGGVVNVILKDKYDGFAATADYAQSTHGDANRRTLGLEWGKTWDRGGLIVGLSQNSMNPVFNRDRSYAAKAVEYLDGQVSEVRGANTRAFLTDGRVLTPVDGVAPGPVGEEAFRPYNRATDSYNVYDAQYLITPIKRTNASLHGSFDFTPSVQGYMDVFWTRSKTVSRLDAYGLEMPDAVDNYYNPFGDQLDAYYLRSPQANTRVYTSTMFQTNVVAGVRGRVDGSSWQWDAAAGHARYKDTLVRTGFSITSALNNAVGASFLDSDGVVKCGAPGAVIVGCTPINVFNPSDPATIAALRGTQRPVDLIDESQMRFVDISANGDLFKLPAGRVQAAVGLVYRTNKFAQGTTSDVAAADADGNCDYNDGCILKQGREESVREAYAELLVPLLKDVPFANVLNLNLGSRYSNYDAWGNTTNSKVAIEWRPIANLLVRATGSQVFRAPALGDLYGSPYNSVIDNTGDFQDPCTGFTGAPNPACANVPNDGSFTNAAQFNVVTSGANNVGFKLKPERGRSYNVGLVYDPDQVRRLSLNVDSWRVVLDDMLTGVGYQQVVSDCFDGSEAAFCPLIQRNATGQLTRVSVPFAYNSGKVDIRGYDAGIHYTLADTAWGTFATGLDATFFSSYRFAGDPHNYVGENSSWGNMPRWRAVANLAWDNGPWHASWNARYLGRTVNGSQYENFCVDTNADGSCAYFPIGSVVYHDASLSRKVASLHSTLAVGVDNLGDRKPPRFYSYSNAANTEASTYDTLGRYVWSRLRVEF

SEQ ID NO: 21297 - protein, 374 aa, Xanthomonas axonopodis
MPMKVWTMALGGLALGAGAAAAGDIERSQQSVGILFEEGRYAEFTFGAVNPDVSGSVGGLGSGNMAGNFNTWSLGYKQPLGANMDLALILDQPIGADVDYPDEGLYPLAGTTAELRSNAITALLRYKFQNNVSLYGGLRAQSVEGKAHILFDIYQSGTFVATTDYNLETNRDWSLGYVLGVAWEKPEIAARVALTYNSAIDHTLEGDESGTNAVFGNFSGKSDFDTTVPQSVNLEFQTGIAEDTLLFGSVRWVDWTEFLIDPEIYQYYFPGIPLVAYESDRWTYTLGVGRRFNEHWSGAVTVSYEPQTGDDTGNLGPNDGFRSIGIGATYTHENMKITGGIRYVELGNATTRGVGAEFDDNSAVAAGIRVGFTF

SEQ ID NO: 21298 - protein, 804 aa, Xanthomonas axonopodis
MAAASVSVAAQAQQRTAPRQSGAAGLFRFDIPAQPLPQALNEIGRTTGLAVVFTGKRPFNVTGRPVQGNLTSSQALAALLAGTGITYRFTNPRTVTIDTGEQGGSVRGGSMPAGAIALDTIDVEGAGNPNSTMSLPPAYAGGQVARGGQLGILGNRDMMDTPFNQTSYTRKLIQDQQARSIGDVLNNDPSVAKLYDSSGGFSRDQWFIRGIGSNAASTSFGGLYGIMGTGTSAVAVESLERVEVLKGASALLNGIPPSQGASLGTVNLVPKRAGDEPLIAFTPEYAMNSQLGGHLDAAQRFGDNKEFGIRFNGVYRNGDTPINHQWRETRLTTLGIDYRGENFRLSADVGYHYQHVTGLRTSLSVADNIPVPRPPDSRINWSQPWEFSKIETKYAATRAEWDITENLTAYAAVGRSVAGERAAWNSMSIQDAAGTLSNPYGPYAFTYYMQSSAAETGLRGRVETGPVTHALALAAGWGTQEVGSEYRYSSTLPDSNLYNPVFLPQPDFGVFASPAEAPRASRNENLGFALADTISTLDERVQLMLGIRHQKVKQQSFLSNTLYNADALSPAAALIFKPLENVSLYVNYMEALQAGQIAPSNALNAGEIFAPFKTKQQEVGAKIDFGRIAATLAAFTTAQPTYARDPNTFMFGETGKVRYQGIEVAAFGEATESLRFISGFTFLDTMLVETPDGTNVGKWLPGLPRYRATLSLDWDTPIKDLAVGASGQWQSFTYRDAPNTQRVDSWYRIDLNARYTIRQPGWKPIIVRASIRNVLDRNYWATSNTWYMNLSEPRTFLLSTTFQF

SEQ ID NO: 21299 - protein, 378 aa, Xanthomonas axonopodis
MIDGGRKNGDAYAGQLMVGTDVDLNSLFGWHGATVKAYVTNRHGTNLSNSSIGNSTSVQEIYGGQGTRLANLTLVQKLFDDRLELEAGRSVANIHFLGSDLCQYFQGNSACGNPTFVFRTSNFTYWPVSSWAAHATAWVTPKVYVHVGAYEVNPVQAQDGQHGLKWSTDDTTGVVVPYAIGYKNKGGDGSMAAMYELGGWQDNSDYTDPLRDRNGNPAVLSGLGYENKQGRSGMFARFEQQVTNPDPSGARGLTVFGAILKSTGGQAIEDHFVQLGLVQKGTFASRPQDNIAFVITQQKYSDEAIENLRLARASAGGTGTPADNQIMMELSYGIQVTKRLRIAPNLHYVINPDQFNEPTRSNDLKNALIAGMRIDWNL

SEQ ID NO: 21300 - protein, 913 aa, Xanthomonas axonopodis
MRHHHPHSAGPARKLLSCALDVTVQVGQTATLNLGVGGEPATAAGGNPTTLDAVQVKAPPVLVETRTSENVTYISNVQIQNLPRATRNFLELADTMPNVQFTREANGTTKVRTGATSAEGTNVYIDGVSQKNYVLTGGVSGQDSSRGNPFPQSAIGEYKVITSNYKAEFDQVSGAAIVASSKSGTNDFHGSFFWDTSNDSWREESPLEKKAGVRDDFEETQYGATFSGPILKDKAHFFIAYEAKEYTTPNVVIPGSIYSDRVDQLPVQLQPLVVTSSTPFKEDLYFGKIDWTIGQNNLFELTGKYRKEDELNDVGQTSTYEHGSINGQEEKRANLRWQYSGANVLNEANLSYESAFWNQAPINNGNGYILSYAPVRGNETDILAAGAGSSFQRKGQKGWTFQDDLTLNSLEWHGAHTVKMGVKFNSIDLDSTQFNPANPQYYYNILTDVETPYRVRFGAPLVEGGGSVVSKNKQYGIYLQDDWEVNEHWTLNLGVRYDYEQTPAFLDFVTPSDVASALQNWPNLRNANYTINDFISSGNNRQAFKNAWQPRLGASYDLFGDQAHVIYGGAGRAYDRNIFDYLALEQLNNSFKSYSYYVTSANNGACLGDPCTAWNPAYNNQEGLNTLTDNSTGGGGREVYLIDNNLKTPYSDQFSIGMRNMVPLWGQDWFTDATLSRIESHDGFAFVRGNRLPDGAFFQPGTISEAPTDGPNGYSAIVLGTNGVETGNTQLALQVEKPFDEASGWGLTVAYTYSDAKENRQFGEHYALDRERIQDYGWREAGGIPNNRLVVTGIYELPYEITLSGKLSLASQTARYGQNCLAGNDQCEIIQFKPDGTLGDKEFSIAANKEWDTGGAVKFNVRADILNVFNWVNYATFNGDTGTLQDLNTAYGTPTGVLASPMRTFRLAFGLNW

SEQ ID NO: 21301 - protein, 268 aa, Xanthomonas axonopodis
MLQATPSNPTAAAQIKADGHADVKGSDWGVGYQLAWMWDINDRARVGVNYRSKVSHTLKGDAEWAADGAAAKQQWNDNMLTPLGYTANEKARVKIVTPESLSVHGMYKVSDKADLFGDVTWTRHSRFNKAELFFEKEKNIANGKKSDRTTITPNWRNTYKVGLGGSYQISEPLQLRVGIAFDKPPVRNADYRMNSLPDGNRIWFSAGMKYHIGKNHVVDAAYTHIHINDTSYRTAKASGNDVDSKGASCARFKNHADIIDLQYTYKFK

SEQ ID NO: 21302 - protein, 907 aa, Xanthomonas axonopodis
MTYGGYVYDHAADGYFDTVFSGDTVNGVISTYYLNHDYGTDTANTLNITNSNIHGMITSDQIGYGDYVWTNGSDYTGHDWVDGDIFTLNIANSTIDDDFDAFYFNDTYLDADGKTSKTDYDRLVTAALGTAVTLDVESNINISNNSHVAGITLVQNDLGNATYNTEGHQWDNNIVVNNSTVTSGSLSEDEQSDRGHFGNSVEPSDYGNGASGADDVALAFIDDDTSDYRMVNNVTFNNSQLLGDVVFDSTWNANFDATGHLIDNSTTAYTHGGWATDDQNVDHLNLTLNNTKWVGSANIDYDVVVADEAFYDVAPNSLNPYASYSEDGWNRVDNANAFQSGVFDVVLNNGSDWETTKDSLIDTLAINSGSQVNVSADSSLTSDTITLNGSSSMEVNGEVNTDHLIIDTFSTVNFGEDTASAWTSAPLYANTITVTNGGVLDVNTNMNDISSVFATDTLELTSGNVKDNNGNVYAGVFDIHSNDYILNADLVNDRTNDTSKANYGYGVIAMNSDGHLTVNGNNDINNGDEVDNSSVDNVVAATGNYKVRIDNSTGAGAIADYAGKQLIYIDDTKTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 21303 - protein, 1007 aa, Xanthomonas axonopodis
MALGLLFLTQLTFAQQKTVTGTVTDGEGLPLPGVNIVVQGTTNGTQTDFDGNYSINAQVNQVLVFTYVGFEEQQKTVGSASTINVQLTAGESLDEVIVVGFGEQTRKSLTTSVAKVEAEEIKSIATPTISGALQGAANGLQVNQNSGAPGGAFSVRVRGASSINGSNEPLYVVDGVPVLSGSIGSNAVGGQTNDVIANLNFSDIESIQVLKDASSAAIYGARGANGVVLITTKEGKAGKFQIEINSYTGFQEEIKRYEVFTAGEYFRWADIALDSQFGTDGAGIWSNAFGYTASEEFYNSDFGDTYVDAIYREGSPIVKQIDATLSGGSEKARFYVNFTDFKQVGVLKGQDFDRRSLTFNGNFQASDKLSIDVGTTISQSDNSRVNGDNNIYGALTTSVLEIPGNDLFNEDGTYNTAPFTFSNPLQNALVDQNDSRTFRMFSNLGLTYKLTDNLTLNSRGSLERIDFKELIFTPATTRRGAPSNGSTTKEIRMINRWNVTNTLNYVKNIGDNFNINALGGFSFEGTNIDNTGLNGTGLPAGLMYPASAAVPITADNSITESKIFSYFGRVGLSYQDKLFLEGTMRADASSVFGSGNAIGYFPAVSGGYLISEEDWFKNNVLTNFKARASWGQTGNQSGIGNFGSRFLAGVSGYGPRPGTSIVQLGAPDLSWETTTQIDLGADITLFDRIDITYDYYNKETTDVLLSRPLRNSSGFLSVAANVGEIRNTGHEVSINARILTGEFTWTSQFQAAYLENEILSLQTDAAGEFIPIDAGFATRLAVGQPLGAFYGLLADGLWQEGDDIPQALVDRGVQPGDRRYVDVNGDGNINANDRAFMGNPLPKWTGNFRNTFTYKGFDLSGNFQFEEDKDIFNNSNAFGGASGSVNFNKFRSQLNYWTPENTDTDLPRPRRGSLQSYNNQDSSAFIEDASYVRLKEVVLGYTFSPEMLGRDLSLRVYIGGDNLVTWTDYSGLDPEVNTFGNSNASRGTDFFTQGLNKVYKLGFNLKF

SEQ ID NO: 21304 - protein, 662 aa, Xanthomonas axonopodis
MNRSLFNTVCVAALTFGAAPLTAQETSNDDVFELGTIYIVGAKRPQDALSFPGTVAQADASELSGRGVQTVADLDRVFPGLAVDTRSSRVYSNFTLRGQSSLDYYSTSVQVYVDGLPQDPAVLAQMFPGALESAEVLYGPQGSLYGRGAVGGVINVTTLKPGEGDRFSYSLGGSEESYQAQLRGELQLAEGLWADFSLARNDVGDDLQVMGTGEDVGGTVEDRAQLRLRYAPEGSPLDITFSAACNEVESSEEQFVMGTALAARQAVPFPSKYSHDTNSFGLTVDYDLGWATFSSLTGYQDRFLDRTIFGSYTPEWQETLTQEFRLSSATGGPVEYVAGLFYSNSEFRREAYGSTTTQKTESYAAFGDLTWHATDRLDVVAGARWDFETTDATATGVVTMRGSDDWNAFSPKLGLSYSITPEWQAYGIVSSGFKAGGFTRTLTPANIAYTYDPATTWNGEAGLKYRSNNGTIEASVAAYYSVTEDYQMFVGTAPAQYLQNVGEVTAKGIDATLRINQGPWGLSGGATWGESRFTDYDSSATPGLSYQGNDVPYAPEFTARLAVDYTHELGAGRGRLIPRLGLSYQGDIWFDEANSIGQDGYWLVDAGLAWEMSNGAVLDLYATNLTDETYASYGFDASSYGLGDVYQLGRGREIGIRLTQRF

SEQ ID NO: 21305 - protein, 1121 aa, Xanthomonas axonopodis
MCIFVTAFVYAQQQKISISIKELPLKEAISQIAEKASMNVAYSKEFVDTSRKVSLEVKDTDVNKALTLLLKGTNIGFRFLDDSILFYNKEYQNKTEPIDSQGEKKELYVKGKVTDENTEPIIGATVSVKGSTTGTITDINGQYSIKVPYGSTLRYSYVGYREESVIAKATTINVVMKENAVSLEDVVVVGYGVQKKVNVTGAVSMVKAEAIENRPITNVTTGLQGLLPGVSIVSSSGQPGAVPSINIRGTGTINSSTAPLILIDGVAGGDINLLNPSDIESVSVLKDAASSAIYGARAANGVILVTTKKGEKKERVVFQYNGYAGFQTPTALPELVNGREYMELSNEAMSAAGFSKPYTQEAFDKYDSGLYPNEYSNTDWIDEIYKSRAFQTGHNVSARGGSEKTGFFMSYGFLDQDGLVVGDGYSSKRHNARISVNTEVYDRLKLTGQMSYVDFYKKDLGYSGTSGVFRLSQRMSPLLPVMWQIPDENGRMVDSENWSYGSVRNPLQVAYESGMEERKTRVLNGIFNADLKIIDGLNVGMQYSANIYTRQVDEFNPKMLSYYSDGSPLKANEDAKDYISQSHLDVMTQTLQFTLNFNKTIGRHELGALLGFSQEWENRSTLGATRDNVMVEDIHVISAGMINFMNSGTKDEWALRSYFGRVNYAFDGKYLFEANLRADGTSRFAKGNRWGYFPSFSAGWNFSREKFMEFATSVLSSGKLRASWGELGNQNIPGNYYPYLSPIITEESYPIGASNTPVMGLWQNKIGNPDIKWETIRMLNFGVDLSFLNNRLNVDFDWYKKENIDALVRPDVPAIVGVSSSNVGYVNLGKIDVKGWELNLSWRDKIGNVNYNLGFNLSDARNKITDLGGTPESLTSTASGSYRRVGDPIGAFYGYLTDGLAQVYDFESVNTTTGKYQKPKFPLVASQNGIVQPGDIKYRDISGPDGAPDGVIDDYDKVVFGEKEPHYTYAIKGGLEWKGIDFSFYLQGVGKVAGYLEDEARHAFINDYSIPKKEHLDRWTPMNPNASYPRLYQSQEHNRLFSDYWKEDASYLRLKNIQIGYRFPARMVAPLGINSLRVYASADNLFTKTDYFGAYDPEVRTTSGDVYPQVKTYVFGLSITF

SEQ ID NO: 21306 - protein, 972 aa, Xanthomonas axonopodis
MFARRVSALAMISTMMIGASAAAQEQAEQQDTADIVVTGFRASLDSALGMKRQEAAAIDSIVAEDIGKFPDSNLAESMQRVPGVALARGDGGEGRNISVRGLGAGFTRVRINGMEGTSQTGSSDIYGAGNNGRSFDFNVFPTEIFSALTVRKTPSADVEEGSLGATVDLSAPKPMDQKDDFVLSMTARGVYNELSKQVDPRASMLISKKFGDSGFGILGSIAYQKRNIREVGYSAVDILSANTNGGFCSPLGAPINTAGQTPEQLLLRGVTAENCSTGNPRTSDPAAYQAIQDLRRDDLPNTPGSGAFLPRLPRYLNSEQDQERIGGSLTLQFNPDDDTDISLDLLYSRFEVTRRDNYIAAVSFARSASNNGQPMTSVRDVEFDENGSLVYGAFDGVDVRSEGLVDNFVSTFKQANLNFRRRLNDNLEVSGIVGFNRSIWDGKKRLQTYMDAIDTDGFTIDFRDGGTTPVLGFGIDVNDPASFNYAPGRPDGTVLGGFSYQGKPSKNTTDNMTGEMNLKWTVNDALSFRAGGQYRRSDFKSTFLRPYSADLVMQPLPAGTSLADLTRSITGVDKLWGNGAPSSWAAIDPEKWADTFGFDSVRYCGVECGGGDSRVREEVMSGYIMANFDLEEAIGFGVRGDIGVRYVKTDMRSSGYITVSSATSPTGLGGQFAAATNSYDDWLPSANIVIEPVRNVLVRLSGAKVLARPELGLLTPTSGVNGVTRVGNVNNPFLDPIRANTFDVAVEWYFRPGSLLSAAFFYKDIKSFIQNVNSQIPFNELGLPIELLDGTNTAPTELFTVSQPFNTPGGPLKGIELNAQIPFTFLDGFLGNFGVLANYTHVTSKIDYILASVNGTPTVTTTADLVGLSKNTASGTLYYEDDKFSIRTTGNFRDKFIRGIPASPGSDLQGNAKTFYMDASASYNVTDRLKIIVEAQNLTDEQNRLYIDSQRQDTLFETRIGRTFTFGVTYRM

SEQ ID NO: 21307 - protein, 906 aa, Xanthomonas axonopodis
MSVQHRHIPAGRTVGQRSIRDFRRSVMAISVATLLSAQAYAQDATTTATPASDATTQQLDTVQVTGTRSSVTKAQLVKQNAEQIVDSIVAEDIGKLPDNNVAEALQRISGIQISRNYGEGSAIAIRGLTQVRTELNGRDIFTANDGRGLSFEDVSAELLGGVNVYKNPSADMIEGGLGGTVDLRTRLPFDYDGRKIAGSVQYNYYDLADDGKPAFSGLFSDRWQTGIGEIGILVNYSQQKSPFCQDTISIEPWYTQTDLPGYEGQGVSVPHGAGINTTVGERERKTGAFAMQWRPNDAVEVYTQVLRSDYDFSWHDYSFFALTGANPMQGLPGIQVNNRNEFVNGSFQNVPTESNTSLTERHSVTTDYSLGAKWTVNEKLTLSTDFQYVDATTTGTRYILSTGQVTSPQFNVDFRGDLPRLSVTDASGAEGYLADVNNYNGWRYHLDNKDDNKGTEFAWRSDMDLAFDSDFVRSFKAGVRYTDRDAETKGNIYRFMCINNCDGAPFSQYPGIGVMTNPITDFFRGQSHAFGPTLTASDAAVANYQQTLAAFGASPLEFAPNNINTQNEKTYAAYGVLRFGVDGDIPFDGNIGVRVVRTEVGSQGVRTGTDAEGGGLIPVDAQQTYTDVLPSLNLRWMLSDQLQWRFAASRGISRPTFDKLNPNLSLSTGTSNGASTFTGTAGNPSLEAVKADQFDTALEWYFGQGSMMYGTLFYKKVEGFIANAVFNEVYDGQVWQITRPVNGDSGKIRGAELGYTQFFDFLPGWLSGFGLQTNYTYVDSEAPSPTATDTNGQSLTVPLEGLSKNSYNAILSYETARFQGRVAYNWRSDWLVTTAGNGTGNLPVYNKGFGQLDASLRFNINDVWSISLDGVNLLDTRRESYLGTESRYRDFVINDRRYGLTLRASL

SEQ ID NO: 21308 - protein, 948 aa, Xanthomonas axonopodis
MYPYTYPFLCLISLSIFSQKLDCLAKEKEACSCHEITGTGLIWPRSNPYGIDQVLKRPTISVGNLHNQNSDIDITDKKYFCVNYQYYRGNGGAITARTLNITKNIGPIIFRENITNDNGGAIFSPNCNITYNKQECCFINNMANVMIETSDSRSGGAIKCSQLVISNNIGCCQFLNNTASLSGGAIAADNDINIANNYGAIVLGNNKCFKEKGQGGSIYSANCSITSNYAPINFINNQAGCAGAVYVTGTCKISHNSEIIKFLNNSSLNQTNDPPIRWNPGGGAIYCTSCSITNNPKGLIFQSNSSKRNAGAIYAQNLTIKDNGPILFINNSSTWGAAIQNYNGGRFYLSADSGDIVFKRNLSFKSSGSYRNALHSTANLNLQIGARQGHSVKFYDPIENEHPSPEILIFNPENHHLGTVLFSGADVSPNNTNLESLRSKMRNTSKIAHGVLAVEDSAVLAIYKITQDEGTLRLGNGAVITTTQSAGQPTTVGCTLAFTKLALNLPSILAKGAQAPKIWIYPSENGNRYTEDPNPTITLSGNLSLLNDDNEDPYDSLNLSRSISRIPFLYLCDTTTKKITVDDLNIEAINDQQHYGHQGVWSPYWEEYTTTTNPTSALTANTSHRILYADWTPTGYIPNPEYRGDLVANVLWQAAYNAISGLHNLTTPPPRASRIGIAGGGSGAYVSQKTRNLKPGFELFSRGYSTQASSPIKKTNHNFALSFSQFYSEIKESESKSKVSSNCYFAGAQLQIPWLNENILSSASLGYAYSHNCVKTKNQNTNTLSQGYFQGHTLGSELCCMLPESKISNLQFRPFIKALGIHAIQENFTETGMHIRSFQTKDPLINVTLPVGIYCYTEHVVNLKTIWEMQLAYSPTIYRQKPKITTTRLISKGTWITSGTPVDHHAVSILIKNTTTLLNTMSLSINYRGDFSKSTLCNFLNVTSEIKF

SEQ ID NO: 21309 - protein, 758 aa, Xanthomonas axonopodis
MKLALSSIALAVASVCSSAMAAELQGQVTDQQGNALANARVSVDGGNSTTTNAQGQYQLKIADNSHLHLHVSHANFKHSDQEISSKTGLLIQDVTLSQTPMENIVVTASPLARSALESTTPISVLTEDQLKLNTEPTLGDTLEKLPGVQASHFGAGASRPIIRGMGGPRVQVLENGLSVGDASTVSADHAVTSEAASAQQIEILRGPGTLLYGNGAIGGVVNVVDSRYSETPIDEVTGHFGARYDSANHGQTYNGELNGGNGQFNWHLDGTHRKTEDVDIPGNAIADMPTTHGTLANSQLKLDDYAAGVGYTGDSGFVSVSGARTESNYGIPSRGEADAPNISIDLQKTAWQLHSGLLDPFAGFSKLKFDAAYSDYQHAEEEDGVAGTTFFNKQSEARLSLNNHPWGEWQGTLGLHAVHRDFAVEGDEALTPDSKTDTLAAFIVQERKLGDFRFELGGRLEHYRLTPDSMQLDTLNGEQEYQPNDLTDNNVTLSAGVVWDFSPSYNLGLSLTRAERSATAEELYSYGPHDATQSFELGSQFSLENGQIVANSGSNDKEIANNIDLTLRKLDGAWTGSLSLAYNRVNNFYYERNTGLVASDLVNSDEEGDMPVYQYTQGDADLYSIEAQATIPFNDLWSLGLFSDYTRGKLVDGGNLPQISPMRVGSTLNFDLQQWHAELGAIGYARQTDTADNETETAGYALVNAAATYRWYTSSGDILVYLKGTNLLNQEARPHTSLLKDYAPLMGRNLMLGVTYNF

SEQ ID NO: 21310 - protein, 413 aa, Xanthomonas axonopodis
MRPTLLVTALAAALALHTLPAFAQHTTTPAVTELDGVDVIGRAQTLYKSEDAAVATRTDTPLALVPQSVQVLPRELIDDQAARQITDLYRSISGISFFSYAGVTLRGFRQENVLYDGLRGDPYAGFSVPQLFNIERVEVLKGPAGALYGGGEPGGVINYVTRKPAHQAARRIELQLGNQSFGAASFEATGPARADGRIRYRIGAYADGEDGFRWNTDSQSQIGDASVAFDLGDTGELTLQYTDITQNLGGNRLRGVPVDNAGNFLTDRRWNHNEPTDFLDMRAKVALAQYRFAPSSAWEVDMALRWFKNQEHQIYHEPMGLIDRDRDGTAEWMTRQLRNQYRDNDAISSNVNAIFRTSTGAIDHTLLMGADYYRLDADFRAQTANTADTGRVRGPVPGINLFNPVYGRSGFYD

SEQ ID NO: 21311 - protein, 966 aa, Xanthomonas axonopodis
MGPIHGLVRGKLKMKKTDVARTVLASALAVALTACGGGGGGGGIRPSTPTAPPPTSPPPPPPPTSPPPPTTAPTPPPPTTVPTPQPAFDAHLALTNTRTAQALGFTGAGYRIGVVDSGINGNHPALQGRLSDSFIYVDPRDNNIAVGDVVGHGTVVAELAAGGAVGQWPGGIAPGATLVSARIIADKAPTDDGSGQGNEIDGPLGLEAVHADLIRAGTRIMNNSWGGLYWTDPNVTNPVAQEYRAFVIGNDGLVVFASGNESRTEPSDTAALPSQPGPNGTRPAADLERGWLVVGAVDTANPTQLASYSNACGVTMRYCLVAPGTSVYVGPDSTAGNLSYFYGSGTSFAVPLVSGAAALVWQAYPYFNNDLVRQTLLGTATDLGAAGVDPTFGYGLLNVGKAVLGPARFDWGTVDVEVMTLRSTWANDISGNGGLTKRGSGTLVLSSTANTFIGDTQVLGGTLQTASLQSARVGVASGASLIGSGRIAGTLNNAGTVQVNGATLAVAGNYIQDSTGRLALNVGDRLNVTGTASIAGELQLLGRRDYVVDNASYTLLQAAGGLQGTFGTVTRGPAVTFLDASLTYDSNNAYLALRGLTATAVASTLGLSGTTAMDSAVRVEQAFQQVDVQLLQGSGAISSGFVQAAAALQQSPTGETAADSLRSLSGRAHAESAAMTFDTIDLSRRALATHFDGVSQQPRLLGVWQRALGGPGEGGATSNGFATSGWMMGNDLRMASGAVAGFAFGETRSNSLGDLDGARGRDRQVHAQLYWGTTRGPGYALGQMGFGNVRRQIERSLQFGLDRSAAFSDYSGSYLSGNLETGYRFGDVAASLTPYLGVDYVRLASEGFREQGGEGFGLRAAASTSARTQLLAGLRSAYRWRGLQLGGYAEWQQALSSEGLSLDASFIGVDAWAPLRGMQPARSGGLLGVAASAPLGERGALRFGYEQRVGERGDDRALSLKYSADF

SEQ ID NO: 21312 - protein, 455 aa, Xanthomonas axonopodis
MLASTMMAASPALAQDGNVEERLDRLEALVEGLIQRLDAQQGASEQQQNALMAEREQMRAQSQALLAATQDLQTRQNDLAQQIAAAPPSGGGSSPGKTTFSYGGYVKLDAISQRTSGGQLPNNSILRDFLIPVAIPVGGDASGFDTDFSARQTRFLFKTETDVGSEHTLKSHIELDFNVTEGGNERISNSFVPRIRQAFITYDNWTFGQAWSTFQNVGALPDSLDFIGVTPGTVFDRQPLIRYTNGGLQLAVEQPETVVTDQNGSRVLAGDDQLPDVVARYNWGGDWGSLTATGIVRQLHVSKDDLQGVDDSAFGYGLSVSGKLKVGPRDDFRFMATAGDGLGRYIGLNLVNDAAITNAGELDPIFTYSGFAAYRHVWADDLRSTLAGSYFKADNPVLLTTNQVTDESWNAFANLIWSPVDPIDIGIELMYAERTLEDGRSGNLQRVQVSTRYNF

SEQ ID NO: 21313 - protein, 832 aa, Xanthomonas axonopodis
MQRTLPRHHLIRDRRNSYPLSPMRPLAAAICSAMLGMAFVTATLVPQSAFAADASMSSSKKHYAIPAGSLSQSLYSFASNAGITLSFDPALTEGLRSNGLNGSYAVLDGLNALLANSGLVATPGQSGGYLLSKRPASDSVLPAVTVNSERSATTEGTDSYTSGSMSTATGLSLSQRHTPQTVSVISRQQMDDFNLTTLQEIAKVTPGIYSKGQAVSDQETNYYARGFVLNHVNVDGLPVDVSGFNERNVSADMIMYDRVEVVRGATGLMEGAGAPAGSINLVRKRPTAAPLFNASVSVGSWNNKQLTIDTSRALNESGSLRGRVAASWRDSDSFVDVTNTKNYSVYGILEADLSPNTTLGVGFSQQRTRTDGVFMGLPTYADGRHMNLPRSTFLNNADSFQDRDNDVYFADLETRLNGGWRSKFAVTHISAESASRYANNSRIAGQPLQRSQSDTGWGYSTQQIVADMRVTGPFELLGRQHEVIVGASYRNDTSDAYQTWDSSTSRIVNIGNWNPYANAVSGGPAEPYNWGRKTREKGLYTAANFNLSDAMKLVMGGRFGWYTQDVTGWYETNKKWRRSLDESAKFIPYLGLVYDVDKQHSLYASATQIFQPQSAMDVNGNTLDPLEGTNLEVGIKGEYFGGQLNTSAALFRITQNNRAVRDDQNCPTGGAISCSRAAGEIVSEGVDLQISGSPLPGWQIAGGYTYVAAKYTKDGNPNNIGKPVATDEPRHLFKLYTNYRLSGSLDKWNIGASAYAQGKTSHTDVGYNTVQGAYAIFGLMAGYKVNDNIQLKLNIDNIFDRTYYQSLDYGWSGGLARYGAPRNALLTLNYKM

SEQ ID NO: 21314 - protein, 617 aa, Xanthomonas axonopodis
MAEDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTFSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 21315 - protein, 206 aa, Xanthomonas axonopodis
MARYLGPKLKLSRREGTDLFLKSGVRAIDTKCKIEQAPGQHGARKPRLSDYGVQLREKQKVRRIYGVLERQFRNYYKEAARLKGNTGENLLALLEGRLDNVVYRMGFGATRAEARQLVSHKAIMVNGRVVNIASYQVSPNDVVSIREKAKKQSRVKAALELAEQREKPTWLEVDAGKMEGTFKRKPERSDLSADINEHLIVELYSK

SEQ ID NO: 21316 - protein, 807 aa, Xanthomonas axonopodis
MFHEPLTPCVAKRRLCTVRPPSAVAEQDSPMTSARRFHATPLALALATLLPVVSQAASPAEPVAVAPAAEAATPVADAANATQLDAINVVSQGSTRQVQRISQQDIEQLTPGSSAFKAVEKLPGVQFQSADPFGTYEWSTQVTLHGFDQSRLGYTLDGIPLGNMSYGVTNGLHITRAIISENLGSVEIAQGAGALGTASNTNLGGTMQFYSADPQTTPGARLVQTVGSDATRRTFVRADTGDRDGLSAYLSYANASTDKWKGYGDQTSEQANLKKVYQWGDGNRLSLFVDTSRRKEYDYMDLSLTSQRALGWDYDYLQPDWATAVQMARAYQNTGATSGVANGYPQSLAGLPSDYSWLDASYYAGGELRRDNLAGLSGTFVFGGATLDASGYYNGIRGEGQWVTPYVPTSAQMPLSMRTTDYGLDRFGGTSALKWSWGNHDLEVGAWAENARTTQGRNYFALGNEGYTSLYNVYEAQTPFRRDFLQRYTTQTRMLYLQDTVRLLDDRLTLNYGAKALSTTTRAQSLVPTTALAQGRIRAEDNFLPQVGINYKLDERQDLYASYSKNIAAFGFTPFATSQAAFDRSRSTLEPEQSQTVQVGYRVQDAQFQLSADAYFTKFSNRLLTTSPCTAVQTCASILSNVGAVHSAGADLALMWRPTEGVSWLNSLSWNRSRYQDDYLNNGVVATSGKDVVGIPALMFSSSASYQIGNLRLDLDGKYVDKRYITFLNDSQVPSYWLFNAGARYDFGRVGGVADVALALNISNLTDKRYFASTGTNGYVASDPDGYNQTMVVGAPRQYFMSLDVKF

SEQ ID NO: 21317 - protein, 707 aa, Xanthomonas axonopodis
MTPRLLSAAITAALLAAPIGAAFAADADSERTTDLDTVNVIAKLEAARNALSPDIGSSQFAITADDIDRLPLGAATPLNQVLLQAPGVVQDSYGGIHVRGDHANLQYRINGVMIPESISGFGQSLEPRIIKNLKLLDGALPAQFGDRTAAVVDITTKSGAELGNRGSVGITAGSFGTINPNASLWGSSGRWSWFVSGDYDQNKNGLENPVDSLNPIHDKTHQGKGFADLTYLVNENTRLSLLVGYANNRFQIPNNPGQTPAFDYLGTTDFDSSRLDENQRENTRFGTLALQGTLGDTNYQLSAGQRYSSVAFSPDVAGDLIFNGIASRVDRSNRANTVQADFATPWGGSHTLRYGVYGNFEHAIASNNSSVFPANDDGSQSSNVPLFIPDGSRFHASTYALYLQDEWKIGEDWTVNYGLRGDKYKAFGTTEGQLSPRLGVIWRATDSTTVHAGYARYFTPPASELISTSDIALYDGTTNQQSAGDGPTTPLSERSDYYDLGISQVVTDHLTLGLDTYYRKADRLQDEGQFGAAYIYSTFNYRYGRIRGAEFSADYTNGPVTAYFNLAYSKAMGKRVMTSLYNFDPDALAYTYDNWIHLDHDQKLTSSGGINYAFSEGSKVGLNYLFGSGLRTDTDTVPNGASLPSYFQLNASVGHDFDVDTHPLHVQLAAVNVLNRSYQLRDGGGIGVFAPQWAPRRGVYVSLQQDF

SEQ ID NO: 21318 - protein, 776 aa, Xanthomonas axonopodis
MCCHNSISTDHGSLRPPMPFIKSRKHLITATASSRHLTAAALLSSFSFVAQAQAIQTTTLDKIDVQAEQLKRYSADKPTYGKYTQPLIDTTQTINIIGKALFNEQGATSLTEALRNSPGVGTFYVGENGTTSRGDSVYMRGFDSSSSIYVDGIRDLGSITRDVFNLEQIEVTKGPSGPDYGRTSPTGAINLITKQPFLHNANTASISYGTASQRRITSDLNLIVSPDSAFRLNIMGQDSGVPGRNNVKNKRWGLAPSAAFGLGTSTRVFVNLQYINQNNIPDGGVLTIGLPGYSTPDSTRTQISTAPRVDSKNFYGTGSDFEHVKSSMTTVRIEHDINDKTKLQNTLRWGRNEQSYLLTSYRGNVENLITPDLADPSTWTMNREIPIFKNQTNTILTNQTNLNLTLKTGPIEHNIATGMELTRERMQGYGISSSGRWPAANLYHPDPNVSGLHWAANGAYANGRTDTTAFYLFDTLKLNQHWQLNGGLRWDRYNTDYAALLCDPVRSRIYCNTTPITLNRFNGNTSGTLFGWKTGILFKPTEHSSLYINYAVSQQPPGGSSLDLSAKPQDANNPKYQPQAARTAEAGVKWNSSQEGLQLTAAIYNTQVKNDIVQDPIDLQYYQNGKKRVRGVELSAIGQITDAWSMSAGFTTMDAKVKQGPAVSADGSHTLAYTPSQAFTAWSTYTLPFGLTIGGGARYVGEMKRDSKTAIGTPTYIESYWVLDMVLSYRLNKNLDLRLNSYNLLDKNYVAAINKSGYRYAPGTPRAFLLTANFHL

SEQ ID NO: 21319 - protein, 1071 aa, Xanthomonas axonopodis
MRKDMKKCPNQTLSYGIRRTPIVLGLSAALCMPAAFSYANAGGRMDSESVQSVLQTHTVKGTIVDETGEPLIGVSVIVKGQSTVGTITDFDGNFVLDIPTGKGMLEVSYIGYKTQTVTIGKNTQITIKMEPDTQALEEVVVIGYGAVKKRDLTGAVSSVKNEDITLTPATNPMQALQGRVAGLDITQASGQPGEGPKLQLRGTRSFTASGDPMFIIDGMPGDYSTLNPNDIESIEVLKDASSTAVYGAAGANGVIIITTKSGKAGKININLNAYVGFNGWATVPEMRSGDSYINVLREANQIAGTYSTDEALFSSPEAYKAHLNGQYIDWADELLQTGVTQNYSLSVSGGTEKTKAYFSLNFSDEQGQFTGDNYKVYSTNMRIDHEIKKWLSVGVNMQGSYVYRNKAYSRFINSLVSVPLGTVYNEDGSINVTPVPGDGNTINLLLNQDKSVYRDNNQNFKLFLNPYIEIRPFKGMTIQSRLNASLGYDKKNYFQGIGSYQYYASDGPNASGTSASVYAQIDQNRSYNYKWENIFTYNFNIKKDHEFTVTAVTSWEHNQTDKSWQKQDNIKNNSYLWHNMDGTGIVYSNYTMSKGLGLVGRINYSYLGKYLFSASVRQDGSSRLAKGNKWSTFPAVSLGWRISDEKFMQGTSNWMNNLKLRLGYGVTGAASIDPYSSVATVELDGYYSLGGQKTNSYKFSENVANADLTWERSHNWNIGLDASFFNNRIDLSADYYITNTDGVIWKQNLPVVNGAYNASKLYYMSKNIAKTQNHGLELTLNTRNIVNKEFTWTSALTFTLNNEKVKSLIGGTADHVKNEDYYLSIGYPVNSFYAPKIDGMWQLGEETDAAAFGCAPGDIKINVPGMIKEADGKFYKVGDDGQPLTDKNGDIIYYTKDNKYTYSDADSQVLGHNAPKWTMGFQNSFTYKNFDLTIYAYFRWGQMINYEMLGWYDSTGKGNFPTYFNYWTESNPSNDFPALNANRETKSYIGYGSLNYVDGSFFKIKNITLGYTFPERLLKNAGISKCRLYATITNPLTVAKSHLLKDYDPEMNGALKYPLSKQLVFGVNVSF

SEQ ID NO: 21320 - protein, 725 aa, Xanthomonas axonopodis
MHVETMIRTASLLGCVALTVLPTSEATAQTELPAITVADTKPTRKKRPKPVRRPPVQPQAAAIPAPVPPGETTPPPPIPPIPPTFASQSQTTNAQILSRGGASLGDTLGTTAGVSATSFSPVASRPVIRGLGGFRVRTQENGIGSADMANLGEDHAVTIDPLTAGNVEVIRGPGTLRYGSQAIGGVVSATTGRIPTAVPANGVAFEARGGLNSVSRGADGAVLLDAGGGNFAIHADAFARQAGDYRIPGGVQENSSYRSDGHAVGGSYIFDSGFIGVAYQEMAMTYFIPGIDSAKVKNHIDLHQSKWTSRGEWRIGEYGLDAIRYWFGATDYKHNEINGVGAAAQIGSRFKNEELESRVEVSHLPFMTALGEWRGTAGMQWGQRNLSVAGATEPLLALAKARNIAAFAFEELQLTHALRAQAAVRIERTQIDGTGAQFPASFLPPPDQPILFPVDRSFMPVSVSTGLLYELPSDIVARVTLQHVERAPDPIEMFYKGPHDTPRTFEIGDPNMKLEKADTVEIGISRKRGATRFDASIYASRYRNFIFKNFTGVRCNETFASCGTPGASYDQIIYSQRDARFVGGEIEIEHDVARLWNGVWGLGGQYDIVHATFADGGYVPKIPPQRLGGSIFYRDADWSARVSLLHAFAQTHLGAFETPTPGFNLLNAELSHTHKFVKAGLPVTLTVGLKGENLLNADIRLHQSYKKDEVLQPGRNVRLFASMKF

SEQ ID NO: 21321 - protein, 216 aa, Xanthomonas axonopodis
MACSFFINTAYAWQQEYIAEAAPGHTTERYTWDSDHQPNYNDILAERIQSTQNTVGPVLSLAAETPLDATSGISMGWNFPLSRRVTTGPVAALHYDGSTSSMYNEYGDSATTLAFTDPLWHASVSTLGWRVNSQFGDIRSWAQISYNQQFGENIWKAQSGLSRMTAVNQEGNWLDVTVGTDVLLNPHLAAYAAFSQAENSATDSDYLYTLGVSARF

SEQ ID NO: 21322 - protein, 786 aa, Xanthomonas axonopodis
MSPLNLASPPPPRRLKRLPLALLLAGSASWTHGYAAETETPVPAPAGKTATATSQLETVTVTTRRREESSQDVPTPMSVVSGTTLETQRVYRIQDLQQLVPSVNVAYMHARQSSVSIRGLGNNPASDGLEGSVGLYIDNVYLGRPGMAVFDLMDIEQLEVLRGPQGTLFGKNTTAGVINISTRAPSFTPERSIETSVGEDGYFQTKGTISGPLNDVLAGRLSAYRTRSDGDIKNEFNGHDLNGGSRDGFRAQLLFKPNENFNLRWIGDYNEEDSSAGTRVLYNTGPTINGVNLYSARAAAAGATLVNGSHRKVNLDNDQHVTVHQGGTSVEANWTLPSDFTLTSVSSYRFWNFTPRNDDGLNVPATYNAGVSVEDKQYSQEFRLASPKGEFFDYVLGAYYFGSDLDNKSFAYYGPQADIWNGTPRGALANVNSVGRGHIKTDSFALFAQGTWHLTPRLDFTAGVRGTYEEKNAWVNRDAPVGGAAVTGAAATARRGRTGAYDSGDLNQYSSSPSGLLNLSYRFTDDLLGYATLSHGEKSGGVNLVVGSAPTAGADSLLIGTERANNAELGFKSTLWDRRLQLNANVFWTQVNAYQTNAYDDVNRVQYLTNAGSVRSRGVEFESTVIPLRGLTLNFNGSYNDVSYLSYKDAPCPPEVSQAPGAPASCDLSGHQVVGASKWIGNANGKYEWNLDNGLQPYVTGSYAFRSKAVGTVEDSDYGQIPSYAVVNLSTGLRGDFNQGQWDVSLWLKNAFDKTYYTTLWTGGNGGYEGLLGTPRTLGVSGRYDF

SEQ ID NO: 21323 - protein, 632 aa, Xanthomonas axonopodis
MRTRVVTRDEAERRGATNVGEALDGELGVQVNPSAYGALGNPSAIQIQGFDLDRVLVLEDGERVIGDAGGAIDLSSLPLGDVSRIELVTGPTSSLYGTSAIGGVVNVLSAPPEHPGFSGRARLEGRSRAGLVLQGSGAYRGERAWVSADASFQREDSLSLVEPAENLAHPEAGADAPTALPERSQTLLGLRAGAALGRDIDLRLRARWIHDAQDGIEQQERPVLGVYLYDLPEVTDRITLHLAETLDLGGGSSLRLAAGQQWAFRSSGRDQRGSPYEELRERSGTLQSYEAIATVADGKRTWVAGARAEVETLDQVLKTTAVTTSGTEEIPPNDEVPSTRLGSAALYGQLGWKLTDELTLMPGVRGELRVRYGGVVAPRLALAYRPSPSLTLRVSGGRGFRAPSAKELGFSFDHSSLGYILEGNPELAPETSWGVNGDVTWIPREGITARAGAFSNWVDNLIDVDPKPVSSSAGVDTYTYTNIAEARTAGLDLSATLQATPWLRVEAGYAYLWTRDDTADPGQPLSGKPPHTAQASLRADLPLRIELVTRLRTISGAFVERGPRAEEDVYAPGFTTLDARLARPLWPSSQAYLGVRNLLGAQKAPDRRGDHRPLEGRTFYVGVRADLPWEDS

SEQ ID NO: 21324 - protein, 412 aa, Xanthomonas axonopodis
MKIRNSDVVQLKNRCSLIHNYMKSHLFATLNPLSKRGCRWSGRILLAILPLAGSSLLGETREFFGEVKEGRLSSYVSENVRFSGRLHPQFDYLESELKGTSVADPETAQRDFFRRVFAGVKVDLSRSLRVNYLTDVSDRIVKNQIARLEWKPGDANKIYIGYQKVPFGFEDTMSSSKVKPIERSANTRFWNEVVGIGSYHSGVYYYHDYGQGMDSVLGLAHNVKSESDWPDVLDGDVSLYARFTKEGKSDYGSFYQAGVDVGYQPYGDGRQVLAASFFGNLSYSGYELALEATGGEIGLVEGDAAKAFGWHAQVSRMWGEKWEWVARASQIDTGGYQLKLSSAIRKAPYSGFKYEQVDSIYFGGNYYMKGNSVKFSVGYELAEGRDALSGSGVLDGVSEVVSGFRARGQLLF

SEQ ID NO: 21325 - protein, 702 aa, Xanthomonas axonopodis
MHLTPLKSGPTRRFVTAALLMAYTLPTMAQTNNDQMEIVTVTASRSEQSLNASTASLSIVSEEDLLTISHIHISETLSRVPGVWVSRGNGQEHLTAIRSPVLTGAGSCGSFTVAEDGIPVRATGFCNVNQLFDLNTEQAQRIEVLRGPGTVLHGSDALHGVINVITKAPASDQETLSSLEAGSNDFYRTKLSQSGTNGDHGYRLNFNGATDGGYKNDSGYDQQKITARHDFNRDNISIQSLLSINNLNQETAGYVQGKDAYKERDRKRENPNPEAFRDTQSYRLQSQLTLALDNGGSFIATPYARYTDMDFLMHFLPGTPLEQNGQKGIGIQTAYRRPINQDLMLTQGFDAEYTDAFLKQSQKGGFSSFPKGQQYNYEVTAKLLAAFISADYELLPTTILSAGSRYEYLEYDYDNRMIDGNTAEDGSQCVNGFTGAIGCRYTRPSDSTDDFDNWSVNASINHQINDALTGVVRLAHGFRAPQATEMYRLQNGQLTANLDSEEINSLEIGLRGAAENISFSLTTFFMKKTNAIFQSSDRLNLADGQSEHYGLEYDVAWQLSSQWHINIAGTFARHSYSNNVSTPGPSSAVIIPSDGNDIDTAPRHMGSVQLGWTPTEDVRAELEWLSMGKYYTDIDNLHSYGGHNLLNLRLIQQLSKNISIGLRISNLTDVDYAERADYTGFNGDRYFIGEPRSYHGNITYTF

SEQ ID NO: 21326 - protein, 509 aa, Xanthomonas axonopodis
MAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSIQLMAQGSRTTLDSRYQQFRQGENPVGSLGMFGGYSGGYQRYDNNEADGNGNHNNLTVGVDYQLNEQVLLGGLIAGSLDKQHPDDNYRYDARGFQATVFSHLRAGQAWLDSDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLS

SEQ ID NO: 21327 - protein, 368 aa, Xanthomonas axonopodis
MTQELRKVIEQQQKVLKDLERRLDATEIRVEKTADVVDAAAESKSATTLGGYGELHYNNITNNQSGKDKKEFDFHRFVLFVGHEFNDSTRFFSELEVEHSISGDGKKGEVELEQAYIEHDFNQMLTAKAGLFLMPVGIINETHEPPAFYGVERNPVEKNIIPATWWEAGVNLNIKAAPGLAFDGAITSGLYVDETYSIRDGRQKVSKAKAEDLAYTARVKYTAIPGLELAATAQYQSDLTQGAGDVDSASATLLTAHVIYSIQGFTVKALYAQWDIDGREAEILGRDEQNGWYIEPAYRFNDSFGIFARYNEYDNKAGAGSRIDTNITQTNVGINYWLHENVVLKADYEKLGGYKDSDGFNLGIGYQF

SEQ ID NO: 21328 - protein, 705 aa, Xanthomonas axonopodis
MTALRSSRFSLFALLLAVPAGAEEIPLDMIEVAGRLREGPPPGLALSAPARSGSRLGLTPLQTPASLDVISGETIRARGQTTIADAVTQNATGITSIAHPGNGNLSFTSRGFAGPGSVQQLYDGTRLYVGAGTVTFPFDPWSAERIEVLRGPASVLYGEGAIGGVINVVPKKPVFTPVNEAQAALGSDGTARLALDSGGPIGEAMAYRLNISGNRADGWVRPDGDFRNLALSGAVTWRAAPDLSLTLSHDLGYNEPTRYWGSPLIGSRVPERIRFTNYNVADARMAWLDNWTQLRTEWSPSPDVTIRNTAYRLSAERHWRDVEQYTFQPATGLIRRSDYIEILHHQEQIGNRFDATVRGSLFGLPNTVVAGFDVNRIAFDRDSNAPFEGVSFVNPFLPVPGSFLNLAGTRRDIISRVNQASVFAEDRLELTPQLALITGVRFDAPTVSVARPLAGTAFTKTFESLSYRVGAVYNPVPDLALYAQYATAADPLGSLITTTVSQAQFDLATGRQVEVGAKGIFAGGRGEWTLAAYHIAKDNLLVPDPDRPGESRQVGRQSARGVEAALSFALDDHWRIEANTALLQARYDAFSERVKGQVVSYAGNVPKDVPQRVTNVWIAYAFAPGWVARLGLNNVGPVFSDFANTARRPGYTLVNASLDWQVTPDSRLSLRGYNLTDRIYAVSGNTNSWLLGPPRSVELAYQVTF

SEQ ID NO: 21329 - protein, 835 aa, Xanthomonas axonopodis
MTRASPKPPQTNRRPPRHRKKTTAHEPFPQVQVTEKESHLDSPFSGPTFMTEQPTCLTPLARTLRHLLLGASLSLASLPLVQAAEAQAQSYHIAPTSLENALNQFGRQAGVLISFGSHVTSGVQSRGLQGQYSPQEGLNVLLQGTGLQARAEGSNAFSLQPASPEAAAQPLHLGASSVVGDWLGDAQQSDVFEHPGARDVIRREEFERQGATQARDVLNRIPGVNAPDNNGTGSHDMALNFGIRGLNPRLASRSTVLMDGIPVPFAPYGQPQLSFAPISMGNMDAVDVVRGGGAVRYGPQNVGGIVNFVTRAIPDTPTVKGGFQTETSPSSSHDGFKTTGNLLAGGTADNGLGGALLYSGTRGGDWREHSDTQIDDLILKGKYQLDDANSFNAMAQYYEGEADMPGGLNVADYKADPYKSTRPYDKFWGRRTMFNVGYRYQEDRREFTVNSFFTKTLRSGYLDQGSFLSLSPREYWVRGLETRFAQGFDLGDSSHEVGVGYRYINEAGHELRYRTPLTANQQLPTSNSRNDRDTRGGTEAHAFFVDDRIDIGKWTLTPGIRYEMIESQQSNNLTHVKYKGDYNTALPALNVMYHLNESWNLYANTEGSFGSVQYSQMPNRVASGEVKPEKARTWELGTRYDGGTLRAEIGAFLINFDNQYDSNQTNDTVIARGETRHQGIESSVSYALDGLAPALAGFDVYATYAYVDATIREDGPNKGNRVPFSSKHKGTLGVSYTEGPWKLNLDSSYQSSQFADNANTRAESADGSTGRIPGYMLFSTRAGYDFGPQLSDLNVAVGVKNIFNHQYFTRSFDDNNKGKYVGEPRTLYVQTSVAF

SEQ ID NO: 21330 - protein, 922 aa, Xanthomonas axonopodis
MQFRTTNRKTPVTLLALSIGLALSGHAAAQDAAQTPAEPAVDLDTVTVTGYRASVEKALDIKRGEAGVVDAIVAEDIGKFPDLNLAESLQRIPGVVITREAGEGRAISVRGLGPEFTRVRINGMEALTTVGAGDQSGGTNRGRGFDFNVFASDLFSQLIARKTASADVEEGSLGATVDLRTARPFDYSGFTFAASGQAGYNAMAEKANPRVAALISNTWADNTFGALLSVAYTEREVLEEGSNTGRWANGPSNGGFSATSPFAAARSADVYHPRFPRYTQQIHDQQRLGVTGSLQWKPSDRTTLSLDMLYSKIDAKRDEHYIEAISFSRGGNARPVLVGKPATVVRNGEIRNNAQVYGEFDNVDIRTENRHDEWNTEFKQISFDVEHRFSDDFSMNARIGTSRSAHENPVQTTIIMDKYDVDGYSYDYRGNNRAPVLNYGINPTDPTGWELAEIRLRPQTVDNDFDTGQIDFNWNISPGFRLKGGVLAKNYTFSTVELRRANELSVPTFANGTRIVPADLTEQAGLKGINGSPAAWVVPNLDAVADQFGIYSNSGTFAVAPRVNNSRSVEEKDRGVWLMGEFSTDLGSIPFSGNFGVRYVRTEQESTGYALINNAPALTTVGRKYNNTLPSFNLVAELAPDLLLRLGAAKVMSRPGLGSLTPGVTVAVAGGARTVAGGNPDLDPIEATNVDLGLEWYFNEGAMVGVGLFYKDIESFIQTAREVRPYSSSGLPASLLEGTGASVNDDFAFSIPLNTPGGELKGVEANYVQPFTFLPGKWANLGVQLNYTWVDSQIQYLASSGAPVMKNDLLGLSRSSWNATLFYEGDTFAGRISATNRDDYLTQAPGAEAGFNVDGVHGMTGTTILDASLRYKISKQLELSLEGINLTNEASDEWVSSPRTGQLPLQYGETGRQYLLGLRYKF

SEQ ID NO: 21331 - protein, 918 aa, Xanthomonas axonopodis
MAAAAAFAPPAAPVHARMPACVLPCSVHSRTGRFAIQAPETARFYRVDARPNAVSFPPASRSHGSRRPHRSRHQTTPARSTRRSARPHRFNDPPPPGPPHRTFRSITTPRTRCDRPKHSFTFALQIQTRTILIHRRSCLECRLKSNRNNSRRRAHFRSALRPGHIARSNRMTNSRSDELKLGKFTTLCGVLAAGPALADGAPPPAAAAPGAHLPPIEVKGKAEHSYKADFSASAKFTAPLVDTPKSVTVIPEELIRSSGAATLTEALRTVPGITFGAGEGGNPLGDRPFLRGYDTQGSMFVDGMRDTGATTREIFNTERIEVTKGSDGAYGGRGGAGGSINLITKAPHLGTTASASAGLGTDRYRRFTADGNWQFADHTAFRLNLMSHNNDVAGRDAVNNERWGVAPSIAFGLGTPTRVTASYYHLSTDDMPDGGIPYFYTASNKPANVGTIYPASVDRRNFYGLTDRDFRKTTSDISTLRIEHDIAPALTVRNTTRYTESTQDYIWTQPDDSQGNVIGGKVWRRNNNRNSSINSIANQTELFGEFRTGPLKHSFTTGIELSREWGKRDTYTVATDKGTICRKGIGAPSGYNCTSLWSPNPSDPWAGSVTANNDYAHARTTTKSIYGFDTIELTPRWQINAGLRVDDYSTRFVNTRASGGKTYTRDDTLVNWQAGLVFKPARNGSVYASYATSSTPAGMLLGEGSETQSLTPGRGGVGSNADQMSPEKNRSIELGTKWNVLNDKLSLNAALFQIDTTNARVALPNNQYAMVGNRRVQGLELGVAGQLTKAWQVFGGYTYMKSELRDNGKDTANNGHRFPNTPKHSFTLWSNYDVTPKFTVGGGAFYMSEVYGDTANLRAVPSYWRFDATAQYRINKTLDLQLNVNNLFNRTYFDQAYPAHYASIAPGRSAFVTLNARY

SEQ ID NO: 21332 - protein, 809 aa, Xanthomonas axonopodis
MSRPLDTLLRPSLLAVAIALCAPLASPALMAAEQSTSVRAYNLSAAPLASTLNQIASQAGLALSLNPSLAAGKTSAPVKGQFDAPGALREALRGTGLQLEHSSAGTYSLVATPEGVVALPQTNITGQQAGESAWGPVDGYLATRTAAGTKTDTSLVEAPRSISVATRQQMEDRNVQNLDDAVRYMPGIVSASYGSDTRYDWMRVRGFEPTQFLDGLPLPRGVYANPKAETWNLDRLALLRGPASSVYGQTPPGGLLDMVSRRPSADTSHAVQIQYGSDNYRQINFASTGKIDDEGQFLYGLSGVVRDAGTQVDHIDNKRYNIAPSLTWNIDTDTKLTLLTQFTRDDTGATSQFMPIQGTKIKSPLGDVSHHKNLGDPDYEFYDRTYYALGYAFEHRLNDVWQFRQNLRYTKSELSFQQLTVGSYAYSPADAAGNISRTSTNVDEDIGQFAVDNNFQADFTTGDISHTVLLGLDHQRTDTSYLSIYGNGGTTNIFNPVYGQSIVRPSRADAYYDYDQKTIQTGLYVQDQMALDNWRLTLGGREDWVHQGTTYLNKKDVTNTDRSKNFSGNAALSYVFDSGVVPYISYAESFQPASNASVSPTESYKPTEGKQWELGVKYQPPGSNTLLSAAVYDLTQKNVLVTSIGAGGESITNQTGEVKVKGLELEAVSDVTENLKVIAAYTLAKSEVQKGIYKGNRLQLMPNQQASLWTDYTWHSGVLDGFGIGAGARYTGNTYGDQANTWLGKADAYTVFDAAVHYDLGRLDNSLKGASLKLNATNLFDKDYLSTCDGSYCYFGDQRSVVASATYQW

SEQ ID NO: 21333 - protein, 450 aa, Xanthomonas axonopodis
MSTASTLSRATLLAVGIAGVLAVGQAHGAAFQLKENSAKGLGRAFAGSGSAPDDASIIANNPAGMRQLDGRLFQADVSAISFSAKYQGEGGSYANGAPISGGNGGDAGMIAPVPAAYFHVPFGENNNMHLGTSLTVPFGFKTEYDRDWTGRYHGTKTELQAIDFNVAFSYDVNPYVSFGASVFAERLDIDLGNAVDFGSILAARRVPGFAPGSADGYSRIKGDSTEVGFTLGGLFSIDENTHIGFSYRSEVEHKITDGDADFSASGTGGTAALAVLAQAAPGTFIDTKGRATVKLPASATASFTHNVNEQWSIMADVTRTAWSKFDQVTVDFASNQPNSVLDFSYRDTTFASIGADYRMSETLTLRGGVAYDQTPTTAEHRDVRVPDASRKWVSLGLSWRPSQQAEYNFGYTHLFTSDPTSDTTTATGNALAGSYKVHGDVLAASINYKF

SEQ ID NO: 21334 - protein, 995 aa, Fusobacterium nucleatum
MDSQKGDMSALKTSLYNAQVSSNVTIPKDTREEDGKVAGVNVGLLEGEGVKVAILDSDFQNAVRSSAKNEDGTAAIVRRTRALNVIFPGTEVDIIPRITSEVRAKDGTLIATTPTTSQHGEEVLEVLRDMDSSGGPYYNRIHTILGSFGLDFYDPDESKNLFGAVLANKETYDAALTRFGNQSVKIFNQSFGGNKAYDDSSLAQYRNEGDSLPLYFNKVVGSTAPQVKQVPYFRDIVENKGGLFVWAAGNDAGKNSSLNAGLPYFEHRLEPGWISTVGVLDEDNGKYYVLGRGNYELSKAGFEAKWWSISALMYSAKNSQETDPNKKVGIGSSYAAPRVTMAAALVYEKYPWMTNDQIRQTLFTTTDKTELTEDPDTLSEAKLRNVTAFPDYTYGWGMLNTERALKGPGAFTDISKYGDTTIFKANIPAGTESYFDNDIYGEGGLETVGSGTLHLTGKNSFAGGSTVTSGTLEIHQVHASPVTVKAGAKLVLNPKAIVGYDVGRFELIENIDPQKITDSGIKVKNYGTVAFKGSTAIIGGDYVGYSGSTTELNFLSNVKVLGDIKYEPNTTVKILSNGYITKQSSSNTVMEGKSIEGKIANVEAQGMRKANVEVKDGKVVATMSRQNPVEYIGENAETSSKNVAENVEKVFKDLDQKVLSGTATKEELAMGATLQKMSTMGFTSATEMMSGEIYASAQALTFSQAQNVNRDLSNRLAGLDNFKNSNKDSEVWFSVLGSGGKLRRDGYASADTRVTGGQFGIDTKFEGTTTLGVAMNYSYAKANFNRYAGESKSNMVGVSFYAKQDLPYGFYTAGRLGLSNISSKVERELLTSTGDTVTGKINHHDKMLSAYVEIGKKIGWFTPFIGYSQDYLRRGSFDESEASWGVKADSKNYRATNFLIGARAEYVGDKYKLQAYVTQAINTDKRDLSYEGRFSGSSVKQKFYGVKQAKNTTWIGFGAFREISPVFGIYGNVDFRVEDKKWADSVISTGLQYRF

SEQ ID NO: 21335 - protein, 619 aa, Fusobacterium nucleatum
MDERGQSLRPAKHPGQAAGGHQAGHVERLGGNGGKPHAGIPGYRRRNRGVDRVTMIVRLFILLFLSALMLFPPWALADADRVVLEEEEIKAMQAQSIEDVLNRTPGVKASSSSISIRGSYKVKVLLDGRPINDATHAGSVRWDLVSLESLSRIEVLKSGGVEYGEDASGGVILISTGSIKTFSGRIKGYGGNYGGAYGSASVQAAQGKLGVGFDAGCERTDGFRINNDKQTLRAGARLQYKASDKRTLSLSGNIVDMEQGYAGLSEYPTPHSRNDQSQGSLLLDGKIDSLASKTYFNFGDSENTDHSKNLDSILRSTEWGQKFLFQANDGPLQGMSVGAGGKCIRAQGTGFGGHDEHGFFAFAKKGFPLGSLPLSLSLGLRGDYYSEYDPVLNPEAALMWTIGQRTFQAKANLSANTPTIRQRYSKSSTTNPNPGLGLENVQSCSLSYQDETAPWLHWGATLFANFIRDRITYVRHGAMGQYQNFGETSLKGGEANVKLIPCRCFSLAASYTYLEAKDDETGLWLTCKPKHKVKCEAAFQPWDSLLMGLSVNYYSRQITLTDNSEQVSEYATADFRAEYKHDSFSLFGEVENLADKTYLYGDGYPGWPRTWTAGASVGF

SEQ ID NO: 21336 - protein, 191 aa, Fusobacterium nucleatum
MTVKNNIYLFVLFIFAQLTLSTSAVADETTSQKGWFSTFTDNVTQTWNEPEHYDLYVPAITWHARFAYDKEKTDRYNERPWGAGFGQSRWDDKGNWHGLYLMAFKDSYNKWEPIGGYGWEKTWRPLADDNFHLGLGYTAGFTARDNWKYIPIPVLLPLASIGYGPATFQMTYIPGTYNNGNVYFAWMRFQF

SEQ ID NO: 21337 - protein, 385 aa, Fusobacterium nucleatum
MKVKEISCAAALSLLGVGHAYAQSSVTLYGIVDSGVTYISNSGGHSVWKLDSGINQPNVWGLTGREDLGSGLAAIFKLEGSFSLANGNMTMAGKLFDRDAYVGLTSNHWGTVKMGQIYDYLYRNVTFYTNVVQFAPAYSFHLSYDIDRLAGEAVANAVDYDTPNYRGLQAGVMYGFSNGNSNHVLSTGLSYAPQGLMGPFSGSLAYTRTNGSPSPTTDATIAQIVFHSDKVYTVAAGARLQVANNAYLNAVYSYTNLTLPLGSSMITQDFELGGTYAFAPDLHAGVGYSYFMQRGVNVRGLTPTQKFGIASAGIHYLLSKRSSIYAFGTFQHAFAGNQPAGNFLVTDAPVFGPVAGTGIGPTGAAAGFSSSSNQAAVQIGIKHMF

SEQ ID NO: 21338 - protein, 816 aa, Fusobacterium nucleatum
MDAAREGAPAMHPFPTRSCYRMNCKTSPLAVAVVLALSFSASTASAQSQAPAQKTLDTLIVTGTRVADRTVAESASPIDIISPQALESTGTTELATALSRAIPSLNFPRPAISDGSDAVRPAQLRGLSPDQVLVLVNGKRYHSTALINLNDTQGRGSSPADLNTIPIAAVERIEVLRDGASAQYGSDAIAGVINVVLKGSGEGGSINGRYGKYSAGDGEQYQLSGDAGFSFAGTGKVHLAAQAGHSDQTNRALPFQGRVEQRYGDPDIDQGALSFNGEYSPTDYLTFYSFGMVSRREVLSNGYFRFSGDNRNRPEIYPDGFLPQIYNVSKDVSWVGGLKTSTEGGLNIDLSYNYGQNNLTFDVRNSLNNSLGVTSPTDFHAGTLEVTQNVLNADFTKTLDWGLAYPVTLAFGAEWRGEKFNQSPGDAASSANGGIPSANGSLIPGAQVFPGFKLSDAGYYNRNSHSVYADLEADLTEKLSAGLAGRYEKYSDFGDTATGKLSLRYAFTDKVAVRATASTGFRAPSLQQQNFQSIATQFLNVAQPNGTVTAIPFEIGTFRTDNPAAIALGAEPLKAEESKNYGLGVVLQPVENLYITVDAYRIDIDDRIVLSENLTSNAVRNYLQANGFPGIGGGRYFTNAVDTKTQGVDAVGTYRWNLDGGSVELTSGYNYNKTEIKRIADNPAALMAIDPSAVRIGRAEIGRITEGTPLDKFFLGGTWSPGNWSFTGTATRWGEFSTFGTNAGSDQTYAAKWTLDLAASYKLGAWNFTVGGDNVLNEYPDRQQAGLGTRTYLPYSSASPFGFNGALVYANVNYKW

SEQ ID NO: 21339 - protein, 215 aa, Fusobacterium nucleatum
MFKKIIRMGVFGVSALSVIAAHASGIYVTGQAGYANNHLGKHLTQLFQSRANGESPGFTMNNIGLAGRLAIGYQVNPYFATELGYLRLENQKGRAFDNPPPYLAPATETLKQNAIDVAAKGILPVTDKLNVYGKLGVAYLTSTITSHFGDVKDNQNAWFGVKKHIFAPEAAVGASYNLTPNVFVDTSLTHIQTIGYKHKPGNIDFATVGIGYTFG

SEQ ID NO: 21340 - protein, 218 aa, Fusobacterium nucleatum
MKKGLIFVLFALVSIVSYSQLSWNAKVGMNMSNFTGDAFKDSKMRIGFNVGVGAEYQFTEMWSIQPSLMFTQKGTKMEESEEGITATAKLNPMYLEIPVLAAARFAIADNQNIVVKAGPYFAFGIAGKWKTDIEGDLGGISVEDVLDYLDIPKEADLFGSGEDQMDMKRFDFGIGVGVAYEINKFFVSLDGEFGLTKLVDGDGAPKNMNFSIGVGYKF

SEQ ID NO: 21341 - protein, 614 aa, Fusobacterium nucleatum
MGLSAWALSGALAVVGNQPQGDGRDQAEEDIIIVDGTRLPQSLAETGTAISVLDRTDLERRQSPFLVEALAAQPGVTVNTNGAFGGTASVRLRGAASAQTLLVIDGLPVNDTAAPAGGYDFSRLGTAGIKTVEVLKGPQSVLWGADAIGGVVLVNTVTPRREGISGTVGAELGSFATRSGMVDLELGGSSGGLALIGNALTTDGISKADEAAGNEESDGFHRAQWLIKGDVDLGAHATLTGSFFGSEARTDLDRFDASAVGSVADGDDYDEAAEQGGQVRLNLGGDGHLFAHEFTLGTWRLSRDSFSGGQLSFSTEGERQLYRYLGKGKLGQRNRIALGVEQEKTSVETEDATTDSLFLLHEFRASDRLTLTIGGRIDDDSRFGSETTTRIAAAYDVTDALTLRGNWGEGIKAPSVFQTTYVCTFCGLTEPNDELRAERAEGTELGFDWDPAYFPATLSMTVFQQSFDDLIDFTFTDGYVNIDHVETVGGEAAVRLVPLPWLTVDGAYTFLDTEDEAGDLLIRLPRHSGDLALIGEGTGRLSGALFVRYNGEEQTVSGEDLPAWTRVDVTATYALTDDLVFYSRIENLFDEEYQQVLGYGTPGRSGFIGVKVEY

SEQ ID NO: 21342 - protein, 1050 aa, Fusobacterium nucleatum
MLTIFIYFILIFLFFCRRYTHMYMYETYCIKSLTWDMYGFYSWLVQYSIKVFSRNKVFIIFSSFLCVYLTAGEAFSISSIKRGYNSPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDSSSSGSLLGSFQDLSSESSFDDGHNPSPPPPSLVDLSLGDSQDLGSDLSLGDSQYLGSDSPSSDLSLGDSQYLGSDSPYSSDSGEEDNSSFSYTHDGISRRPCILSEFDGVNSSTSSIDTVVVTQPKGFSENHACLDTVKAVCVGATAGGAIGCGIDWICSCLGISSNVGLYSACGTCGCSVGAGVGCVICCVGHYWKELYKKDRLCLASPNSVLGKCDSHTDSRSSEGSSSEKNHSTITQTQQCSNTEKNKLLGVDKTTAFLLPGYNYKGQVCSLFGIQHMLLDTSKRISTTVKMLGMKACSSNITANEHTRFGSHFRRLASKKSKHIFSGITNNIPYRITTSLDSYCSNMEYKAASGQMGVLFDLWPTLTAGFIYGRHNDRVQKTNGMQGDLKSSSVSTRKKLDSLSAVVAWNTKKNGFIGHIVTYYGWGTVTNIRSVPHADCMVKTKGTSEIQSIAGLIQLGYNLQLSSEIVCIPYVEYMFSSIRCAGYQEYTGILPSKFTRNNEQTQEKSIGLRSQYKVSQNSQLQGWISYVSGQYHFAEFKSTLLGIPNIRYSVSIPSYKKEYSGTEIGMIHESKLTSRCTIGAHMIIHLYHNSVYNMYTGAQIRYHY

SEQ ID NO: 21343 - protein, 406 aa, Fusobacterium nucleatum
MKTKSAVIGGAGAAALLALAAAGGAQAQDAPREFKGAPEFEFGDFTIKPRGRIYLDQVWQEVDRETLSPVDLKDTRMRTARLGVQGGYGEHWSYVAEVDIKEDGAVDWEDLYVEYSPTDGAAFTVGQFKTVSLENLTSSRYITFMERGAFADVLGVGRTLNAQARVGGENWSAAVFVSGDNINNPEVPSGRPTGSEEQYAYGARVAYAPVVTDTTKVHLGAWVRRRDRADQANFSYGARNNTNFGSRYVTTGSVGVRDTQVGLEGAVVRGNLSLQGEWANARVERFGDVEDDVRAWYVFASWFPTGESRRYNAADGEFGRIKVKRPVTQGGMGALELAVRYDSADLTEVSGVSTAGEYSAWTLGANWYPHPYARLMANYTYSQNDNRLAGLDVDVQTFQLRAQFDF

SEQ ID NO: 21344 - protein, 295 aa, Fusobacterium nucleatum
MIDTQYSLAATQAAIPSEPIAPGAAGRSVGTPQAAADLPQVPAARADRVELNAPRQVLDPVRMEAAGSELDSSVELLLILFRIAQKARELGVLQRDNENQSIIHAQKAQVDEMRSGATLMIAMAVIAGVGALASAVVGSLGALKNGKAISQEKTLQKNIDGRNELIDAKMQALGKTSDEDRKIVGKVWAADQVQDSVALRAAGRAFESRNGALQVANTVIQSFVQMANASVQVRQGESQASAREGEVNATIGQSQKQKVEDQMSFDAGFMKDVLQLIQQYTQSHNQAWRAAAGVV

SEQ ID NO: 21345 - protein, 700 aa, Fusobacterium nucleatum
MPYAYADTSDNQKKSTKDIEIINVVGAKDLHDKRYKTPAMNTATGLDLSYLETPQSVTSVTRQMMQDQQLNSVIEAMTSVAGINARPMDNDRYSISSRGIAVTSILYDGVPTTYDTRFNYGDNLIDTAIYERVEIVRGATGLMTGAGNPSAAINLVRKRPTQEFMGSTSVSVGSWNNLRGMVDLSSGLTDSGNIRGRVVAAYQDKESFQDRYQQQRTTLYGIVETDISDSTLLTLGADYQDTTPEATMSGGLPLFHSDGSRTNYDRATSTAPDWASAHTQGLNSFASLEHRFDNGWELKGTYSYGDNSLEYNVLWATGYPDPVTNLGATAGSIAYIDGSRTQHNLDLRAQGMFALFGQEHQLTFGWTGQRQEFANPYYYPTAAVPPLGDFRDPNFQYPKPQWKETHTTGSFGETEQSAAYVATQLNLTDALALLAGLRLNQWQTDQNNFGSLYDFNVDNELTTYLGLTYALTEQYSLYASYTDIFAPQTLQRIDASYIDPVKGKNYEAGIKASLMDESLDMSLSVFEIRQDNVGERTGDVLPGTTIPVYREVNGTQTQGFEFESTGKITDDWNIYFGYTQFSTDDPKGNRINTTSPRQQLKLFTTYTFSGDWNKLQLGAGVNWQSRVYQTVNSPLGRVEVEQDSYALASLMTSYAFTEQLKLSANVHNALDKTYYSQVGQYSQFQYGTPRSVSVNLDYRF

SEQ ID NO: 21346 - protein, 787 aa, Fusobacterium nucleatum
MKADAHPDTRSLIGKTLAAGQRRPLRTITLAALLTSSSQLCFAQSATPGATITLDTIVVEQRREAVRAPARPRSVVRRAAPATTPSAAPTASATQTVDLVRERFNVLAGGVALVSQKDMPNAGNPTLANTLSGVPGLIIQNFLGANDQPRIQMRGSAQQNPAERGVLVLYNGLPINRADGSYVVGFANPRQAEAIEVYRGYMANRLGATVLSGAINFISPTGSSQPGVQMSVSGGSFGQINSSAQIGTKKDNVDAFLQFDTTRRDGFRDYNSSDRTSLNANVGIALSENVKTRFFLGYTDLGFDVAGPINKDALFANPRQTATGPTVVNGVAINPGPNAVRDKPRRDASQFMIGNRTTATFDAHLIDIALGYTYTDDTFRFPISSGVRATKGGDFTGLVRYAYNPADALLPLFETTAQYSVGSADRDYYLNQSGMTGAQFGSNRLDAQTLSLFAGANVPVWQQWTVSPAISYAYATRDNDDRYTAATRPTIAYNPSKPTVLLPNGSVPTQDNGYARSYSGWNPSLALSYRPDATQTFFIAGSHSFEPPTHDDLIATINGTPNSSPGRPTPPSPNLKAAAFATPNLSAQTAVTVEGGWRGRADRFSWDVVTYYSWIDNELLNLRDVTGASIGAINADRTTHFGIELGAGVRFTDKLSGRLAYTYQDFRFVNDPLRGNNKLGGAVPHLIYAQLQLQATDAWMVQGAVRWSPASVPVDNMNTLYADPYAVVDLRSEYRINKTFRVFGEITNLFNKTYAATSLVVDQARPDQAAFLPGDGRGFYAGIKASF

SEQ ID NO: 21347 - protein, 465 aa, Fusobacterium nucleatum
MAIQNDISSVFATDTLELTSGNVKDNNGNVYAGVFDIHSNDYILNADLVNDRTNDTSKANYGYGVIAMNSDGHLTVNGNNDINNGDEVDNSSVDNVVAATGNYKVRIDNSTGAGAIADYAGKQLIYIDDTKTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 21348 - protein, 657 aa, Fusobacterium nucleatum
MKKKFMLLALIALGGMSAFAEESPVLELKQTVVTSDSFGTPVRETAKNMTVINAKEIKEKGAKTIADALKGVPGVVVRQMDGTSPTIDLRGSGATAQFNTVILLDGVPVSGLAGFNLNTVPIEEIEKIEVLQGAGAVMYGDGAIGGVVNIITKAPTNKAVYGGVGLEVGSWRTIRENVYLGGKIGDKFLLNASYSGNTSKDYRDRSPQYENKKDKRDSLWLRGKYLLDNGSIAVNYNHSEDKDYYTGSLSKKQFDDNPRQIGSWSGYTYGINDIINAKYNQKINDKLDIFLTGGYYNNKDKFQNNSTSEYFIRPEVKVTYAKDSYVTLGLDYRDGKRKFKDDVLINGVTQKAPDDKRESFAGYVMNKSTFGNWQFTQGYRREKVKYEYSSKVYDPMTWQLKEIKPKSADYASNDSFEFGVNYLYSDTGNVFFNYTRALRTPTIQDAGAWYGPVKTQKNDIFEIGLRDAYKNTSISTSVFYINSKNEIYYDKTNPFSSNNQNFDGKIRRIGAQLSLAHYFDKLTLRERVSYIVPKVTSGIYDGKEFAGVSRWTANVGATYNIIKGLTANVDGYYQSNAYAEDDFDNYFSKGNNYVTVDANLSYAFENGIELYTGVSNLFDKKYANAVTSTRSTFGAGPRKVYYPANGRSVYAGIKYTF

SEQ ID NO: 21349 - protein, 744 aa, Fusobacterium nucleatum
MATTSVFAQSGKITGKVTLKDGTPVSFANITLANTPMGTASDEKGRFTITNVPYGNYTLKFSAIGYASNSQTISIKSLVNTINIEVAENAEELDEIVVTGTMKAISRKESPVPVEVYSPSYFKKNPTPVLFEALQIVNGVRPQLNCAVCNTGDIHINGMEGPYTMVLIDGMPIVSGLSTVYGLNGIPNSMIERVEVVKGPASTLYGSEAVGGLINVITKTPENVALFSADVMATSWQEYNADLAVKFGKKNATSLLGVNYYNYSNPLDNNGDGFTDITLQNRVSVFNKWNFKRINNRVASIAGRFIYEDRWGGQMNWTPQYRGSDQIYGESIYTARYELMGAYQLPLDSEKIMANFSYSHHDQNSVYGDMWYIAQQQIAFGQLVWDKKISKSHDALFGLALRYTWYDDNTPATRIGDENSGTNKPDEIYLPGIFVQDEIKLGNKHKVLLGARYDYNSEHGSIFTPRFNYKWTPNKNNIFRLSFGNGFRVVNLFTEDHAATTGARDVIVTEALRPERSVNVNLNYQKFIPTSVGVLSLDATAFHTRFSNKIIADYETNDDQIIYDNLDGYAVSQGVSLNLDFAFTFPLKIMAGATLMDVYAMEKNAVGQLERNRQLLTENISGTFAISYTFSRWNLSIDYTGNVYGPMRLPILENDFRNEFSETYSLQNIQITKKFNNGLEIYGGVKNLLNFTPPANSIMRAFDPFDKTADDPVNNPNGYTFDPTYVFAPNQGIRGFFGVRYSIR

SEQ ID NO: 21350 - protein, 309 aa, Fusobacterium nucleatum
MDFSTPVLKHVEKHIQHRIHFMNTTVYQSSRYKGGAYTTSHLIFNPKIGKFEILVNASVSFGNELNKTFEELGFNSLPSADDLEKDTKDVNETGRKYLLEAYAGLKVKRAGVYAGILDTTSFFDTNEYANDEQNQFLNTDLVNNPLAVLPSYNPGLILNLNLSHNFSLQFGWAQGDPDTESVYLMQFGFSSEDYHVYFYYTHSPFEEVKSLGISSDYTFENLGFFFRFGKNNLEDYKYFVSGGSVLNLGKEEIGFGYAFRKGNKLKDVNVLEIYFKHVLSSYLHITFDYQLIDDVRNTYVLGFRLNFEY

SEQ ID NO: 21351 - protein, 384 aa, Fusobacterium nucleatum
MNGDTYKKGKLMKQTTRLAVIAGGAALAFANQYAAAQSSVTLWGVADASIRYLTNANAKNDGLLSMANGAITNSRFGIYGTEDLGGGLKAVFNLESGVNLQNGGFADSGRLFNRAAYVGLQSPYGTVTLGRQKTPLFDLLADTYDPLTVGNYLENAWLPVALGGGLYADNQIKYTGKFAGLTAKAMYSTGTNYESTGAGGFSGQIPGSLGKGNAWGVSLSYVAGPLSIAAGAQQNSDNSARKQTIYHANVVYAFSKAKVYAGYLRSKDDTGFVDSLLAQQSIPVAKGTGRIDDGPFAGVSWQVSTPLTLTGAFYYDHMRNAMTTNGTLASGNRYAIVGIAEYALSKRTEIYGTVDFNKTNGAANVELPGRSNQTGIAIGLRNIF

SEQ ID NO: 21352 - protein, 859 aa, Fusobacterium nucleatum
MKLGHFSYLGIAGIICLLCSESVQAQGKEKLVQIHLNREYTVPKEGTKAEVPITQIPQISDIQRPHTSVKDWLTQLQNQVILVTGVSLNTRENSLEVTLETSSSDHLQTVVKSEGNNFIVDIPNAQLKLSSGELFRQEKPSAGITDVVVTNHDANTIRVTVTGETSLPKVELDDSDKGLIFVVAPVTTSTQQPQIPDTPPTQPSAQDDQPIELVVTGTRFEVPIQDAPQSIQVIPRQVLEDRGVVRLDEFTDNVSGIQRLTGGAGPGSSGFIIRGFADDYETLRNGFRTQGGFARDLANIDRVEVLKGPAAILYGSGFQSGTVNTITKKPLEDPLYEVKATFGSYSFYRGEVDFTGPLTQSGSLLYRLNASYQNEGSFRDFGRYAGTFIAPALTWKLGDRTTLNIDYENFTYESVSAGAFRADPRFFNVRRSFYQGEPDLDLETYSANSLTYEFEHRFSDNWQFKQTFNRIWQEISAKRASRRALQADGETLNRRYTVADADVNNLTFRNELFGKFNTGSLRHNLLFGVEYSHLDYPGKSFSTAIDPINIFNPRYGARPTGELSLDYFETYGNDVVGIYVQDLIEVLPNLKIAAGVRFDSSTGSNENLQTNTIINEVSDSQFSPRLGIVYQPSDTTTLYASWSNSFTPQIYGRNSRGGAFKPITSEQLEVGIRQELFDRRLLAGLALYQITRQNVVTDDPNSDDFLDRIQTGEQRSRGIELDISGEISPGWKIITTYAYTDAVVTKDNEIPVGDRLGGVPYNSASLWTTYEIQKGNLQGFGGGFGLVYVGDRANTIPNEFTTPSYLRADAVLFYRSDRYDINLNFKNLSNLKYFDTNSYGDSLSVQEPFTVIGSFSYRF

SEQ ID NO: 21353 - protein, 344 aa, Haemophilus gallinarum
MKKTAIALAIAGLTAASVAQAAPQANTFYAGAKAGWASFHDGLNQFENSQNADGTLRNSVTYGVFGGYQITDNFAVELGYDDFGRAKSRQGGETVIKHTNHGAHLSLKASYPVLEGLDVYARVGAALIRSDYKPTKRAAPNQTHEHSLKVSPVFAGGLEYNLPSLPELALRVEYQWVNKVGRVEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDTVKGRKALIACLADDRRVEISVKGEE

SEQ ID NO: 21354 - protein, 348 aa, Haemophilus gallinarum
MKKTAIALTIVALAVASVAQAAPQPNTFYVGAKAGWASFHDGLNQIEYVSKTSFGSKRNSVTYGVFGGYQITDNFAVELGYDDFGRAKVRANSKTTAFDAAKHTNHGTHLSLKASYPLLDGLDVYARVGAALIRSDYKLYAPLINKRLSPHFKITQVSPVFAGGLEYAFIPELTLRVEYQWVNNVGKFEYADGQYADFRPDIGSVTAGLSYRFGQSVYVPEVVSKTFTLNTDVTFGFDKADLKPAAQNVLDGIYGEIAQLKSASVAVAGYTDRLGSDAYNLKLSQRRADTVANYLVAKGVAQNAISATGRGEANPVTGNKCDSVKGRKALIACLADDRRVEIAVKGNK

SEQ ID NO: 21355 - protein, 192 aa, Wolbachia endosymbiont
ISDEETSYYVRLQYNGEVLPFKTRIDGIEYKKGTEVHDPLKASFMAGGAAFGYKMDNIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 21356 - protein, 195 aa, Wolbachia endosymbiont
ISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGASFNKEAVSATKEINVLYSAVGAEAGVA

SEQ ID NO: 21357 - protein, 318 aa, Salmonella pullorum
VKNQGVKNQGVKTKTATQIADFGSKIGFKGQEDLGNGMKAIWQLEQKASIAGTNSGWGNRQSFIGLKGGFGTVRAGNLNTVLKDSGDNVNAWESGSNTENILGLGTIGRVESREISVRYDSPVFAGFSGSVQYVPRDNANDKDKYTHMKSSRESYHAGLKYENAGFFGQYAGSFAKYADLNTDAERVAVNTANAHPVKDYQVHRVVAGYDANDLYVSVAGQYEAAKNNEVGSTAIGKKHEQTQVAATAAYRFGNVTPRVSYAHGFKAKVNGVKKASYQYDQVIVGADYDFSKRTSALVSAGWLKEGKGVNKTEKTASM

SEQ ID NO: 21358 - protein, 342 aa, Salmonella dublin
VKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTADEHLYGNGDRATVYTGGLKYDANNIYLAAQYSQTYNATRFGTSNGNNKSTSYGFANKAQNFEVVAQYQFDFGLRPSVAYLQSKGKDISNGYGASYGDQDIVKYVDVGATYYFNKNMST

SEQ ID NO: 21359 - protein, 944 aa, Acinetobacter sp.
MDVKRGSEGIVDAINAEDIGKFPDSNLAESLQRISGVSIDRQNGEGSRVSVRGFGADQNLVLLNGRQMPVTTGSRSFDFANIASEAISAVEVEKTAKAENPTGGIGATINVLTHRPLSSPGMKATFGAKAVDDSSTDKGSTTPELSGLYSNTFADDKFGISISGSYQERESGNQQAQVGTGWRSFPGIVDQDYSGPNAEWGGVPKNDNQVNRPGDDDVYSVPQTTIYRFEEQQRKRTNGQLVLQYEPIDSLRATLDYTYMRNDIDTQTHDVSAWFNFVPSQENIWSDGPVSSPLVYSETYDAPADLSMAAGDFGTRDQSGSLGFNLAWEASDNLTLNLDYHNSYAERTPNNVNGSTSNLSTAAFIRTSAATDFSGDVPVLAVGGGNAVRPEDMRVTGSTFTNAVNRSEIEQLQMSGKYDLAEAGSIDFGIAMSDVNNHSQQVDIQRNDWGGVGAAGDLDAAWFPTSSVIDKFDGSKGNFAGYNGNASTDPLNTMFLWDFEAVRARAAELYATNIVGDCGNGFCPSTDYSKGTDRFTEEKSQSAYIQYNFASEIANMPYDVHFGLRYEKTDVESTSVVSSYDTATWIAESEIALTSSVDNNRVYQTQKGDYDYLLPSFNFNIEMLEDVFVRAAFSQTIGRPDYTSIQGGTTVGTLAYRNGGSGSAGNPSLLPLESTNYDLSTEWYYNDASYVSIGYFRKDVTNFISSNPENSDIYNIPDPAHGKYVDEAIAAGATTAIQQRQWIYDKYGATDPNVKINPDNGNIEITGNPGDPSLNFLITNPTNSDLSNVIDGWEFSIQHFFGESGFGIQANYTMVDAGDSYDNTNLGRPGDATQNVILGISDTANLVGIYENYGFSARIAYNWRDEFLNSTGQDTGSNPKYTEAYSQVDFNIGYDVEAVEGLTIFIEGLNITNEATRVHGRATEQVLNYTQTGARYSIGARYTF

SEQ ID NO: 21360 - protein, 393 aa, Bacteroides fragilis
MMRLKSIVIATTVLLGSATASIAAGSDNIDTSANTNSATTQSSGFAANNFIAPFANTYSALTNKDNTWGPQDRTGQWYLGVDANGLARTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 21361 - protein, 726 aa, Salmonella choleraesuis
MGMKVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLISYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 21362 - protein, 344 aa, Haemophilus gallinarum
MKKTAIALVIAGLTAASVAQAAPQANTFYAGAKAGWASFHDGLNQFENSQNAYGTLRNSVTYGVFGGYQITDNFAVELGYDDFGRAKLRQDGETVGKHTNHGAHLSLKASYPVLEGLDVYARVGAALIRSDYKPTKRAAPNETHEHSLKVSPVFAGGLEYNLPSLPELALRVEYQWVNKVGRWEKDGSRVDYTPSIGSVTAGLSYRFGQSAPVVEPKVVAKTFALNSDVTFAFGKANLRPEAQNVLDGIYGEIAQLKSVQVDLAGYTDRIGSEAANLKLSQRRADTVANYLVSKGVAQEVISSTGYGEANPVTGAKCDAVKGRKALIACLADDRRVEISVKGNE

SEQ ID NO: 21363 - protein, 345 aa, Haemophilus gallinarum
MKKTAIALAIAGLTAASVAQAAPQANTFYAGAKAGWASFHDGLNQFEDQENAQGTLRNSVTYGVFGGYQITDNFAVELGYDDFGRAKLRKGGETVIKHTNHGAHLSLKASYPVLEGLDIYARVGAALIRSDYKSTKRAESDYVMHEHSLKVSPVFAGGLEYNLPSLPELALRVEYQWVNKVGRVEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDAVKGRKALIACLADDRRVEISVKGNE

SEQ ID NO: 21364 - protein, 344 aa, Haemophilus gallinarum
MKKTAIALAIAGLTAASVAQAAPQANTFYAGAKAGWASFHDGLNQFENSQNADGTLRNSVTYGVFGGYQITDNFAVELGYDDFGRAKRRQGGETVIKHTNHGAHLSLKASYPVLEGLDVYARVGAALIRSDYKPTKRAAPNQTHEHSLKVSPVFAGGLEYNLPSLPELALRVEYQWVNKVGRVEKDGSRVDYTLSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDTVKGRKALIACLADDRRVEISVKGEE

SEQ ID NO: 21365 - protein, 344 aa, Haemophilus gallinarum
MKKTAIALAIAGLTAASVAQAAPQANTFYAGAKAGWASFHDGLNQFENSQNADGTLRNSVTYGVFGGYQITDNFAVELGYDDFGRAKRRQGGETVIKHTNHGAHLSLKASYPVLEGLDVYARVGAALIRSDYKPTKRAAPNQTHEHSLKVSPVFAGGLEYNLPSLPELALRVEYQWVNKVGRVEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDTVKGRKALIACLADDRRVEISVKGEE

SEQ ID NO: 21366 - protein, 344 aa, Haemophilus gallinarum
MKKTAIALAIAGLTAASVAQAAPQANTFYAGAKAGWASFHDGLNQFENSQNADGTLRNSVTYGVFGGYQITDNFAVELGYDDFGRAKRRQGGETVIKYTNHGAHLSLKASYPVLEGLDVYARVGAALIRSDYKPTKRAAPNQTHEHSLKVSPVFAGGLEYNLPSLPELALRVEYQWVNKVGRVEKDGSRVDYTPSIGSVTAGLSYRFGQSAPVVEPKVVAKTFALNSDVTFAFGKANLRPEAQNVLDGIYGEIAQLKSVQVDVAGYTDRIGSEAANLKLSQRRADTVANYLVSKGVAQEVISSTGYGEANPVTGAKCDTVKGRKALIACLADDRRVEISVKGEE

SEQ ID NO: 21367 - protein, 389 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 21368 - protein, 392 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 21369 - protein, 391 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTKNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHK

SEQ ID NO: 21370 - protein, 377 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 21371 - protein, 391 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 21372 - protein, 196 aa, Neisseria meningitidis
GFGPISDEETSYYVRLQYNGEILPLFTEIDGITNATGKEKDSPLKASFIAGGGAFGYKMDDIRVDVEGLYSWLNKDADVVGDTVADNLTAISGLVNVYYDVAIEDMPITPYIGVGVGAAYISTPLKEAVNDQKSKFGFAGQVKAGVSYDVTPEIKLYAGARYFGSFGAHFDGKKQDPKDATKQVIDEGAYKVLYST

SEQ ID NO: 21373 - protein, 163 aa, Neisseria meningitidis
THRQLIGACHASFESQTVGSALSFYFPLKARTNNRLTVIPFFRYQAFASKQNDFKEKGARVRSFVTPDSLVDISVPFGLHNKLAFHGYFPSLWELEVSYKPTLLRQKHLVGSVLVADDGTWISSPTEVCYHAFSINLKNETQVFKHLHINFDYQCDASSSTCS

SEQ ID NO: 21374 - protein, 393 aa, Neisseria meningitidis
MRKKLTALVLSALPLAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 21375 - protein, 395 aa, Neisseria meningitidis
MRKKLTALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 21376 - protein, 391 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHYTTVYNATTTTTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 21377 - protein, 320 aa, Helicobacter pylori
MNTNLKKALFLTTLGYLQANEGFLAIMPDENKQEDISQEQKLEHKMEQKIAPQNTLKKQQSAPLQSAELLQSQVKREVKEQKKSQKHLVAMQTKNGFFLGSEIAITGTKLTQSLSLISNDTDDLITYSKTSKNADFNMGLLIGYQHYFGASKRHGIKISSHLYGGTPSDVSTDIKIYKSKVSANYTPLNFGIDVKYLFDFLNVIKKNRHTLGLSVGFGWRMQYYFAKIDPIKTNHSEFITNKPKDIFNHGFYPTIGLHYYLNHHQFEVNYRFGGAINYQSVVPSKIVVQNGNFKGEVLFSNFLTKATNSSYIAFNYAYLF

SEQ ID NO: 21378 - protein, 327 aa, Neisseria meningitidis
APKDNTWYTGAKLGWSQYHDTGFIPNNGPTHENQLGAGAFGGYQVNPYVGFEMGYDWLGRMPYKGDNINGAYKAQGVQLTAKLGYPITDDLDIYTRLGGMVWRADTKANVPGGASFKDHDTGVSPVFAGGVEYAITPEIATRLEYQWTNNIGDANTIGTRPDNGLLSLGVSYRFGQGEAAPVVAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 21379 - protein, 304 aa, Helicobacter pylori
MKKALLLSLSLSFWLHAERNGFYLGLNFAEGSYIKGQGSIGEKASAENALNQAINNAKNSLFPEQNTKAIRDAQNALNEVKDSKKIANRFAGNGGSGGLFNELSFGYKYFLGKKRIIGFRHSLFFGYQLGGVGSVPGSGLIVFLPYGFNTDLLINWTNDKRASQEYVERRVKGLSIFYKDMTGRTLDANTLKEASRHVFRKSSGLVIGMDIGASTWFASNNLTPFNQVKSHTIFQLQGKFGIRYNSDEYDIDRYGDEIYLGGSSVELGVKVPAFKVNYYSDNYGDKLDYKRVVSVYLNYTYNFK

SEQ ID NO: 21380 - protein, 738 aa, Rhodovulum sulfidophilum
MWRIQGWCSGGCFLGLAIISQPVFPQQVDLEQAGADESPTARLEEVVVTATRSAESIAAIPGAVRVITRQQIEQQMNLSRDLGDMLGKLIPGMGVSSQTGSNEAQTLRGRKVLVLIDGVPQNTTRDVSRNLSTIHPSAIERIEVVPGATAIYGQSAAGGVINILTKVPGKGPMELTTDTNFNFSLSHPGSSYGGFVNQGISGQKGAFDYLLNGTFEHVGGFFDAEGDRIPPDPHGQQSLDDSNNYNIFGKFGFNFYQQRLQFEINHFKESQDTDFISDPAVKAFPPGTKKARALKGLVLDDQRGTENTLLSLDYHHADLFGNRVHAQFYHQDFLTRFGPFGPFASIGNQIGQSRLESERFGARLEIETFLPKLAFVTPTLLWGADYFDEETSQPLAIFDQETVQESNGLVFEKIDEQLWVPALKPRNLGLFAQLEADVTERLILRGGVRYQRIWFEVPTFTVLADGRSIQGDTLNFDETLFNAGAVFYLTNALNVFANFSQGFSTADIGLFLRFPPQEFTTLEDQRLEAQKVDNYEVGLRGDWRTLQFSLTGFYNESDLGTRSAGFGLPVVRAPERIYGFDATVDIQPMDRLRLGAAASWVEGESRQDTDGDGVGDGAYQALNGFRIPPVKIFGYIEFDTVPRWQWRNRVQVLYSGDRERAFEDLGPMAFGGRKVESFTTVDLISTLQLGPGTLKLGVENLLNNQYFTPVSQMLRNRNNTSYAAARGAVFNIGYSVAY

SEQ ID NO: 21381 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSDKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESTKNDKQESSQNNSNTQVINPPNSGQKTEIQPTQVIDGPFAGAKDTVVNINRINTNADGTIKVGGYTASLTTNAAHLNIGKGGINLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGSQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFASYALIKNAPFAQTSATPNLVAINKHDFGTIESVFELANRSKDIDTLYAHSGAQGRDLLQTLLIDSHNAGYARTMIDATSANEITKQLNTATDALNNIASLEHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNGEVEAIVGGFGSYGYSSFSNQANSLNSGANNANFGVYSRIFANQHEFDFEAQGAVGSDQSSLNFKDTLLRDLNQSYNYLAYGASARASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELQLAKEVFLNLGFIYLHNLISNAGHFASNLGMRYSF

SEQ ID NO: 21382 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDNLNNTNSQSGAKSDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKSGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFASYALIKNAPFAQTSATPSLVAINKHNFGTIESVFELANRSEDIDTLYANSGAQGRDLLQTLLIDSHDAGYARTMIDATSTNEITKQLNEANSALNNIASLDHKTSGLQTLSLSNAMILNSRLVNLSRRHTNNIDSFARRLQALKDQRFASLESAAEVLYQFAPKYEKPTNVWANAIGGASLNSGGNTSLYGTSAGVDAYLNEKVEAIVGGFGSYGYSSFSNQANSLNSGANNANFGVYSRIFANQHEFDFEAQGAVGSDQSSLNFKGALLRDLNQSYNYLAYGASARASYGYDFAFFRNALVLKPSVGVNYNHLGSTNFESNSTHKAALKNGASSQHLFNASANVEARYYYGDTSYFYMNAGVLQEFANFGSSNAVSLNTFKVNAARNPLNTHARVMMGGELKLAKEVFLNLGFIYLHNLISNIGHFASNLGMRYSF

SEQ ID NO: 21383 - protein, 1296 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKNDKNESAKNDKQESSQNNSNTQVINPPNSGQKTEIQPTQVIDGPFAGAKDTVVNINRINTNADGTIKIGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKSGEKLVINDFYYAPWNYFDARNIKNVEITNKLAFGPQGSPWGTAKLMFNNLTLGPNAVMDYSQFSNVTIQGNFVNNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFASYALIKNAPFAQTSATPSLVAINKHNFGTIESVFELANRSEDIDTLYANSGAQGRDLLQTLLIDSHDAGYARTMIDATSTNEITKQLNEANSALNNIASLDHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNEEVEAIVGGFGSYGYSSFSNQANSLNSGANNANFGVYSRIFANQHEFDFEAQGAVGSDQSSLNFKGALLRDLNQSYNYLAYGASARASYGYDFAFFRNALVLKPSMGVNYNHLGSTNFESNSTHKAALKNGASSQHLFNASANVEARYYYGDTSYFYMNAGVLQEFANFGSSNAVSLNTFKVNAARNPLNTHARVMMGGELKLAKEVFLNLGFIYLHNLISNIGHFASNLGMRYSF

SEQ ID NO: 21384 - protein, 429 aa, Pseudomonas putida
MFSPFPLAPGRRVTGLFLLCAGVNAQAAGFLEDGSAKIEARNVYFNRDFRDGYSSSSQGASKREEWAQGFILNVQSGYTQGPVGVGVDALGMFGFKLDSSPADSNSGLLPSSGHDPRHSADQYAKMGLAAKVKVSNTVLKYGSMMPDVPLLKYNDGRLLPTLFQGAMLTSEELHDLKFTLARLDNYTARDSTDRQDIRVHCKNKRYACDTEADHFDLAGVDYRFNERFSAQYQVAKLENIYRQHFLGLVASQPLPVGSLSADMRLIKSDDIGNARAGEIDHRAFSGMLGYSLGGHKLSAGWQRMYGNSAMPYLDGSNPYLVNYAQVNDFAAAQERSWQVRYDYDFKALGVPGLTFFTRYINGDNIKVPGSRAEGKEWERDTEFKYQVQSGSFKDVSVRLRNSTYRSNYEQWARDMDETRVIVSYNFSIF

SEQ ID NO: 21385 - protein, 1023 aa, Rhizobium sp. AC100
MRSYHEIDVQRASIKDFVLILFILVSLCGSNNAFAVVQQQGGPALKSVQKILSGTVYNEKHEPLPGATVIVKGTSNSTTTDFDGKFSIKVNTTDAVLVVSYVGYANKEVSAVDNNLEIQLAPETTTLTDVVVIGYGKAKARDLTGSVSSIDVAKTKNQPVANIGEAMQGRAAGVQVISSGEPGSNVTFRVRGTGTIANNNPLIVVDGMPLNGGLNQVNMNDVESISVLKDASSTAIYGSRGANGVVIVTTKRGGTKEGSTLTFDTFTGVQNASNVVKMLNASQYASLNNDMLTNGGLAPNPLWTNPASLGTGTDWVGTLFNPEMMSSYTLSYGNKTKKSNIYVSANYFNQKGIVLNTDYERFIVQFNSDTKVTSKVKFGNSVKIAHDIKESGAYDIRSTLLANPTQPIYDENGNFTGPTGNPLYYGDITNPIGKATTVERSTKGYNLQGNLFAEINLLKNLVFKSLGGVEANIWFDRTWSPKYSWGSNVQTNSYLYEGTNKSITVLWDNTLTYDAHFGAHNLNAVVGSSSQSNKYDFLNGSIQKFASDETQQIDNGTLQPTVGGNASEWAIMSYLARVNYDYDGKYYITGTIRRDGSSRFGEGNKWGWFPSGALSWRISSEKFMEKVTAINDLKLRVGYGITGNQDIGNYAFSSSYNTVMYNFNNNYVSAVVPTVLPNTNVKWEGQEQFNVGLDASFFDSRINLTFDAYVKNTNDMLVPMSVPVTSGYSDIYVPSINAGKIQNKGIELSLSTKNLVHEFKWSSDVVFSYNKNKVDSINGDTPIITGSTGLNSTISLIQAGYPVNVFYGYVTDGIFQTQTDVNNHAVQMLGSNSATSTAPGDVRFKDLNNDGIINDKDRTFLGNPNPKFTYSLNNTFSYKNFDLTVYLQGVYGNDIYNANRMYTESMSVANNQTTATLGRWTGVGSSNSMPRAVYGDPNSNARVSDRFVEDGSYLRLKNVSLSYNFPDSVFNNVFSSIRLYFSAQNVLTFTNYKGFDPEVSANGIDNSVYPVTTNYSIGLNLGF

SEQ ID NO: 21386 - protein, 185 aa, Aggregatibacter actinomycetemcomitans
VYLYVRLQYNGEILPFYTKVDGIKNATGKEKDSPLTRSFVAGGGAFGYKMDDIRVDVEGLYSQLATDAAVVNGSETNVADSLTAFSGLVNVYYDITIEDMPITPYVGVGVGAAYISNPSKADTVKDQKGFGFAYQAKAGVSYDVTPEIKLFAGARYFGSYGASFDKAAKGDTGIKNVVYSTKGIP

SEQ ID NO: 21387 - protein, 1123 aa, Aggregatibacter actinomycetemcomitans
MRKHCQKSRSVLSLSVAAAVASLSAATSTSVFAQQGEDIQLEEVVVTGSRIAGDPNAIASQPVTSVNAEDIAISGEFNITDVINDIPALFSSNTSENSLDGNQGAEVADGTNTLNLRGLGAARTLVLVDGRRHVAGAAGTQAVDVGSLPMKLIERVEVLTGGASAVYGADAVTGVVNFILKDDYEGFEIDLQTGMSSEADAGQSAISALWGKNFSNGRGNVAVTLDYRTDEGLKAGERGRDGLLTGTGRDWVNPDLRFQQGDITGDTPNFQQFFNYQNTGLTDFGLPIPTQEDFIADYQAEFGVAPSITAAEEALFAQAGSAPQRAVELGRSFPFTSGYGYIIPGNPYTFEGFDPDVPIDLDNNGRNDCQDSFTGYNSVFGAASFGVVGGCWNVDQNGGYAPVQDGRVAGNFQGFGGDSLNTIQQADSYLITPEDKITFNMVGHFDINENMTAFGEFKYGWQENENQVRPQSFWDLLFGAPDNPFLPGFIQPVAQELGGVAITIDPIGLGPTQRVTERETFRFVGGLEGTFSNGWTYEVSANYGKFEQTIERSNEVIVDRFLAAIDAVTDPATGEAACRSSVDPNAPVVATPFDIPVFDPGYYSFTPGDGQCVPLNIWAGQPGITDEAVDFVTRATSEGATLEQTVFAAVVTGDSADWFELPAGAVSFAAGVEYRKEESETSFDSYALGIIPAGAPFPEGTQLSDVSDNSNLLFRPALSNSNEVGDYDVTDVFFEVNVPLLSGTPFAESLVFDAAVRASDYSTIGEAYTWKTGLSWTPIDDIRFRATVSQAVRAPNINELFAPTTGTNFRPIDPCDAAQLAALSGSIGAQTQANCVADFATFGLNPFDAEGNYVYTDPLSASFGGTQGGNQDLQEETADTYTIGVVFQPTFLEGLTLSVDYWSIEIEDAIEEVTSQNIVDACYQGTSLNDAFCSQFTRNTNSSSVQFGGFNFLQVSPINFANLESDGIDFQGSYDFSIGEHGFKASIGGTYVNELNRFSDPLDSSVVDVELGEVNRPELAGNIWLNWYWKDLTVQWQTQYQDEQLLAFIEIDTAQELYGDSVVQDEYWQHDIAATFAIKETMSVFGGVRNLTDEQPFITNRGYPASARGTYVYLGFNMVFGGF

SEQ ID NO: 21388 - protein, 763 aa, Aggregatibacter actinomycetemcomitans
MKKITLFITALLYTISSFASGFSELRGQVKDAATNAPLSGATIYITDLKAVTTTNAAGEFNLKNIPSKGRFLLEVRYVGYKTFSQVVDLAKGTNLEVLLESSVVESAEVVITGSPFSSNNKTNSLSVVTVGKDKLTQAAGTNLIDAVARIPGISQVSTGGAISKPTIRGLGYNRVLTMVDGAREEAQQWGDEHGIEVDQFAAARVEILKGPASLLYGSDALGGVINIIDDVVPAPGVFNGSFTSAYSTNNGLTASSLMLQGNDNGFVYRGRASYKNAYGFGYKDAVVPNSGFDEFNLNGMVGLNKSWGYSHLTFSRFHTNIGLVEAGPDGDGNYLDEDGNVITKSVARERRLGLPYQDINHYRAALNSNFILGSGQLKTTFAFQRNMRKEFEERLQEPGLNLNLNSYTYDVKYYFPNAGKWEPAIGVQGMYQDNVNKGDEFLIPDYSSNNIGAFFYLKRNFEKGAINVGARYDYKKINGDELTADGEQVFAAFDNSFSNVSGSLGFSFEVAKDLVFKGNAGSGFRAPNIAELAANGRHEGTFRYEIGNSNLKQETSLQFDLGLEYTGKNVTLGLNAYANRIYNYIYPGNFNNETTDLINEDGTAETLPVYRFVQTDADLIGGEASVDIHLIKSLHFENSFAYVKGTNRDNDQALPFIPAASLNNELRFEPSIKGMTDSYIKVGLNNVFKQSRFDDFETLTSGYTLLDAGIGTAIRTAKGKFNIWITGQNLLDKKYFNHLSRYKPEGIYNAGRNVTFGVSVPFL

SEQ ID NO: 21389 - protein, 309 aa, Wolbachia pipientis
LYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRHKF

SEQ ID NO: 21390 - protein, 333 aa, Wolbachia pipientis
VYDKDGTTFDVYGRVQANYYGDHNTADSTAASGYKDVDGELVGSSRLGWSGKIALNNTWSGIAKTEWQVSAENSANKFDSRHIYVGFDGTQYGKIIFGQTDTAFYDVLEPTDIFNEWGDAGNFYDGRQEGQVIYSNTYGGFKGKLSYQTNDDKAVKVTDVGQGIKETAVYGADVKRNYGYAAAAGYDFDFGLGLNAGYSYSDLENTKTSNTGDKKEWALGAHYAINGFYFAGVYTQGDLSYDNTTGGDKDKGRGYELAASYNVDAWTFLAGYNFKEAKVKSNTAGAEYKDLLDETLLGVQYAFTSKLKAYTEYKIQGIDKLDDEWTVALQYNF

SEQ ID NO: 21391 - protein, 147 aa, Wolbachia pipientis
FPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAG

SEQ ID NO: 21392 - protein, 198 aa, Wolbachia pipientis
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSCDVTPEIKLYAGARYFGSYGANFGKTAKDDGGIKVLYSTVGAEAGVAFNF

SEQ ID NO: 21393 - protein, 185 aa, Wolbachia pipientis
QYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVAFNF

SEQ ID NO: 21394 - protein, 407 aa, Bordetella pertussis
MNMRLLVGVAAVALCAASGASAQSALSGWYVAGDAGYHEPQDVKATSSKGYQWNFNADKDWAAFGRLGYRFSPNWRVEAEYGYRPSDLQGVRGAGLSGAQPIGLCTAGVGRTSASPGCGEPNGELKASTLMANLIFDMGGDSRLSPFIGVGAGTAWVHNKVYGQLSGVPAGAAIYQNTGFDDVDQAFAMQGLLGVAWNFADNWSMDLTGRYLRSSKLDWGSVTQNAGPAGGSITDVGTFSGRYKDTSVTLGLRYTFGAPPPPPLPPAPTPTPTPQPPPLEPTPTPPPIPPPVQAFEPREFVVYFPFDQYVLTPEAQAVVQQAADYAKGGNATRVVVTGHTDTSGSDAYNRKLSERRGRAVADGLVGMGLNAATVAVDWKGEKAPAVETGDGVKEPLNRRSSVSINFQ

SEQ ID NO: 21395 - protein, 266 aa, Pseudomonas fluorescens
GTIKVGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEY

SEQ ID NO: 21396 - protein, 185 aa, Wolbachia pipientis
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKEFGFAYQAKAGVSYDVTPEIKLYAGARYFGSYGASFNKEAVSATKEINVLYSAVGAE

SEQ ID NO: 21397 - protein, 191 aa, Wolbachia pipientis
SYYVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFCAHFDKDTAAASKDKGELKVLYSTVGAE

SEQ ID NO: 21398 - protein, 290 aa, Pseudomonas fluorescens
MNNKKMFSIIGISLLANLLLLPNMSFAKNNYSYINPVLYISGQYRPGVSHFSQFSVRETHYDTQLLAELKKEVGSVTNTVIQAYANYNVPSQAPFSHTYVAEFEDNTISFSGAVGFSYSEGPRIEIEFSYEEFDVKNSGHSSIDAHRYFALLRHSNNGNTQQNPFAVMRNNGLFIGSVAINSCYDFILDDTPALPYVCGGIGGDFIEFFDELHVKLAYQGKIGISYPIHSKVSTFVDVYYHRVINNKFKNLHVQYVNTTTSQAINPQITSAVATLNVGYFGIEIGARLTF

SEQ ID NO: 21399 - protein, 92 aa, Oryza sativa
RARNSGKWNASYNIASWRFELSYLYQGKRYNDAANTQVLDPYSLVDIAGTYYFDNGLSLGAKVGNLFDEEYETVSGYKTPERNYYVNAMYQF

SEQ ID NO: 21400 - protein, 593 aa, Agrobacterium tumefaciens
MFYEDKELVVTPTRDPKPVSQVAENITVITAKEIRNLNAHTLADVLVTITGVQQDWRGGPGSLAFPGIQGSNPNQVLVLIDGVSQTSTSSNFADVGAIPVQNIERVEIIKGPASTSWGSSLGGIINVITKSPEENRAAAGMVSASLGERFTGDYRGELTGTVGSFGYYLSGGKLHSDGLLPHNSVDTDRAYLKLTHQLPDGGDLRFSLGYSAGDRGDQMDPVARTSYDNTFDNLLTTLSISLPLTERIDWDLSLRSQWLEYDQFRNGLDTGLVDASLLDDRSFGATTKLVWRTGDHSLTVGAEFDRGDFRLEQESSGIGRSSVRSHIAKSAIFANDTIVFGPLTITPGIRFDHTTTNGDFLSPSLGVTWGIGEHTVLRGALARGFTVPPVIYTVGDGFALAPNPDLKMEKVLSWQAGFETSLLRYLWLKSTFFLHDVSDAVVATILSDGQFRYENREKQRRQGMEIEVKTIPFMYTTLGAGYTFVDSKDRNTHQRIPSAARQTVNTTIQFDDLKGTRANLVGRYIWWNAPDFIQGSYTSMVWDLNVARNIYRDERYSVELFLAGRNLFNGSQYVDATLKNPCRWFEGGIRFDF

SEQ ID NO: 21401 - protein, 581 aa, Chlamydia psittaci
LGDITFDGNKIITTSRSSSTVKRNSISLGSGGKFTKLNAKEGFGIFFYDPIANTGDTNTEIELNKAEGGSTTYTGKIVFSGEKLSDEEKKVADNLKSYFTQPLKIGAGSLVLKDGVTLEAKKVSQTDGSTAVMDLGTTLQTSSSGETITLTNLDINVASLGGGGVAPDPAKVEAQASGKTVTINAVNLVDTDGNAYEYPILATSQPFTAIIAKAGSSGTTTTPTDNLKNYTPPTHYGYQGNWTVTWKLGTSAQEETATLNWEQTGYSPNPERVGSLVPNTLWGSFSDIRAIQNLMDVSVNGADYSRGFWVSGLANFLNKSGSDTKRKFRHNSAGYALGVYAQTPSEDIFSAAFCQLFGKDKDYFLSKNSSTIYAGSIYYQHISYWNAWQNLLQNTIGAEAPLVLNAQLTYCHASNNMKTNMTNTYTPKNVTPSEIKGDWGSDCFGVEFGAKAPIETASLLFDMYSPFVKLQLVHAHQDDFKENNSDQGRYFESNNLTNLSMPIGVKLEKFSHEDTASYNLTLAYAPDIVRSNPDCTASLLVSPTSAVWVTKANNLARHAFILQAGNYLATYNIDLGSKIQF

SEQ ID NO: 21402 - protein, 184 aa, Wolbachia endosymbiont
SYYVRLQYNGEVLPFKTKIDGVTYKSGKDNNSPLKPSFLAGGGAFGYKMDDIRVDVEGLYSQLSKDADVVDTSPAVVESLTAFSGLVNVYYDIAIEDMPITPYVGVGVGAAYVSNPLVTEITGDKKSGFGFAYQAKAGVSYDVTPEIKLYAGARYFGSYGANFGKTAKDDGGIKVLYSTVGAEA

SEQ ID NO: 21403 - protein, 181 aa, Wolbachia endosymbiont
SYYVRLQYNGEVLPFKTKIDGITHKSGKDNNSPLKASFLAGGGAFGYKMDDIRVDVEGLYSQLSKDVDVAADSPAIAESLTAFSGLVNVYYDVAIEDMPVTPYIGVGVGIAYVSNPLATKATDDKASGFAFAYQAKAGVSYDVTPEIKLYAGARYFGSYGANFGKTVKDDGGIKVLYSTVG

SEQ ID NO: 21404 - protein, 185 aa, Wolbachia endosymbiont
SYYVRLQYNGEISPFKTKIDGIEYKKGNDAQDPLKASFMAGSGAFGYKMDDIRVDVEGLYSQLNKNDVSGAVFTPVTVADNVTAFSGLVNVYYDVAIEDMPVTPYVGVGVGAAYFSNPSSADAVKDQKGFGFAYQAKAGVSYDVTPEIKLFAGARYFGSYGANFGKAAKDDAGIKVLYSTVGAEA

SEQ ID NO: 21405 - protein, 196 aa, Wolbachia endosymbiont
SYYVRLQYNGEISPFKTKIDGIEYKKNNDAQDPLKASFMAGSGAFGYKMDDIRIDIEGLYSQLNKNDVSGAVFTPATVADNVTAFSGLVNVYYDVAIEDMPVTPYVGVGVGAAYFSNPSSADTVKDQKGFGFAYQAKAGVSYDVTPEIKLYAGARYFGSYGAKFDGEKKQGSGADQVTITDKGAYKVFYSTIGAEV

SEQ ID NO: 21406 - protein, 197 aa, Wolbachia endosymbiont
SYYVRLQYNGEISPFKTKIDGIEYKKDNNDAQDPLKASFMAGSGAFGYKMDDIRVDVEGLYSQLNKNDVSGAVFTPATVADNVTAFSGLVNVYYDVAIEDMPVTPYVGVGVGAAYFSNPSSADTVKDQKGFGFAYQAKAGVSYDVTPEIKLYAGARYFGSYGAKFDGEKKQGSGENEVTTTDKGAYKVFYSTIGAEA

SEQ ID NO: 21407 - protein, 719 aa, Salmonella enterica IIIb 50:k:z
MQPRLLTGSLALALAVAIRLDWPAYPQPAAEPGAAQLGPVLRPTAPSADPTAPTDLEPVFVTGERSYRIEDAGTATKLDLPLRDIPQSIQVIPRQVIEDRQVLRINELADNVAGVQQFTGFGGVSTPSFQVRGFNLFGEHLRNGFRDFGLISPREMANVERVEFLKGPAAVLYGSSGGFGAGTGLINVVTKKPLAAARTGAELVFGNYSLYRGTLDLGGPLTANASLSYRLNAAYENDAGFKDFGQSESVFVAPALAWKIDERTDLSLEYEYQRFNNRFQQAFPLEVEFLDLPPNRFLGEPAFDQGKTDSNALTAVLEHRFAEGWKFRQGFNMTLVKYDNRQTFPFFLLPDRRTLPRLPLLDNEGNENYSLQNEIFGKFSTGSIQHNVLFGVELSRYRYRSDVFAAPTFDAIDIYNPVYGDLPTEFVPFSLSETGSDNIGVYLQDFVEFTPNLKLLAGVRYDYVDSLIRDRLSGLLENQQFLNNLSPRAGLVWQPGDTTSLYFSYSTAFVPQFNTRTRGNTQLQPTTGRQFEFGVKQDLIPGQLSANLAFFDITRQNVVRADLENPLFGVQTGEQKSRGIELDITGRILPGWNVIATCALTDAYVSRDDIVPVGDRLFNTPVNRATLWTTYFFARESSLAGLGLGLGLYYASEKEASLPNSFTIPAVLRADAAIYYAFSNYRLVVNFKNLTSARDYTTEGLGLYPNPPLTVLGTLSLQF

SEQ ID NO: 21408 - protein, 283 aa, Salmonella enterica IIIb 50:k:z
MKNFEKLVLAGVVAVGAAWGTAHAADLAPTYKMPVKAIAPVQTWNGFYVGGNVGYDWSTGSTGISVLSTDPALAAPLAALVAAGSFPTALSPSAKGVIGGVQAGYNWQVAPQWLVGLEADFQGADVKGTTTQALAPVGFDATSTTVSKGIDWFGTVRGRVGVLVAPQWLLYGTGGFAYGRTKSSFSTTDVTGGCIVGATICASGASSGTSTGWTAGAGTEVMFAPNWSFKAEYLYVDLGRRTLNVASSTVPAIVFTTSTPFREQIARVGVNYHFSAGPVVAKY

SEQ ID NO: 21409 - protein, 160 aa, Klebsiella pneumoniae
LMDRGSKYNLDWVSPVYGLNIKESDLSLIDDNLNKLDQVGIYLQDQIEYGSWNLLLSGRYDWSQLKSLSRITNKLTQQDDNAFTGRAAVLYAFDSGISPYVSYSTSFEPNTGKGAPGSEALKPITARQLEAGVKYQPPGSKTLMTAALYDLRQKNINQRD

SEQ ID NO: 21410 - protein, 659 aa, Vibrio cholerae
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAVGHRFQVSYDVYRDQGDYSPRPDMAGSANLGLSKNRLVPTHYDRDTITGSYELKQDKHRGKVTLYSSQTEIDRDESVMAGVWPGNRLSRNTATNRNVGINALFQSDYELAAHRNQVSYGMDYVDQTSKATYGSTPFMEESAVSTAVFAENKLYVNDVWSLTAGLRFDDFKRKAMTGTKDFDEVTWSLGTEWDVTSDWTLFANARSLFKGPELLETFVRYQDQARLADNIKPETGLNTQGGVRFDKTYGDHFVGANFTLFKTQIDDHIRTSNSYLISNVGDMEIKGFELSTTYAYQAASAKLSYAHSDANDVTNGGPMLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 21411 - protein, 353 aa, Pasteurella multocida
  misc_feature (350)..(350): Xaa can be any naturally occurring amino acid
MKKTAIALTIVALAVASVAQAAPQPNTFYVGAKAGWASFHDGLNQAKYLEAPEATFGFKRNSVTYGVFGGYQITDDFAVELGYDDFGRAKLRIAETDQKARDVAKHTNHGAHLSLKASYPVLDGLDVYARVGAALIRSDYKVYDHSDPAKLPQLKRTHSTQVSPVFAGGLEYAFMPELALRVEYQWVNNVGKLKDVDGNRVDYRPDIGSVTAGLSYRFGQSVYVPEVVSKTFTLNSDVTFGFDKADLKPAAQNVLDGIYGEIAQLKSASVAVAGYTDRLGSDAYNLKLSQRRADTVANYLVAKGVAQNAISATGHGEANPVTGNKCDSVKGRKALIACLADDRRVEIAVXGNK

SEQ ID NO: 21412 - protein, 186 aa, Wolbachia endosymbiont
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 21413 - protein, 149 aa, Wolbachia endosymbiont
PSPSFDGPTLTYTADLLPVLFLSIPSGALPSLPSDESSPARMSSSRPQDRTAVGVGVRPAGLRLTYRPHKRVQPFVAGSTGLAFFDRSVPNALGRSLNFMFDVGAGVRVVLTPTLTLTAGYRYHHLSNGFRGQINPGVDANLFRLGVTV

SEQ ID NO: 21414 - protein, 187 aa, Wolbachia endosymbiont
SYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 21415 - protein, 696 aa, Escherichia coli
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASAQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTVGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSVNDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVNAGLSWKMTDALTLNAAVNNLLNKDYSDVSLYSAGKSTLYAGDYFQTGSSTTGYVIPERNYWMSLNYQF

SEQ ID NO: 21416 - protein, 547 aa, Escherichia coli
MNLFQRLLVAPAALGLLAPMAVNATELNIDGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLKGQTTFVTGGVIAGGDSVAGESFSRAGLGGADAYNREYGAFTFNYDQRLSLNTSFTGKDKLFTRLRTGNFDNNAFGGDGVNLTALDIASSTENSVTIDRLYYKFPVGEEFTFIVGALARNTESLAMWPSKYNKGGAKILDYFAVAGVPGVYNKETGQLLAAYWKQKVDKGDPAFSVSVNYVADDGEGNNSDSSTGGFATDNSRANLLAQLGWGNGQYGAAFAYRYGQCRSAFRRSTSFVQNGNFNLNCQPGDDSRSSNSYALNAYWQPENPGFIPSISVGWALNNISGDNILDGTYTTSQSWFTGLRWADVFLKGNDLGFAFGQPTFATALKGSDTPSDGNYAFELYYNFQVTDNIAVTPALFYLSRPMGQNTRNLKVDGTGYDGQFNVFGGLIQTTFKF

SEQ ID NO: 21417 - protein, 721 aa, Escherichia coli
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 21418 - protein, 1114 aa, Serratia marcescens
MNKKHLCIIICFLVNALAMASAANRTITGVVISGEDNEPLIGASVYVHTDELKKAGASQTSLGTITDIDGKFSLSVPDKVTRIHCSYIGFEEQVIVLQGDKKSYRIVLQTSAHTLGDVVVTGYQTLERRKLTAAISKVEVSDAMVGAAKSIDQALTGQIAGVSVTNTSGAPGSPAKIRIRGTASMNGTQDPLWVLDGIPLEGTDIPKMDNKSSDNDIVNIGQSSIAGLSPNDIESITILKDAAATAIYGARAANGVIVVTTKRGKTGKPVVNFNTKLTYTPNLETSRLNLLNSEEKVNLELQMMKEAPFNKWGFYPIPVYSEKGGVAAILKQYNLMDIYREKGWEGLTPEAQNAINRLKSINTDWNDILFRDAITQEYNISISGGSEKVTYYNSLGYTLENGNIPGVSLSRFNLTSKTSYQINKLLKVGVSIFANRRKNTTFLTDTYGLTNPVYYSRIANPYFEPFDNNNNYLYDYDVVTGSIPDLLQGYNILEERENTSNKSVTTAINSIFDIELRFNDQWKVTSQVGVQWDQLSREEYAGTNSFNLRNQRENSAYYKGNDRIYLIPEGGMLKSTNSTTSQITWKVQGEYKNTFNDIHNIQIMAGSEIRKNWYENQASTGYGYDPKTLTFKNLEFRDSKQANEWKLKTKSFKENAFASFYANGSYTLMDCYTLGGSVRMDGSDLFGVDKKYRYLPIYSVSGLWRISNEPLINQFKWIDNLALRLSYGLQGNIDKNTSPFIVGTYGNISILPGSNEESITINSAPNSKLRWEKTASYNTGIDFSVFNQAINLSVDYYYRKGTDLIGNKMLPLENGFTSMAVNWASMKNQGIEINLQTRNIATKDFSWYTSFNFAYNKNKVLKVMTEKDQVTPSLEGYPVGAIFTLKTKGIKSETGQIYIENKDGEAVTIEELFQMADKGNLDGEYSIGVDKETERGFYSYAGTSDAPYTGGFMNTFNYRNWELNLNFSYNLGAHVKTDPTYYIADPDPGRNMNRDILDRWTPENKNGKFPALTSLNTNPADYYLFSTRRDLYKSLDIWVKKLSYIRLQNIRLAYHFPSEWLHKLNIGGATVGLEARNLFVFGSSYKNYMDPESMSNLYSTPVPKSVTFNLSLNF

SEQ ID NO: 21419 - protein, 200 aa, Wolbachia endosymbiont
SYYIRLQYNGEFLPLFTKVDGITYKKDKSDYSPLKPSFIAGGGAFGYKMDDIRVDVEGVYSYLNKNDVKDVVFTPADTIANSLTAISGLVNVYYDIAIEDMPITPYVGVGVGAAYVSTPLKTAINNQNSKFGFAGQVKAGVSYDVTPEVKLYAGARYFGSFGAHFDSETTGADNKKVVTKDAYKVLYSTVGAEAGVAFNF

SEQ ID NO: 21420 - protein, 138 aa, Chlamydia psittaci
LFTKIAGIKNAAGKEKDSPLKASFIASGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAG

SEQ ID NO: 21421 - protein, 601 aa, Chlamydia psittaci
LGDITFDGNKIITTSRSSSTVKRNSISLGSGGKFTKLNAKEGFGIFFYDPIANTGDTNTEIELNKAEGGSTTYTGKIVFSGEKLSDEEKKVADNLKSYFTQPLKIGAGSLVLKDGVTLEAKKVSQTDGSTVVMDLGTTLQTSSSGETITLTNLDINVASLGGGGVAPDPAKVEAQASGKTVTINAVNLVDTDGNAYEYPILATSKPFTAIIAKAGSSGTTTTPTDNLKNYTPPTHYGYQGNWTVTWKLGTSAQEETATLTWEQTDYSPNPERQGPLVPKTLWGSFSDIRAIQNLIDISVNGADYRRGFWVSGLGNFLHKSGSNTKRKFRHHSAGYALGVYAQTSTEDVFSAAFCQLFGKDKDYFVSKNSSNIYAGSIYYQHISYWNAWQNLLQSTIGAEAPLVLNAQLTYCHASNNMKTNMTNTYVPKNVTLSEIKGDWGNDCFGVEFGAMAPIENASFLFDRYSPFLQLQLVHAHQDDFKENNSDQGRYFESSNLTNLSMPIGIKFERFAYNDVASYHLTAAYAPDIVRSNPDCTASLLVSPTSAVWVTKANNLARSAFMLQAGNYLALSHNMELFSQFGFEIRGSSRTYNVDLGSKIQF

SEQ ID NO: 21422 - protein, 846 aa, Chlamydia psittaci
MKHPVYWFLISSSLLASNSLSFAQVTNETLTSSDSYNGNVTSDEFEVKETTSGAIYTCEGNVCISYAGKDSPLNKSCFSETTENLSFIGNGYTLCFDNITTQSSHPGAISVSGTNKTLDISGFSLFSCAYCCPPGTTGYGAIQTKGTTTLKDNSSLVFHKNCSTAEGGAIQCKSSSSTAELKLENNKNLVFSENSSKEKGGAIYADKLTIVSGGPTLFSNNSVSHNSSPKGGAICIKDSDGECSLTANLGDITFDGNKIITTNGGSPTVTRNSIDLGSGGKFTKLNAKEGFGIFFYDPIANTGGSTEIELNKTESDTTYTGKIVFSGEKLSDEEKTVPANLKSYFKQPLKIGAGSLVLKDGVTLEAKKITQTKGSTVVMDLGTTLQTPSSSGETITLTNLDINIASLGGGGGTAPAKLATNTASQAISIAAVNLVNTDSNTYEDPILSASKSFSAITATTSSSTVTPPETNLKNYTPPTHYGYQGNWTVTWKQGSSAQEKTATLTWEQTGYSPNPERVGSLVPNTLWGAFSDTRAIQNLMDISVNGADYSRGFWVSSLANFLNKSGSDTKRKFRHHSAGYALGVYAQTPSDDVCSAAFCQLFGKDKDYFVSKNSSTIYAGSIYYQHISYWNTWNTLLQNTLGAEAPLVLNAQLTYCHASNNMKTNMTNTYTPKNVTPSEIKGDWGNDCFGVEFGAKAPIETASLLFDMYSPFVKLQLVHAHQDDFKENNSDQGRYFESNNLTNLSMPIGVKLEKFSHKDTASYNLTLAYAPDIVRSNPDCTASLLVSPTSAVWVTKANNLARHAFILQAGNYLALTRNTELFSQFGFELRGSCRTYNIDLGSKIQF

SEQ ID NO: 21423 - protein, 683 aa, Bordetella pertussis
MAGPMSALAGGLQQPEVQLETTTVVGSAAAAAATSEAASQGYVPRAQLENRPLLRPGELLETVPGLIVTQHSGDGKANQYFLRGFNLDHGTDLATTVAGMPVNMRTHAHGQGYTDLNFVIPELVSGIAYKKGTYFAEEGDFSAAGAVRIDYADKLPHGLAQFELGEYGYRRGLLANSNTVGPGTLLYGFEWLGENGPWVVPEGVHKLNGVLRYTLPLGGGERITITGMAYKNAWQSTDQVPQRAIDEGLISRFGAIDPTDGGMASRYSLSADWLRPLADGQFKANAYVIKSRLTLFSNFTYALANPELGDQFEQFENRVTTGFNASRTWFGEIAGHDSETEVGSQTRHDRLDPILLADTVARQPYAVVRSDTVNETSTALYLRNSIQWRPWLRTLAGLRADQFWYSVGSSNPLNSGSGAEHIVSPKLGMVLSPTAGTDVFVNWGRGYHSNDVRGATTTVDPVSGNPVQKVSVLVPATGYEIGVRTKELARGLQLSASLWRLDIGSELVFAGDTGTTQPSRPSRRTGVELAAYYKPSPELILDADAAFSRARFRDADPVGDYIPEAIQTTASAGVSWTHGRWTLGARLRYFGPRPLIEDNSVRSASSFLVNLKVGYRVQKNVRVFIEVLNALNRKANDIDYYYASLLKGETSPVDANGVATGINDRHIHPAEPRTVRAGIAWAF

SEQ ID NO: 21424 - protein, 672 aa, Bordetella pertussis
MHIYGNMNRATPCRGAVRALALALLGAGMWTLSPPSAWALKLPSLLTDDELELVLPTGMSLEDFKRSLQESAPSALATPPSSSPPVAKPGPGSVAEAPSGSGHKDNPSPPVVGVGPGMAESSGGHNPGVGGGTHENGLPGIGKVGGSAPGPGGLGRNDENSESSLNPGTLGPSPGPDTSTGSGPDAGMASGAGSTSPGASGGAGKDAMPPSEGERPDSGMSDSGRGGESSAGGLNPDGAGKPPREEGEPGSKSPADGGQDGPPPPRDGGDADPQPPRDDGNGEQQPPKGGGDEGQRPPPAAGNGGNGGNGNAQLPERGDDAGPKPPEGEGGDEGPQPPQGGGEQDAPEVPPVAPAPPAGNGVYDPGTHTLTTPASAAVSLASSSHGVWQAEMNALSKRMGELRLTPVAGGVWGRAFGRRQDVDNRVSREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRTELAVGVASQLGKHGSLFGSYEYAKGSRQTMPWTFHVGYRYAW

SEQ ID NO: 21425 - protein, 199 aa, Escherichia coli O157:H7
MRKLYAAILSAAICLAVSGAPAWASEHQSTLSAGYLHARTNVPGSDDLNGINVKYRYEFTDTLGLVTSFSYAGDKNRQLTRYSDTRWHEDSVRNRWFSVMAGPSVRVNEWFSAYAMAGMAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 21426 - protein, 757 aa, Escherichia coli O157:H7
MNTVTKHLAALALLATAAPLMAQSAPTADTDNEVVKLSPFLVSGGSSVGRYTSLESTSAGRVRVAIMDSSQNVSVITSEMLTDVGAGRILDATKYIAGISESTLPNAQDRTNVRGFQADGRTVDGFTYGGFMSLDPAIVDRIEVVKGPNAILAPQPTSPGGTVNNATKKPQFRNFGMVNAQVGEFDANSAFLDVNRQVNDKIAVRGILSVRDWDNWWRDSSIRSFTFMPGLTYKISDTAQLTVQYIYTDWKSSLYLGLPVDPSSGTKTKAHILAGVPKDLSVYADDIYRTDKQHDFKLLFTAELWRGIQMRFAALYHKTSQYAPQLNTGNSTGGTGGNRDPLTGNYVPGMQYLSTPPFTGSPIASGPTRIFVRSGTDPRADPRQLFLQNDYAYLARNDMLTSTTLLGFAFTESIDYGSTAYNISAPNFDIDHYTPVHWTRGTLNFDNRTSSRFLQGYLSESLSLLDNRLILNGAISKNYYRQRARGLVTGFFHGVAPEANLPSYGVVIKPYKDVFSLYYSYSEQSTSNGPTINSTTNSVPPLTSSKQNEFGVRTKLLDNKLYFTISHFDIKQDNFSVPNPANLTTPPPNPLLPALFSDRKAKGWEYELRANPTKNISIIANYTNFKNRDPNGVEFRGVAEKSGAVLVSYSFDRDTPALDGFRVAVGIDYIGNRPGDAPSGLTPASTPTNVIPNQPSFYLGARTLVNLILAYESKQNWGVQLNVDNVFDEDYMMASINRSMVYTGTPVNFRLSGHYKF

SEQ ID NO: 21427 - protein, 199 aa, Escherichia coli O157:H7
MRKVCAAILSAAICLAVSGVPAWASEHQSTLSAGYLHASTDAPGSDDLNGINVKYRYEFTDTLGLITSFSYANAEDEQKTHYSDTRWHEDYVRNRWFSVMAGPSVRVNEWFSAYAMAGVAYSRVSTFSGDYFRVTDNKRKTHDVLTGSDDARYSNTSLAWGAGVQFNPTESVAVDVAYEGSGSGDWRTDGFIVGVGYKF

SEQ ID NO: 21428 - protein, 199 aa, Escherichia coli O157:H7
MRKLYAAILSAAICLAVSGAPAWASEHQSTLSAGYLHVSTNVPGSDELNGINVKYRYEFTDTLGMVTSFSYAGDKNRQLTRYSDTRWHEDSVRNRWFSVMAGPSVRVNEWFSAYAMAGVSYSRVSTFSGDYLQVTDNKGKTHDVLTGSDDGRHSNTSLAWGAGVQFNPTESVAIDIAYEGSGSGDWRTDGFIVGVGYKF

SEQ ID NO: 21429 - protein, 953 aa, Escherichia coli O157:H7
MRNRTNGGARPSNKRFYGTASAAAITLALAGSGAAWAQSAPQTPKAEDDTVEAIVVTGIKAGIQNAINIKKNETSIVEAVSAEDIGKLPDVSIGESIARLPGLAAQRVNGRAQVISIRGLAPDFTTTLLNGRQQASSGDNRAVEFDQYPSELLSSVVIYKTPDAQVSGMGLSGTADLRTVRPLEFGKRAVAVNIRGEKTAGKKLNDDVSNWGGRYSASYINQFADGTFGVALGYAHLDSPSQVKHYKAYGYEAFGFAVTPDSADNALILNGQELFATSRLNKRDAVIGIFEYQPNDQIHSTLDLYYSTFRQEETTRGAQWFSNGWADNATFTNIKTEDLGGSQFARSGLLNNAVPQLRNDYNTRMDQLFSAGLNNEFQLSDRTKLVADLSYSSNKRKEQIMETYAGYGRGVGGVTPATPNIGRVFDKIGFQVADNGFSQYDEGFNYADAGKVTLGDRAPWGGWGHDGAIRFPQVKEDVTTIDVHLEHELDGFITQVSAGVNHTKRDKGKTVSDNDLFLKNGRQQVYVDAADLVDPTQLGFAGFGGVLSVNIGDAWRKYYNWAPILDANYYDKTWEITEKVTTFFARANFQAGDLRGNLGVQVVKQEQASSGVVINGTEPGKPITPTKINVKDDYTDVLPSMNLIYDLGGGHRLRFALSKTMARPRMDDMRANVTPGFNSLVCSGQPCAPGTTVNPWSASGGNPNLKPWMAKAADLAYEWYVSPATYVSVAGFYKKLDTYIYSQTGKFDFTGIPRPTTATAIPPGITISPIGQITLPANGNGGVVKGLEFSGAVDLGQFADLLKGFGMQGSLSLTKSNLNPTTSTDPKQKVRIPGLSGTVYNVTGYYERGGFQARISQRYRSAFKGEVVQLFATRGFTEILADKQVDAQIGYTFQDGPMENLGLLVQVNNLTNTPYRTRLGLDGGGTKTSGGGALPETYEKYGRQILFGVNYRF

SEQ ID NO: 21430 - protein, 819 aa, Escherichia coli O157:H7
MNEGGALTNEGVLNTVTLEGGTFNNNGTLNDVVKIEKNSNAVINNTGSLSTLQLHDGTVNNSGIASARVNAQGDAVFNNLAGGEARKGAILYNSAVVNNAGTWKMGYQDENNNAGTLDIDDKSTFNNSGKLILDNSKNAIRFQGSNANATLYNTGEMTLDAALGAGAIHYDDGASEFINKGVVDAKVTVAVSTAGATESDAFLWNQDGGVINFDKDNASAVKFTHNNYVALNDGVMNISGNNAVAMEGDKNAQLVNNGVINLGTEGTTDTGLTGMQLDANATADAVIENNGTINIFANDSFAFSVLGTEGHIVNNGTVVIADGVTGSGLIKQGDSVNVEGVNGNSGNNTEVHYTDYTLPDMPNTYTTSPFSETTDSGSSDGSSNNLNGYIVGTNVDGSAGKLKVNNASMNGVGINTGFAAGTADTTVSFDNVVEGINLTDADAITSTSVVWTAKGSTDASGNVDVIMSKNAYTDVATDASVNDVAKALDAGYTNNELYTSLNVGTTAELNSALKQVSGSQATTVFREARVLSNRFSMLADAAPKVGNGLAFNVVAKGDPRAELGNNTEYDMLALRKTVDLSESQSMSLEYGIARLDGDGAQKAGDNGVTGGYSQFFGLKHQMSFDNGMRWNNALRYDVHNLDSSRSVAYGDVSKTADTDVKQQYLELRSEGAKTFEPREGLKITPYAGVKLRHSLEGGYQERNAGDFNLSMNSGSETAVDSIVGLKLDYAGKGGWSANATLEGGPNLSYSKSQRTASLAGAGSQHFNVDDGQKGGGINSLASVGVKYSSKESSLNLDAYHWKEDGISDKGVMLNFKKTF

SEQ ID NO: 21431 - protein, 980 aa, Escherichia coli O157:H7
MHSWKKKLIVSQLALACTLAITSQANAATNDISGQTYNTFHHYNDATYADDVYYDGYVGWNNYAADSYYNGDIYPVINNATVNGVISTYYLDDGISTNTNANSLTIKNSTIHGMITSECMTTDCADDRATGYVYDRLTLSVDNSTIDDNYEHYTYNGTYNNAADTHVVDVYDMGTAITLDQEVDLSITNNSHVAGITLTQGYEWEDIDDNTVSTGVNSSEVFNNTITVKDSTVTSGSWTDEGTTGWFGHTGNASNYSNTLTADDVAIAAIANPYADNAMQTTVTLDNSTLMGDVVFSSNFDENFFPQGANSYRDADGDVDTNGWDGTDRMDVTLNNGSKWVGAAMSVHMVDEDGDGSYDGYAVGTEATATLLDIAANSLWPSSTVGVDNINTQYDENGHIVGNEVYQSGLFNVTLNGGSEWDTTKSSLIDTLSINSGSQVNVADSRLISDTVSLTGGSNLNIGEDGHVATNTLTIDNSTVKMSDDVSAGWGLEDAALYANTITVTNDGLLDINVDQFDANPFQADTLNLTSTTDTNGNIHAGVFDIHSSDYVMDTDLVNDRTNDTTKSNYGYGLIAMNSDGHLTINGNGDNDNTASIEAGQNEVDNNGDHVAAATGNYKVRIDNATGAGSIADYNGNELIYVNDKNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 21432 - protein, 234 aa, Escherichia coli O157:H7
MLMIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSSLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 21433 - protein, 659 aa, Escherichia coli O157:H7
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 21434 - protein, 242 aa, Escherichia coli O157:H7
MYKYIGFRIASIVLCAICSFFSYGTPIFRDHSLTLSGLIGYTDFKDPIDQQLVISHYVTDLLTNSHKHDHPSVLISAKQQLNFEANKIHKIMLGPALYFQKLHYSGDVWELMLPEFYNYQYDYTSNNVNFLIEGDMYFNPVSTWLIPFVTAGLGFGVAYVHYDDYALPGIDPVSERHHFDSSIKGIYQLGAGLLVPVNPNWSINLRYAYIHMGKVHTTPNSLGPIELVLNNQNILVGINYSI

SEQ ID NO: 21435 - protein, 729 aa, Escherichia coli O157:H7
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTQGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 21436 - protein, 301 aa, Escherichia coli O157:H7
MKKLLPCTALVMCAGMACAQAEEKNDWHFNIGAMYEIENVEGYGEDMDGLAEPSVYFNAANGPWRISLAYYQEGPVDYSAGKRGTWFDRPELEVHYQFLESDDFSFGLTGGFRNYGYHYVDEPGKDTANMQRWKIAPDWDVKLTDDLRFNGWLSMYKFANDLNTTGYADTRVETETGLQYTFNETVALRVNYYLERGFNMDDSRNNGEFSTQEIRAYLPLTLGNHSVTPYTRIGLDRWSNWDWQDDIEREGHDFNRVGLFYGYDFQNGLSISLEYAFEWQDHDEGDSDKFHYAGVGVNYSF

SEQ ID NO: 21437 - protein, 719 aa, Escherichia coli O157:H7
MRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 21438 - protein, 410 aa, Escherichia coli O157:H7
MNRTRFSCLTWLATLALPLPALADFVGDSHARLELRNHYLNRDFRQSNAPQAKAEEWGQGFTARLESGFTEGPVGVGVDAMGQLGVKLDSSRDRRNTGLLPFGPNSHEPVDDYSELGLTGKVRVSKSTLRLGTLQPILPVVVYNDTRLLASTFQGGLLTSQELDGLTVNAGRLTKANLRDSSGRDDIGYGAASSDHLDFGGGSYAITPQTSVSYYYAKLEDIYRQQFVGLVDTRPLGEGLSLRSDLRYFDSRNDGAERAGNIDNRNFNAMFTLGVRAHKFTATWQQMSGDSAFPFVNGGDPFTVNLVTYNTFTRAGLDSWQVRYDYDFVAMGIPGLSFMTRYTDGRHAETATVSNGRERERDSDLTYVIQSGPFKDVSLRWRNVTFRSGNGLTNAVDENRLIIGYTLALW

SEQ ID NO: 21439 - protein, 159 aa, Escherichia coli O157:H7
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWRGQVIFSQLVKRC

SEQ ID NO: 21440 - protein, 696 aa, Escherichia coli O157:H7
MQNFVFSKKWLICSSLLPLFFLNPLAAEDDGFFMGVSYQTSLAIQRVDNSGLNASQAASTYIRQNAIALESAAVPLAYYLEAMGQQTRVLMQMLCPDPSKRCLLYAGGYKNGSSNTNGDTGNNPPRGNVNATFDMQSLVNNLNKLTQLIGETLIRNPENLSNAKVFNVKFGNQSTVIALPEGLANTMNALNDDITNALTTLWYNQTLTNKSFNSGNSVNFSPQVLQHLLQDGLATSNQTICSTQNQCTATNEAKSIAQNAQNIFQALMQAGILGGLANEKQFGFTYNKAPNGSDSQQGYQSFSGPGYYTKNGANGTTQAPLKALPAGATIGSGNGQYTYHPSSAVYYLADSIIANGITASMIFSGMQNFANKAAKLTGTSSYSQMQDAINYGESLLSNTVAYGDFITNWVAPYLDLNNKGLNFLPSYGGQLNGANHQTPQLTPQQAQQEQKVIMNQLEQATNAPTPAQINRILANPYSPTAKTLMAYGLYRSKAVIGGVIDEMQTKVNQVYQMGFARNFLEHNSNSNNMNGFGVKMGYKQFFGKKRMFGLRYYGFYDFGYAQFGAESSLVKATLSSYGAGTDFLYNVFTRKRGTEAIDIGFFAGIQLAGQTWKTNFLDQVDGNHLKPKDTSFQFLFDLGIRTNFSKIAHQKRSRFSQGIEFGLKIPVLYHTYYQSEGVTAKYRRAFSFYVGYNIGF

SEQ ID NO: 21441 - protein, 850 aa, Escherichia coli O157:H7
MGWTDGVDMNIRKLALYSTILSFGLWTGVSVAATADGSAQDSKKSAHAKKAKASPTRAAASEENVIVTGTHASNRHARQSTSPVTVLSAATLRRSGMLNLSDALTRTYPSINVSTMGNDAGALTASIRMRGLNPNEVLVLVDGKRRHTTANINADAGPNFGSTPVDLNMIPSNMIDHIEVLEDGAAAMYGSDAIAGVVNIITKKQDHGLDISSQTGANAYNGDGWQYQLNADGGFKLGRDGYMHIAAQVYHTDHFVTKTLDNRLAGYTPPGVQNELYTGSLNVPGDSNKIMSTPEETRENLGIDFGKPITEDIQLYGQITYGHRHAEAYENYRLPSGTSASNPELFPSGYSPLETIDEDDYAATLGLKGGRLFGFDWDLSTTWGEDLDKISTKNTTNPNMYAATGYTPTTVRNENFRLAQWTNNLDFRRNFRIANVVPMTLAFGGESRMEQYTVTAGEPASYEYGGTSALAGLTPQDAGKWNRDIWAAYLDGDFHPTRKWDLDFAGRFEHYTDVGNTENGKVSTRYDFTRRIGVRATISNGFRAPTMAEQHYSAINVGPTSVLGLLPVSSPEAAATGASPLKPERSTSASGGIVLEPVDGFHIETDVYQINIRDRVVQGGNVTGPVAVAALEQMGVSLPALTQQSENSVQTYYFTNGASTRTQGLDIKADYMVHMHQYGNVALSMALDLNRTRLTHNGLSGTGSPLLNAQNIGYLTTGFPRSKIILNAYWTVGAWDVNLRQTRYGETTGMMTYQDWTPSAATCPGGGQLEQSSVCFAQFKNTPRWLTDLEIGYRVSPRWHVAVGANNIFNIRPRKLPGYLNQLGGNPYDTFSSQVPMTGGYYYGRVNFTL

SEQ ID NO: 21442 - protein, 700 aa, Escherichia coli O157:H7
MKIVFVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGSVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGMEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 21443 - protein, 398 aa, Escherichia coli O157:H7
MNSDGHLTINGNGDVDNGTELDNSSVDNVVAATGNYKVRIDNATGAGTIADYKDKELIRVNDANTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQFGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 21444 - protein, 814 aa, Escherichia coli O157:H7
MSTSSDTAIDGWTFNAGASNYLISNSHRFDFNGAGIVVNGGSVILKNTGTVFFLSGTAGSATIDNDSGGVFGAGILTFNDSTAGSATITSHDGGGTIFLGASTAGSATIINNYAGGTLFGGTATAGSATIINNSGGSTGFAQTSTAGNATIINNAGGTVSFRDSGTGGTARLINDGVVDLTYLFDAQGITLGSIEGSGVFQLATKNLAVGGNNRSTTFSGAILDQGSFPNPLAVGASLTKEGTGTLTLTGTANAYTGATTVNGGTLVVNGSIETSSLVTVNSGGTLAGTGTVGNTAIAGGIFAPGSGTPGSSMTVNGTLGLSPTSTYAVNIGPMTSSFANVTGAATLGGATVNASYAGGSNVSKHYTILTATGGISGTFGVVNSNLPANFTTALSYDSNNAYLDLSFGFAPPPGGFSTNQNNVANAVMNAFNTNGIPLAFGALSPQGLTQVSGEAATGTQQATFDAMSLFMGVMTDPFMAGRGDGIPSSNGAPAFAAEDHDALGYAARGNGRNAAERNAYAAMSRKALPMAPSFEQRWSVWAASYGGSQTTSGNSVVGSNTATSNLYGVAVGADYRVSPDTLVGFAMAGGATNFNVAGGLGSGRSDLFQAGAFVHHHIGAAYLSGALAYGWQDVTTDRTVSAGGIERLRANFNANAFSGRLEGGYRIATPLMGITPYAAGQFTTYDLPTYAEQASTGGLFALNYAAKNVTASRSELGIRTDKSFALSNAILTLRSRAAWAHNFDTDRAIAATFQSLPGASFVVNGAAQAREAALLTGSAEMKWANGFALATTFEGEFSDTTSSYAGKGVVRYSW

SEQ ID NO: 21445 - protein, 381 aa, Escherichia coli O157:H7
MKIIGLYLKFSFLLSLILTTSRITAQNLPDGIQYKITGRLLMDGGVYLKNPNNFGNGTEFNDLRIGVKATYQNWGMKLEMGYAGNKVAIKDAFATYSYKNSSIQIGQFYEPFSLDMICSTFDLRFNQSPGAVLALTNSRRMGVAYSYRTQYYYLCGGFFTDNDLSNLKNASQGYAIDGRLVYRPLYEQAKLIHIGLAAIHRTPDGTLPEDENRNTFTYKSPGVSTIDNRTLIQADVDHAASQFKIGTELLIYYHKFFLQGEYIRAHVKREKGFENYTAQGAYLQCSWLLLGQNYLYDEEVACPGRPEGKALELCARFNYLSLNDAGIKGGTQKDLSFGLNYYINKHIAVKLNYSYFIPGSHIKEIESTNFSVVQGRFQFIF

SEQ ID NO: 21446 - protein, 656 aa, Escherichia coli O157:H7
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLTFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFVEEGRNFWAGVEYTF

SEQ ID NO: 21447 - protein, 447 aa, Escherichia coli O157:H7
MRVIAGHSRAGVSTGRKELVRYFMVKGGRMKALRVVGLWVALVLGMASSAMAEGFALTEWSARGLGLASGMVGRADDVSAIAYNAAGITQLPGVQVMGGMGLIAPMGTLSLDTTYGKQETTTKPAVWAAPHAYASWQLNDSLWLGLGVFSRFGLGNSYDQNWTGRYNLYSVNLQTISAVPTLAWKINDILSVSAGLEIMNVNLTTEQKIPFPLGIPNPATDSDIGVQASGWGVGGHFGLHARLNDQWSVGLAYKTQVTVNAYGEAKHDGVLKNAGMLRDCDAHGTVQLPDSLALGVAYKPLDNLSFEVGAVWTRWSTYNSLNIYMDNGNQSISHKNWKDGWNFNASVEYKPLDWWSLRAGFWYETPVINEDHSDFMVPSNGRTALTLGTGVEWNDFTIDFAYCHMWINPTSYDDTDGHGILDSKYITGGHSKDTVANIYILSFGYKF

SEQ ID NO: 21448 - protein, 199 aa, Escherichia coli O157:H7
MRKLYAAILSAAICLAVSGAPAWASEHQSTLSAGYLHVSTNVPGSDELNGINVKYRYEFTDTLGMVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPIESVAIDIAYEGSGSGDWRTDGFIVGVGYKF

SEQ ID NO: 21449 - protein, 456 aa, Ralstonia solanacearum
MELESRFGAVSKPACRQAAAVKPSTGRRGASAIAAAALALCAASAHAYDITTSPYLLGDWGGLRTRLADQGVTFNLGYGSELAHNFSGGTDHLTRYTDQWVMGTTLDLNKLWGWKGGTFQATVTDRNGRNLGSDANIGNNMLIQEVYGRGQTWHLTQFWLNQKLLDDRLEIKAGRVTVGEDFFSFSCDFQNLTFCGSQPGNLVGSYWVNWPTSQWGTRIKYHTSQETYAQIGVYQVNPNYVNDSWASHNGWKLNNPSGTTGALIPLEFGWLPNLGGRPGSYKAGVWYNTSNGKDLYEDVNGNPRGITGLDARSRSGQYGAYLNLQQQVTGTAGGRGATVFLNFSQADRNTAQTDHQISVGVQYKGPFDRLADTVGFAVGATHNNSRFADFVRQNNARTGQNTIVGDGYEYVSELYYSWSPVPSVYFRPNLQYIMHPGGTSQNKNAFVVGLKSGVTF

SEQ ID NO: 21450 - protein, 257 aa, Ralstonia solanacearum
MWQGTLGQEFLGYGFRGNDFCEGIRKALIAALLATTAVIGGSAVPQSQALAQAQTSFNIPAGPLNQALAAFGQAIRDMAYPPTPGNFGTDCCYLGSGRIMSQGVDVEVSGEIVDRWRVHAGYTFNDNENQAEGGAYSTITPKHLFKLWTTYAFPGQLEGLKVGGGVTAQSSYYQRGFIRTFNNGVYDGPETPFDFTEPGRAVVDLLVQYDISKNWSLALNVNNVFDKKYYYVTESNPWGGNFYGTPRNFMLTARARF

SEQ ID NO: 21451 - protein, 802 aa, Ralstonia solanacearum
MKHVVSSTLLLGLSSLSLAAQAAPIALDLPAQPLAASLEQLQGASGLRIRFDRAAVADRRAPALRGTLEPSEALQRLLAGSGLSGEVRGGDAWVEAAATGAGIAPGDSVDLGALSVVATQDPATAAITEDSGSYTTRAMRTSTKLAMSIRETPQSVSVVTRQRMDDQGMRDLNDAVKGVTGLTVQQYGPARVKYAARGFDVDNIMYDGLPTSISTYTQDVISAADLAMFDRVEVVRGATGLMQGAGNPAAAINMVRKRPTQDFRASLQGSVGTWDRYRSEADVSGPLNSEGTLRGRAVVAYQKGNSFQDHVSSERGVFYGIAEADLSPDTTFAIGASNQNDNRNDNWVGLPSPLGGRHLDLKRSSYYGADWSYWDTDTTHLFSDLTHRFANGWQMKLAADKLWARINMLGLYNDCYYSTTGCASMTQNPGDYSYTDDHDSYDAYANGPFQLLGREHELVVGASYRQERFDGHGGWGSLFNKDGTPTGPMDPTQWDPSSTLKPRLNTSLWGMKLDQEQKGAYLTTRLNLADPLKVILGGRLDWYKADADTDSYKVTRNVTRYAGVIYDLNQTYSVYASYTDIFKPQSNFDAGGGLLDPITGKNYEIGLKGEHFGGALNSQIALFQIDQENRATEDVGGPSPCPFSPTSRYCSRASGKVRSQGVDLELSGALSDDWQMMAGYTYVDAKYKHDSNKANEGKPFDAAKPRHLFKLATSYTLPGELHKWRVGGDLATQSKTEDSSTGFQQGGYTVVNAMLGYKVNERIDTRLNFNNLFDKYYYSGIDFGNLNYGEPRNLMFTVKYSL

SEQ ID NO: 21452 - protein, 896 aa, Ralstonia solanacearum
MSPLPRDSLRCDSPSALSLLACGANAQTQDASSAASAQISQLDTIKVTSSYQKSLITAMDNKRDDVCMTDGISAQDIGKFPAENIAEAIQRIPGVQISTINGRGSTISVRGLGPQYSATTINGQVIKSADFTDGFRYDIIQPEVAAGIEVIKSPSADMDAGGLSGTVNINTTKPLDYQQTKLLFSAKTQPSEFAGSSPTPKGVLTYIDQFQFGGGDLGVFLGAGYQKLKDRADYLWIDRWYTQATDAGTLYIPRRPRYRSIERETTRKMFNGGVQWKPGEQLDMNLTALYSQDRTANDMNQLVYSFERSPLTVLQTNGLTATQVSASDYWLENNHQIEQHNLSTQLLTYDFKWKGDAWTLRGAANDTQGKTDENERAAILGRIPSATLLDTFNPDAVSLTTDADANDASAWNTANLVRSEYPNGSIQSLSNKEWSLQLDAERYLDLGALNAVRFGAKYRRETFDRDVRRRDFLYLLRTGAVSGFDMFPELSAASSTVSNFLDGQLASQDSWVTPDVAAYARSLAAAGITVQVLFAPQSSYSIENDISSAYAMARIDTDIGSMRLRGNVGMRYENTRRTTDTYLTQAQAASADANLVVGTARAPYAYSNWLPRLNLVLDMREDLLLRFAAAKVLVRPILDSNTAIASTVSTGTNTAGTTTYGVAQGQTDLKALTADQADLSLEWYYGNGGALTVAGFWKNIKNGTFNSIVCPAAFNGTALSSNAAGDCVSGNGDIYEITATTNDPSKVKIRGYELGWTQSLDAWLPIDGFGFTTNFTRVIPQRDTDFKIRNLSEQTWNATAYWESEHDSARVSLNHRSEYEQDSSDSFFAREGHIMKARTQLDAVLGYQVNDKLSVQLGGLNLTNRKEQAYKDIPSRWQMTGVTGRSYYLSMQWDML

SEQ ID NO: 21453 - protein, 157 aa, Ralstonia solanacearum
NNGEILPLFTKIDGIKNAAGKEKDSPLKASFIASGGAFGYKMDDIRVDVEGLYSQLSKDTTIINTSETNVADSLTAFSGLVNVYYDIAIEDMPITPYVGVGVGAAYISNPSKADAVKDQRGFGFAYQAKAGVSYDVTPEIKLYAGARYFGSYGASFD

SEQ ID NO: 21454 - protein, 480 aa, Ralstonia solanacearum
MPFCIFILISLGVRVLEIKKYFSYSLFFLLFSSLFLSKLQAYKFNMSIVGKVSSYTKFGFNNQRYQPSKDIYPTGSYTSLLGELNLSMGLYKGLRAEVGAMMAALPYDSTAYQGNNIPNGQPGSRTDPFGAGIFWQYIGWYAGHSGLQVQKPRLAMVHNAFLSYNYKKDKFSFGVKGGRYDAEEYDWFTSYTQGVEGFVKYKDTRFRVMYSDARASASSDWFWYFGRYYTSGKALMVADLKYEKDNLKINPYFYAIFQRMYAPGINITYDTNPNFNNKGFRFVGTFVGFFPIFATPANQNDIILFQQVPLGKSGQTYFFRTRFYYNKWQFGGSVYKNIGNANGDIGIYGDPLGYNIWTNSIYDAEINNIVGADVINGFLYVGSQYRGFSWKILGRWTDSPRADERSLALFLSYFSNKYNIRMDLKLEYYGNITKKGYCIGYCGMYVPVDPNGPGTQPLTHNVYSDRSHIMFNIAYGFRIY

SEQ ID NO: 21455 - protein, 385 aa, Ralstonia solanacearum
MKRSLLFSAVLCAASLTSVHAAQPITEPEFASDIVDRYADHIFYGSGATGMALVVIDGNQRVFRSYGETRPGNNVRPQLDSVVRIASLTKLMTSEMLVKLLDQGTVKLNDPLSKYAPPGARVPTYNGTPITLVNLATHTSALPREQPGGAAHRPVFVWPTREQRWKYLSTAKLKAAPGSQAAYSNLAFDLLADALANASGKPYTQLFEEQITRPLGMKDTTYTPSPDQCRRLMVAERGASPCNNTLAAIGSGGVYSTPGDMMRWMQQYLSSDFYQRSNQADRMQTLIYQRAQFTKVIGMDVPGKADALGLGWVYMAPKEGRPGIIQKTGGGGGFITYMAMIPQKNIGAFVVVTRSPLTRFKNMSDGINDLVTELSGNKPLVIPAS

SEQ ID NO: 21456 - protein, 914 aa, Ralstonia solanacearum
MFALAVTAMPAAAQQRSDDADDATQTLDQVNVTGTHLRRVDAETASPVVVIDRQRIEDSGQSTLGQLLQRLPMMAGFQTGPALNSNFSHGRALVSLRNLGPERTLVLVNGHRMAGPASSVASAPGVDVNAIPAAMVERVEVLTDGASSVYGSDAIGGVVNVILKDRYDGFAATVDYAQSSHGDANRRTLGLEWGKTWDRGGLILGLSRNSMNPVFNRDRSYAAKAVKYLDGQVGEIRGANTRAFLTDGRVLTPVGGVAPGPVGEDAFRPYNRATDSYNVYDTQYLITPIQRTNASLHGSFDVTQAVQAYVDVFWTRSKTVSRLDAYDLEMQDAVNNYYNPFGDQLDAYYVRSPQANTRVYTSTMFQTNIVAGLRGRLADSSWQWDAAAGYANYKDTLVRNGFSVTSKLNNAVGASFLDNDGVVKCGAPGAVIAGCTPINVFNPNDPATIAALRGTQLAVDLIDKSQMRFVEISANGDLFKLPAGAVQAAVGLVYRTNKFVQGTTSDVAAADADGNCDYNDGCILKQGRDEAVREAYAELLVPLLKDVPFAEVLNLNLGSRYSTYDAWGNTTNSKVAIEWRPIANLLVRATGSQVFRAPALGDLYGSPYNTVFDTTADFQDPCTGFTGAPNPACANVPNDGSFTNTAQFNVVTSGANNVGFKLKPERGRSYNVGLVYDPDWVRGLSLNVDSWRVVLDDMLSGVGVQQVVNDCFDGSESAFCPLIQRDTAGQLTRVSVPFAYNSGKVDTRGYDAGIHYTLANTAWGAFAAEVDATFFSSYRFAGDAHNYVGENSSWGNMPRWRAVANLAWDKGPWHASWNTRYLGRTVNGSQYENFCADTNADGSCAYFRIGSVVYHDASLSRKIASLHSTLAVGVDNLGDRKPPRFYRYSNAANTEASTYDTLGRYFWSRLRVEF

SEQ ID NO: 21457 - protein, 740 aa, Ralstonia solanacearum
MLERSFCPVAGALPFRLHATAVAVSVLCLLPGIGHAQEDAGSTLAEVTVQEKAVPNVYGESSDSYVPSAVEVGKAAQSLREVPQSVTVVTRQRMDDQAMRTLDDVMNYTTGITREETWLDTTYLSRGMNITNFRFDGGAASSSRSGSRSLDMAQFDSVSVLRGADGLFGAGEAGGVLNFTYKRPQAKRQTQVLLSGGTMSNYRAELDTTGALNESGTLRGRFVAVNHDRKEMATPSTLKRQMLYGALEMDLTSSTVATLGASYQKDRNTGFNASLPRYADGSDIGFARNTNFGAPWNWINRENTTVFAKLEQQLGNDWLLKTQLRHTRFNEGVNGAEIESSPDPITLQGADWWIHQARSRERETSFDINLQGGFDAFGQRHDVILGFDQHRNSNTYRSLWPRVGPADVFNRIPPQDPGYPLGDWTSGSQAKTQKSGLYGSIRLRPVERWSVVLGGRYVLQDRNTQHDMNGALTASSRESNVFVPYMGLMHELTKSTNLYFSTAEIYQSQAGKFSAPLPGTPLDPVRGRTYELGVKSELTPNLIASAALFRTDKKGEAVYDPAYPQTDWRGGCCYFRDGFKLSQGIDLEMTGRITPNLQLAVGYTYNSNEDRRKDSAQFSTVTPRHLFKAWADYRLSGDLRGWSVGGGVVAQSSNYRASGISAYNPATGRYDGAWTPYNFTSPGYAVWSARAAYAFNKDWSVAVNVGNLFDKTYYSTVGYAGYGNFYGEKRTVTVSLKGRF

SEQ ID NO: 21458 - protein, 104 aa, Ralstonia solanacearum
MGHETKAQLKDYVEVKIMKIKTTVAALSVLSVLSFGAFAADSIDAAQAQNREAIGTVSVSGVASSPMDMREMLNKKAEEKGATAYQITEARSGDTWHATAELYK

SEQ ID NO: 21459 - protein, 1052 aa, Ralstonia solanacearum
MLSSIGLILFSVSFVLAQVLVKGTVKDNLGEGVPGASVQVKGTSQGTITDLDGKFAFNVPNKNSILVISFIGYVTVEMKVDTQKPMVITLKEDTKTLDEVVVVGYQEIRKKDLTGSVAKASMAELLSTPTASFGETLGGRIAGVNVSSGEGMPGGQMNIVIRGNNSLTQDNSPLYVIDGFPVEDPSIAAAINQNDIESLDFLKDASATAIYGARGANGVVMITTKKGTIGQPKIKYDGSFGIQHITKTIPMMDAYEFVKLQAERSPKDMETTYFMNYDGKKWGLEDYRNIPQYNWQDEIFRSAWMQSHNVSLTGGSEGVRYNASLSYYDQDGILLESNYKRVQGRMGTTIQKKKLKIYLTTNYSSTTTTGGSPSQNSYSGMNNLFYSVWGYRPVTEPDRPLNSLMDNIMDDAINNTNDYRFNPIMSLKNEYRKTYANYIQFNGFAEYEFIKGLKLKVSGGYTFDTRKGETFNNSKTRYGNPKSSDKVNAEIYHSQRATWLNENILTYQTNIKRKHFFNSMVGVTLQNSDYEYYSYKTVQIPNEALGMAGMSEGTPSTTKSLKSSWSMLSFLGRLNYNYKSLYYATVSFRSDGSSKFRGDNRFGYFPSGSLAWGFMEEDFMKPLKSVVSSGKLRVSWGLTGNNRVGEYDTYALYQILKDKVGDFISIGSLPSGVYPFENSLTSVGTVPTSLRNRKLKWETTEQWNLGLDLGFLDERIGLTVDWYRKTTRDLLLNTALPTSSGYFSAMKNVGKVRNQGIEFTLNTTNIKNRHFSWTTNFNIAFNKNKVLELAENQSSLLSAAKFDQNYNSQYSYIAKVGYPMGMMYGFIYEGTYKYEDFDKVGDTYTLKRNVPYFSSESNTQPGMPKYADLNGDGIIDDNDRTMIGNGMPKHTGGFTNNFEYKGFDLSIFFQWSYGNDVLNANRLFFENSNKTRDLNQYASYADRWTPENPESNIPRATDSGSNKVFSTRIIEDGSFLRLKTVSLGYTLPKQLTKKWKIDNARVFVAGQNLWTCTGYSGYDPEVSIREGALTPGLDFSAYPRAYSISFGINLGF

SEQ ID NO: 21460 - protein, 755 aa, Ralstonia solanacearum
MQLSRLSSALLHIHHTYTAGSFKPLYCLSASVFLLGGSPLALAQTDEATETPPSAMFDSIVVTTSADASAQGLPVAYEGGQVATGSRVGLLGNQDIMDTPFSTTAYTNEYIKNQQAHSVGDLLKKDPTVRVARGFGNFQEAYLMRGFVTNSDDTMFNGLYGILPRQYIATELFERVELQRGASAMLNGAAPSGGNAGGSINLLPKRAGNEPLRQLTLGYGAGDQGRVGIDVSDRFGQDDAVGIRFNAAYQDGDSAVDNESAKLGVAALGLDYRADKYRVSADFGWQDNKLDETRPNVTLSGVTAVPKAPKGDKNWAQPWSYSNEKDLFGTVRAEYDFQDNLTGYAAYGARKGEEENSLANLTVTNTDGTGSTYRFDNTREDKVQSAQLGLRGKLQLGNTQHNWTLAGDLYDQEEKGAYAFDYGNQLPTNLYRPTAHKDNSWTGTTAYGGNLSDPRLASETQLTSVALADTISLMDDKLKATLGVRHQNIETRSYDYSTQVKTSDYDDSEWTPSVGLVYQPNKDWSVYGNYIESLSKGETAPAESANKPVTNAGEALSPYVSKQSEIGLKYDNGTVGSSLAIYHTTQPRAYVNDANTFVEAGENRHQGVELTVFGSPAENLRFNAGVSYLDAKQTDTGSQVFDGKRVIGIPKLQSNFNLEYDVASVSGLTLTGDVIHTGSRYADAANTLKVDSYTTLDLGARYRTKLGKQDMTLKGVVSNVTGEDYWSVGKYAGSEMGYLSANEPTAVKVSATFDF

SEQ ID NO: 21461 - protein, 444 aa, Ralstonia solanacearum
MSYTRHRNFTTPRACATALLATGLLAGGLVTASAQEKSLEERDKLTGTWGGARTALEDKGIEIGVVYIGEVLGISGGAKPAGGTHATYEGRLDVTINTDLEKLVGWAGAKTHVRAFQIHSAQGQNAANYVGSIADPSNIDAYGTTRLFTAWFQQEFGTWGSIRLGQLAGDDEFLVSTTAGGLINGTFGWAAIMAANLPSGGPAYPLATPGVRLQVNPTENISLLGAVFAGDPAGKNCTSGNQQRDCNRFGTTFSLDGGAFWLGEAQYNFNQDKDATGLAGSYKVGAWYHTGDRFLDQYYQSNRSTDWGMYGVVDQMLWRGKDASTSIFVRGGWTPSDRNVVSWYIDGGVGFKGFVPGREADTLTIGVAHSKISREAAAYSFDNSALRRTGETVLEVSYIAQVNPWWTVQPDFQYIAKPAGGALRDDGSVVDDAYVFGVRTTITF

SEQ ID NO: 21462 - protein, 91 aa, Ralstonia solanacearum
MVVGEGLLSAARFALRVVACGNALSLALKSNLGRSFSSFPAWAEYLIADSFENSGAFESDGGGGRITQRCALRPSGRCLRQRSLADARAEP

SEQ ID NO: 21463 - protein, 320 aa, Ralstonia solanacearum
MKKVALASASASAILASLTAGTVNAATVYQDDDKSLSIGGRAEARFNLSDKNKDGGTGNAFKDKSRARINLKGKAKITDQVTAFGKYEAEISDSSDSTVKSRYVFAGFDTQAGAFSYGKQDSAQVMLTDYTDILATFGGDAVDLVAGNEDKRENNFLYAGEFNNFTVSANYIAENNNADKDSDSYGIAAQYAFPFGLSLGAGYVSGKDGVDVDANQYNLAASYEFNNFYLAGTYASGENGKTDLTGYEFATAYKIDKFIAQAVYNFKQSETAGVKEDDKDYFALEGIYKFNKNLRTYAGYKFQQIDDQDDELQMGIRYDF

SEQ ID NO: 21464 - protein, 975 aa, Ralstonia solanacearum
MLFLLVSLSSTKVLAQTTITGVITDADTEETLVGVNILVKGKVVGTISDLAGKYTLEVHQEPPLTLVFSMVGYDSQEVEITGTQSTVNIQLQETTILGQEVVVSASRMEESVLQSPVSVEKMDIIAIRDAPQASFYDALNNMKGVEMSTQSLTFKSFNTRGFNANGNVRTVQLIDGMDNQAPGLNFSVGNIVGISELDLESVELLPGASSALYGPNAINGILLMNSKSPFLYQGLSANVKTGIMAEDERSKAATGFYSFSARYAKAISDKFAFKVNFEYLTADDWQANDFRDQSLLNGSTIESGTPLNNPAYNGVNIYGDETNVNMQSVAQSMVDAGFLPSAALQLIPNTAVSRTGYMERDLADYGTKSIKMNAALHYRINDRVEAVLQGNLGFGTSVYTGADRYSLKNFNIGQYKAELRGSNWYLRAYTTQERSGDAYAVGTAAQGINEAWKASTQWFPEYVGAYAQAIQGGLPADQAHLAARAFADQGRYMPGTSEFNNALADVTSRPIPGDQNGVGAQFVDSSNLYHFEGSYNFSEQIEFAEFVVGANYRIYDLNSNGTIFALDENGDEFKINEYGGYIQGSKKLFNDHFKLTASARYDKNENFAGQWSPRVSGVYTIGNHNFRASYQTGFRIPTNQDQYIDLNTPQARLIGGLPLFADRYNLNANPGYTLANVTNYGGAVQQSAQDPAIQSQAQQIVADGISQGLIDPANAQAAVIQIIGLLAAEANVGLLQPYDIKEFKPERVKSFEVGYKGIWGNKLLVDAYAYFNRFENFNGNQVLVQDATDAGLAGPNAMTGLNLIGAIAGARNIYSTPVNRTETIKSWGWAASLDYKLPKGYTIGGNVSYNTLSNLDELVETGFQPSFNTPDYRYVINFANREVVENLGFALAYRWQGEFAWQSSFVSPAVSTQQLSVMPAFGTFDAQASYKLKSIKSILKVGASNLFSKGYRQAWGNPTVGTMYFVSLTFDEFLN

SEQ ID NO: 21465 - protein, 693 aa, Ralstonia solanacearum
MSRTPKTRATLLVMTTALTTTGLIPERAIADDDIIYLGEITIFSNFWEELARKAAATATVLDEEDMSQSISPDLDAVTEKSANTIFQRANSQERLVVRGMSAFDNALSDPVGYSVNGVPLPMGTMQLPHFFGVENVTLLKGPQGTIFGRNSEAGLLTFETIAPGSREGWEINVGLSGSDAGASPLGANGSILWSGQATNGPALSFGLEVARDPGVISNPVTGADDGGENRRVTGFLGLEWDLQDGGYLKLTTMAEDQDFNKEQFRYVSGPLATDRYESVYSDPSWENRRMSVTALEYGTSFDGFDLTAITGFTTFDREFALDFDSSSLPLGVTEMDIEDRALSQDIRLTSNSEGPLKWTLGVNAFTQNTDADFNLGAMSTDRHTEIDQWGAGLYGFAEYAFTDRFRIGAGLRVDYVSSKAWQRFSSPTANLRYEGSDSSTTLLPKLTLAYDVSDATTIHASYARGYMPAGYNYAFANSADGLSYDAEYSWNAELGVKHEFASGAALSLVAFHTTVKDKQITETIPGAAQYISNAGEAKSYGIETEFNAPLARGWELTANAGWQRARATSFQTTTTDISTGSVMAVDWSGNALPMAPDVTWGLALSHVGDIWSGKISLHGSGSYWFDPANSLKQEGFMTVNAEITRQFGGGELTLWAKNLFDEEYYSTAANTIRGTVVEDGSPRTVGLNWRMTW

SEQ ID NO: 21466 - protein, 241 aa, Ralstonia solanacearum
MAYKKALAAAAGMILATAAHAQSAGSNIVSLGWFRVMPNSSSDPLQIDSVGGVPLNRQVANTGAKIKDADTVGLAFTHFFTDNVAVELVGGIPPRHKIEGTDSFARYGQIGSAKQWSPTVLAKWFFGGADSKFRPYVGAGLNYTWFTDEKITNSTFQTQVLGGGFPSTSTVSTDSSLNPVLSVGATYAITKDWFVGLSVSYLPLKTTAKIDTTLANGQHSVTEAKITINPIVTFLSVGYRF

SEQ ID NO: 21467 - protein, 372 aa, Ralstonia solanacearum
MNQPNGRADRLAVPLAALLACAALPAFAQSSVTLYGRVDTAIEYANAGPNHVTRMGSGNLFASQWGLKGVEDLGGGYATIFKLEDGFNAASGALSNSSALFGREAWVGITGPFGGVQFGELYTILHTTLVTYSLPGLGAGLAWGNATNNFVGPAFLRVRNSMRYTSPRYAGFMLRAMAARGTNGAAGQPATLGDTYGAGLNYVQGGLSVDVDYMQQKFSPVAASSLGDSSPAANGNYTLGAISYDFSVVKVAALYMRHRGGPDVATAIDSQSAYPHSDIMELSATVPIGRASLLLSVGHYRKVADSDGNADSYGIRFDYPLSKRTVLYTGAAMVRNGAHARFVVNGAAGGGVAVAKPGATASSIVVGMLTAF

SEQ ID NO: 21468 - protein, 616 aa, Ralstonia solanacearum
MKKSAFAKYSALALMVGMCLHTAYAKEFSQVIIFGDSLSDTGRLKDMVARKDGTLGNTLQPSFTTNPDPVWSSLFAQSYGKTASANTPYNPTGTNYAVGGARSGSEVNWNGFVNVPSTKTQITDHLTATGGKADPNTLYAIWIGSNDLISASQATTTAEAQNAIKGAVTRTVIDIETLNQAGATTILVPNVPDLSLTPRAIYGESLMAGVQDKAKLASSLYNSGLFEALNQSTANIIPANTFALLQEATTNKEAFGFKNTQGVACQMPARTTGADDVASTSLACTKANLIENGANDTYAFADDIHPSGRTHRILAQYYRSIMDAPTHMGKLSGELVKTGSAHDRHVYRQLDRLSGSQHSIWANVHASDRTDPTTQIGLDVAGSSSHTGAYLSHQNQDYVLDDTLSSDVKTIGMGLYHRHDIGNVRLKGVAGIDRLSVDTHRHIDWEGASRSHTADTTARRFHAGLQASYGIDMGKATVRPLIGVHAQKVKVRDLVENEPTLSTAMRFGEQEQKSLQGEIGVDVAYPISPALTLTGGIAHAHEFNDDERTINATLTSIREYTKGFNTSVSTDKSHATTAHLGVQGQLGKANIHAGVHATHQDSDTDVGGSLGVRLMF

SEQ ID NO: 21469 - protein, 873 aa, Ralstonia solanacearum
MAVTWRATKQIALTGASLVAMLAAGPALAQTSGASAAGEATVDEIVVTGTSIRGVPPTGSNLIGVTREDIKAVGAATAPELLASVPQLNSFNTAPRAANAGAGSFAPGLRSLPASATLPLLNGHRLVAGGANETNPDFPFVPDLAIERVEIVADGASSIYGSDAIAGVVNFITRKRYSGVEMSARYGVAEDYESFSVSGLAGRDWAGEWGDGSILAAYQYSENGNVTGADRDYRIVDFRPFGGVDTRGTSCPSPNLVVGGVVHAAPTLTPNTTNYCDVGAPVDLVPASRLHSAFVTARQDVGERVTLWGDLLYSDRKDAVQAAIPGQTVTLTAANPFFRAPAGSAATAGTVFFRPDNLVGADHFDQTYHVKAGNSSAGADVLLPRDFNLSLYGTYDWSRHVAFQPMINPVALAQAAAGTSPSTALDPFGEGTAPTVVQAITDYSTSVTIKQRTKVAAAKIDGPLFDLPAGELKIAAGVEYRKETFQQRGFVGVTPVPENLGRDIKSVYGELFVPVVGDANSAPLIHRLSLSLSGRYDHYSDFGSTTNPKVGVNWDPVEGVTIRGTYGRSFRAPGLRDVGATVGAYYLDAVTAGVAARDPTRGSAQVNTVYLLGGNKDLQPEKAETYSLGVDWRPTFLPELRAGVTFYSIDFTDVIGTPPTAMVFTDPTFSSVVYRDPTAAQLSGLLAIAVPVNLPTPLPTVGNLLDLRRGNFGVRKTNGLDFDVNYRRATDFGAVFGGVAGNYILKYDTRLSPTAPVSNSLRLGVPRATVRTTLGATAGPVSVVGFVNYRDGVTNTYATPTGLSQYEAKSYTTVDLRLNWTLPDAGWTQGTELALQVNDVFDEEPPFFPATDGIGGGYNPIGRFVAVNLRKTF

SEQ ID NO: 21470 - protein, 375 aa, Ralstonia solanacearum
MKMKLFAAAVAALAAGGAYAQSSVTLYGVADVGVEWANKVAGADGQGHSRVAMQSGNLSGSRWGLRGVEDLGGGLKGIFNLESGFSLDTGTSGQSGRLFGRNAYVGLQGQWGQLTLGRQQNLLYDFALAYDPMAIAGRYSITSQDAYLAGRADNAIKYVGTFGGLSVSALYAFNRDGQEVAGVNKLGREWSLGANYAAGPFSVGAVYDQSNGATSSTVLATQNAVADNKEQRATIAGTYAFGPAKLYAGYRWYHANYAVVAGNGNLRSNLYWLGAGYQATPALTLTGTAYYQQFKNAGTGNPWLFVVGTDYALSKRTDAYFNVAYAKNSSGSGLGVAGLNAFGTATTLGSGSDTFSNSTSTNNQIGAVVGIRHKF

SEQ ID NO: 21471 - protein, 665 aa, Ralstonia solanacearum
MRAQSPYTSTVYDWTGWYIGAHAGALRGSSSWTATPLGPGGPPVSGSFGLPLNFDFMAGTGTYVLGLQGGYNYVLPSRVMLGIEGDVSVPNSDVVVPYSVRGGQTVISPAIGQVTYSEAVIHYGSVRGRVGYAFDHFLLYGTGGFAWTYDQLTRSQDASPVTGSFVPAGTLETKLLWRLGWVAGIGVEIPITGNWSAKAEFLETGFGRRGAFFAASIDAFRSDFATQSVRVGLNYKIGDTNPISALITKTPEALETDRFAFHAQSTLLEQYTPPFRSPYVGTNSLNPNQGRETFDATLYAGMKLWDGAEAWVNPEMDQGFGLSSSVGAAGFPSGEAYKVGANYPYVRLHRAFLRQTIDLGGDVQKIDSGFNQFAGSTTSDRLVITLGKIGIPDIFDTNKYAHDPRSDFMNWSIVDTGTFDYAADAWGYALGGTIEWYTGPWTFRGGIFDLSIAPNTTSLDSRFGQFQWIGEIERRYSILGQPGKIAVTGFLTRGGMGSFNDAIQLAAVTGAPADITAVRHYQSRGGISMNLEQQINENVGFFARAGWADGHKEAYEFTDIDRSVAAGFSISGRVWGRNDDVWGIAGVDNGITNVHQAFLNAGGLGILVGDGQLPHAGDERILETYYSFPWFASRITLDYQLIVNPAYNRDRGPASLLGVRLHTQY

SEQ ID NO: 21472 - protein, 702 aa, Ralstonia solanacearum
MNRHLAARAFSCALAAIPLAVSTLAHAEAGQPATGGATVDLNETTVTAGSQRGFAASTAQVGAFRGMVLRDIPATVNVVTREALDAQQDTSLYDALRNTAGVTRQQLSGETFDNLAIRGVTLENRTNFRFNGSMPMAALTAIPLEDKERVEVLKGVSALYYGYTTPGGVVNFVTKRAGNTPVTTLGMQFDSNGTAVGTLDVGRRFGEDNQYGIRFNAAGGSLQSPTSGIDGTRQLAAVAFDWKVNSRLSLKADVEYSRKVITEQSVVTLPAAKNGIITLPAMPDPSKRISPGWADFDGNNTNALLRADYALADAWLLTVEGGMSETARTRAFSEFKLTNALTGAGTLSGQRQNGRWNTSHLRADVSGTEKTGWITHDLTFGVARSDMRQAAVYSDRFSGTQNLYNPVDLGWLPTTGTGFTAEQRAVDTGVYALDRMTLSEHWQVILGLRYTRYTSEQAPNRYEASKTTPLGAVIYKFTPALSAYASYAQGLEAGARPPNTAANANVAMPPALSEQKEVGVRYETPAGTQLAAAVYDIDRAASYTNDANIFVQDGRERIRGIELTAQGRVTQDLSLLASAGWTDAKFRGVGNGLDGKTPENTPRSTASVFAEYTLPMLRAVSFNAGAYYLGPRPVNDANQAELGGTTLFSAGVRYVTRISGKRATLQFNVDNLTDKRYWAGAGNNRLSMGAPRLFKLGMKIDL

SEQ ID NO: 21473 - protein, 386 aa, Ralstonia solanacearum
MKKSLLALVALSAFAGAAHAQSSVTLYGIIDEGFNINTNAGGKHLYNLSSGVMQGSRWGLRGTEDLGGGLKALFVLENGFDVNSGKLNQGGLEFGRQAYVGLSSGFGTVTLGRQYDSVVDFVGPLEAGDQWGGYIAAHPGDLDNFNNAYRVNNAVKFTSANYGGFTFGGLYSFGGVAGDFSRNQTWSLGAGYTNGPLVLGVGYLNARTPSTAGGLFGNNTTSSTPAAVTTPVYAGYASAHTYQVIGAGGAYSFGAATVGITYSNIKFMNFASTVFPNQTATFNNAEINFKYQLTPTLLAGAAYDYTQGSKIAGSSAAKYHQGSVGVDYFLSKRTDVYAIGVYQHASGNVIEADGNTVGPATAAINGLTPSSNRNQFAARVGIRHKF

SEQ ID NO: 21474 - protein, 1526 aa, Ralstonia solanacearum
MNRTSPYYCRRSVLSLLISALIYAPPGMAAFTTNVIGVVNDETVDGNQKVDERGTTNNTHIINHGQQNVHGGVSNGSLIESGGYQDIGSHNNFVGQANNTTINGGRQSIHDGGISTGTTIESGNQDVYKGGISNGTTIKGGASRVEGGSANGILIDGGSQIVKVQGHADGTTINKSGSQDVVQGSLATNTTINGGRQYVEQSTVETTTIKNGGEQRVYESRALDTTIEGGTQSLNSKSTAKNTHIYSGGTQIVDNTSTSDVIEVYSGGVLDVSGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDTGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQVVNEGGLAENSVLNDGGTLDVREKGSATGIQQSSQGALVATTRATRVTGTRADGVAFSIEQGAANNILLANGGVLTVESDTSSDKTQVNMGGREIVKTKATATGTTLTGGEQIVEGVANETTINDGGIQTVSANGEAIKTKINEGGTLTVNDNGKATDIVQNSGAALQTSTANGIEISGTHQYGTFSISGNLATNMLLENGGNLLVLAGTEARDSTVGKGGAMQNLGQDSATKVNSGGQYTLGRSKDEFQALARAEDLQVAGGTAIVYAGTLADASVSGATGSLSLMTPRDNVTPVKLEGAVRITDSATLTLGNGVDTTLADLTAASRGSVWLNSNNSCAGTSNCEYRVNSLLLNDGDVYLSAQTAAPATTNGIYNTLTTNELSGSGNFYLHTNVAGSRGDQLVVNNNATGNFKIFVQDTGVSPQSDDAMTLVKTGGGDASFTLGNTGGFVDLGTYEYVLKSDGNSNWNLTNDVKPNPAPIPNPKPDPKPDPKPDPNPKPDPTPDPTPTPVPEKRITPSTAAVLNMAATLPLVFDAELNSIRERLNIMKASPHNNNVWGATYNTRNNVTTDAGAGFEQTLTGMTVGIDSRNDIPEGITTLGAFMGYSHSHIGFDRGGHGSVGSYSLGGYASWEHESGFYLDGVVKLNRFKSNVAGKMSSGGAANGSYHSNGLGGHIETGMRFTDGNWNLTPYASLTGFTADNPEYHLSNGMKSKSVDTRSIYRELGATLSYNMRLGNGMEVEPWLKAAVRKEFVDDNRVKVNSDGNFVNYLSGRRGIYQAGIKASFSSTLSGHLGVGYSHSAGVESPWNAVAGVNWSF

SEQ ID NO: 21475 - protein, 689 aa, Ralstonia solanacearum
MALFGAPELAAADEAPTFALEEAVVRAQAGERLRARSATSATLTDTPLKDVPQSVGVVTRAALDDFGATRLDTALDWVSGISRQNNLGGIADNFAIRGFAGDLNTGSDYLVNGFSANRANSVPVDTINIARIDVLKGPSAALYGRSDPGGIVNIVTRTPQFKPSREITLAAGSHDQYRLATELTGPLSERFAYRLGVAAENNHSFRDFSTSRRYAIAPSFTWLPTDDTVVTYAFEAAQLKAPFDRGVVAINKQLGALPNSRFLGEPGDGDTTVRTQSHQLTVEHQLGSGWKVDAGLSYRTSHLFGKSSDASRLLDDGRTLWRQARERDYRANDLAGRVDVQGDVTSGPVKHTLVAGADFYDFRYDTVMYRANPSASAPYAIDIFDPVYGQPRPAMRLNSSTRESQRGFGAFVQDQVTLTPHWKLLAGVRADRFLQHADNRLTGVRVAQQQTAYSPRLGLVYQPTQTLSLYANTSRSFRPNTGVGAQGNAFAPERGRGYEVGAKLETADGRFGGTLALYSIDKANVLTGDPRDPAFQRTAGAVRSRGVELDVSGQLTANLKVLGTYAYTDARVTADTVLPSGAPLSNIPRHSASVLGLYEFGAGSLGRAGVGGGVIYVGERAGNSTDNGFKLPAYATVRLNGYVQPTRALRLSLTIDNLFDKRYYASSYNELWVAPGAERQVTLAATYTF

SEQ ID NO: 21476 - protein, 21 aa, Ralstonia solanacearum
MGAKLEYRRMYSLFLNYVFAY

SEQ ID NO: 21477 - protein, 726 aa, Ralstonia solanacearum
MTYHLPPRRFQRRALRTTPIAAIVMAGAFTTPNAAAQTQATAPAAPTALPTVTVTEHSDPTQRSSTGTKTDTPLIETPQSISVIPADRMATQGATNVKEALSYSPGVIPTRFGADSRYDWISLRGFDAYAPGFYLDGMPLRNNGNWGIWPIESYGAERIELLRGPASVLYGQSGPGGLVNAVSKRPTAEPLREVQVQVGDHGRKQIAGDFSGPLREDGTLLYRLTALTRDAELPAGGMKDDRTFIAPSLTWKPSSDTSLTLLSQFGRTRAGVFSRTRPAVGSLVPTAIGTFIPSGLFASDPTHNRFDLDTSMVGYLFEHHINDAFTVRQNARYGHLDVDYSAVQGRNFITENPANPRDPANFTTLRRTVSGSNERIRALNLDNQLETRLRSGDVQQAVLVGLDYQRTRIDQTSYSGGSASSLNIYNPVYGGAVQIPAPWYDGVATLAQTGFYVQDQIKWRDRWLLTLGARYDRASSEVDSRLDGRHTKISESKATKRAGLTYLAPNGWAPYVSYTESFVPTATRNPATGQPFKPETGRQYEAGVRYQPEGGKQSYSAAIFDLRRKNYLTADDNFVPRQTGEVQVRGLELEASAEVLPRLNLVGSYTYTPTAEITASSTAREIGKPLTAVSRNAAALWADYRFPNRIKVGLGARFTGSNYGDLNAAPGKVPSFTVFDAMIGYDIDRWTFALNVRNLTDKTYIGNCDQYGNCYYGDERRVIATATHRW

SEQ ID NO: 21478 - protein, 190 aa, Ralstonia solanacearum
  misc_feature (5)..(5): Xaa can be any naturally occurring amino acid
  misc_feature (30)..(30): Xaa can be any naturally occurring amino acid
  misc_feature (32)..(33): Xaa can be any naturally occurring amino acid
  misc_feature (36)..(36): Xaa can be any naturally occurring amino acid
  misc_feature (47)..(47): Xaa can be any naturally occurring amino acid
  misc_feature (56)..(57): Xaa can be any naturally occurring amino acid
  misc_feature (60)..(60): Xaa can be any naturally occurring amino acid
  misc_feature (66)..(66): Xaa can be any naturally occurring amino acid
  misc_feature (69)..(69): Xaa can be any naturally occurring amino acid
  misc_feature (71)..(73): Xaa can be any naturally occurring amino acid
  misc_feature (77)..(77): Xaa can be any naturally occurring amino acid
  misc_feature (82)..(82): Xaa can be any naturally occurring amino acid
  misc_feature (84)..(84): Xaa can be any naturally occurring amino acid
  misc_feature (86)..(86): Xaa can be any naturally occurring amino acid
  misc_feature (180)..(180): Xaa can be any naturally occurring amino acid
DEKTXYYVRLQYNGEVLPLFTKVDGMTIKXGXXDVXPFKASFIAGGXAFGYKMDDXXVDXEGVYSXLNXNXXXDAVXTPDTXAXSXTAISGLVNVYYDIAIEDMPITPYVGVGVGAAYISTPLKDAVNDQKSKFGFAGQVKAGVSYDVTPEVKLYAGARYFGSYGANFDKSGGEKDKGGXTVLYSTVGAE

SEQ ID NO: 21479 - protein, 389 aa, Ralstonia solanacearum
MKIRLAMFSTALAMGIAAPVFAQSSVEIYGIIDEGPEYSSNAGGHPLYSITTAAQGGSRLGFRGTEDLGGGLKALFRLENGYDLGTGKLGQGGLMFGRQAYVGLEASHYGTVTLGRQYDDIVDFIGPLTVGDQWGGTIGSHPGDLDNFDNSFRTNNSVKYASPNYGGISFGGMYSFGGIAGDTSANRVWSMGAGYTGGPLQLGLGYLNVRNSNVSFFGNSGVTATTNNIASPVYSGYASATTYEVFGAGVNYTFGPALVGLLYSNIRFLSLNNTAQSGPNPNHLDGDAAFNDVEVSFRYHLTSALLLGLEYNYTRGNSMNGQDPAQYHQGTLGLDYFLSKRTDLYVVVAYQKASGVDSTGKAAVASINTVTPSSSDRQTIVSLGYRHKF

SEQ ID NO: 21480 - protein, 372 aa, Ralstonia solanacearum
MGVNRHDLFKAFFLIINIKLRKRNTMKKEILTASVFAISALPVLADESPSVYGRLDLSVTHSELSSTVYSGTSGVKVGESGTYLENNSSNIGVKGKSAISDGINVVYKMEFGVNNTSNRANDSSKVFSARNTYLGVETAYGTLLVGRNDTVFKTAEGKVDIFGTTNADINQLVSGQTRSADGVWYYSPKLFGLMDINATYLLQDNYGADNELYALSTTLGDKDLKKNPYYFAAAINKGIANIDAYRFVTQVKLGDMKLGGIFQHTESLKFSNMEGDSYFINATYDLWGATLKAEYGQDSSGLGGYFSKLVGPNEQITDVDISQFTLGADKKLTKSTRVYTHFSMYEGEYQMSGITQDIGDDKVITVGVRYVF

SEQ ID NO: 21481 - protein, 1143 aa, Ralstonia solanacearum
MKITSKQKGFRSYFDLSPQIPTRMKIAALCLTCFLSAANANSLYSQSARLSIEMNNVSIEEVLNKIEENSEFHFIYNNELVNVDRKVNVKFDNETIESILKKVFKSTNVEYKVNEKQIILRPKEMDIVAKVQQEQKTVKGVVSDQFGPIAGANVSIQGTTVGTITDMDGNFTIEVPENATLQISFIGYNTCFVKVAGQSNLNVTLTEDTQKLDEVVVIGYGTQKKMNLTGSVATISADNIATIPVSNISNAMAGRMPGIFSYNKSGMPGVSSPITIRGVNTPNNTNPTYVIDGVVREKADFDALDPNTIENISVLKDAASAAVYGSRASNGVIVVSTKRGKNQKPQFSYSGLFGTDRPTRTPEVMNAYDRTVYLNNQFMYNGIPETDSRYYTADEQEYFKTHSTNWFDLAWKNPFTTQHNLSVNGGSERINYFMSAGYYSQSGTFNNLDFTRYSFRSNVDAKVADNFTIGLDVDGNMSDQRTPYWPHDSDKDLMNDMYRALLNFPTTEPAYINGKPNATIYNWNILEAINNGHVSKKHNTLNTKLSAKWEIPWVEGLTANAMFNYRRYYENEKQVGKEYTLYIHETSGGHNHIIRDDAPVVGTRTRTENGNFVRKDFNETSAYTLNLQLNYNRTFGKHDIGAMFLYEQYEEWGDMFWAQRKQLLSSSLEQLFAGSADSQWKDADGHESEIGRIGYVGRVNYGFDNRYLLEANFRYDSSVKWIPGKRWGFFPSVSAGWRVTEENFFKQNEKLNFISNLKLRASYGTLGNDGGDDVAYYQYLSKFTTGTNAVFGSGATGILPGVYPSKGITWETTTTADVGFDLGLWNGLLSLEFDYFHKKTSDILMDRKRTIPGTFGATLPKENYAEMVNQGCEFMLRHDNKIGNFTYYVSGNFSFARNHYTYIDESANAYEWEIKTGRPINFITGYIADGIARTDEDLAGLPLYNGGFEWSKGDIILKDIHGAGGVGGPDGVVDGNDQAVLSLYSKDPEIIYGISLGGEWKGIDFTAFFQGVGHRSIMFPNRGDTWTEQTVLNIWSDAYSPDNTDGKYPRVGGTGSKGANGQASSFWLMNGNYFRCKNIELGYTLPKQWVNSIGVDRCRVYVSGTNLFVFDHIGIYDPENSGDRGAYQYPLTKSFNFGINVSF

SEQ ID NO: 21482 - protein, 1156 aa, Ralstonia solanacearum
MSIISRFLVGITFASLLPGTLPAQSIYGTLTGIVSDPSDAVVAGAALTLRDQQSGSQRETLTNSEGYYTFSSVPPGTYQIMVAAKGFEGHKQNDIALGGGDKLNFNFTLKVGNTSNVVEVSGTVDLLVTTDSGENANRLTVKELDNFIQLGTNAAEYIKMMPGFGITNGTSNSANYNGQTVGINGNGNGGNQSPLNAAYSYNGLPTNSLDITADGAHVSDPGCNCATPVNPNSKMISEFKVQMSNFSAENQKGPGVISSVARGGGNTYHGSAFISARNAVLNANDWLSNYSRVARPENKYYYPGFTLGGPVKLPFTKFNHKRDKLFFFTGYQFFYQVLDTGLLRATVPTLGERNGDFSPAEIAKEGNFTAANQPPGQLNAKALGLYPAGIIPKTAIDPNMQALMKLYPAPNADPNANGGFNWVDDLHFNQNNTQWMSRVDYSISDNTKLFVRYNLQREVQLFPIGLWSSATTQQLPYPTPIQGKNRSDSVTASLTHVFDTSMTNEFVFGYTFIGFPNVFQDPSKVDRAQIGYAYKGLYKNGVAQFPNLTGSGEAASISTNGGFEVGGPGQGLYANKYMPSASDNISRIVGTHTLKAGVFWERIRNAQPANNTTQGQLGFNVGNSNTFGNPYLDMLLGNLNSYTETSFNRVNDIFYNTYEGFIQDSWKVNRRLTLELGLRITHFAPWADNLGFGFSVFDYSKYSSSCTPTQYCGFLWNKRDPSVPMGGFPTKGAYFQPRFGVAYALGNSTVLRGGWGRYFYHSGQFTTGLNVSAGMQTINLSNNQGTGGNTPLLASELDSLNVNGSALSTGAVDRKDDRSPYTDSYSFTVSQRVPGSALVEIAYVGNSSRNLLNQSGVGSDINLVPVGAMLSSKNGGVDPNGLNANNFRPLLGFGSLPLATHNLFANYNSLQAKYMRTKGRAVINVNYTFGKALGIVSTTLDQFNINNDYGVQASNRTHIFNAAYSYNFGSLVRSRIAGGFVNGWQISGITQIQSGVNLTGQRTQTFGLALNSGKIPGTTQNISSTSLLGTPSITLSPTLTCDPRSNLGPHQFINASCFSFPNQIGQNGPTTLPTIYGPAFFNADLGLFKNFKIAEKRNFQVRLNGYNFLNHPLWSFNGNNLNLGFAANGTLNTPLFGTVTTKQGHRVVQLAATFSF

SEQ ID NO: 21483 - protein, 688 aa, Ralstonia solanacearum
MRPVLPPSPCIGFVALFTVAQHVSAAPAVELGEVLISDEAQSEMEDARERLQAVPGASNLVDMRRVGQGRVASNQDVLAYQPGVFAQSAGNDGIKLSIRGSGINRAPGAHGSGVYTMFDGLPLTGPGGTPYELFEPLWLSRAEVRRGANGFDQGALALGGAINYVTHTGYDAAPLQVRYEAGSRGYQHRHVSSGQVLGNLDYYVALTDSEYDGYQTHSSGSAKGIAANAGYRFNPNLETRFYLRYRETENELAGRLTKDQIKHDPRAANAAYLARDDSRPQPGSTWAANKTTFYLEDDARVEAGLVYHDFPMDLREGPMRLKVAYTDVSGTLNYVRRDTLLGHQSNTTVGWRTTKHLPNSGASQFARTTGDNFGARSRDFSYQGSDTVLHVGNDLELIPDLWLTTGLAMIYTRRESAVTYPQSGGKVSQHDWDYAPRLGLRYDINPQLQVYGNLSRSVEPPHPWSLIWSSTVATQPIELQNQTATTLELGARGDSALGRWDLAWYYSQVRHELLAVEIEAGLPAKEVNASATLHQGVEAGLDSTLWEHAGTGKLSLRQAYTFSDFHYRDDDTFGDNRLPGIPVHYYQAELRYDWPSGFHAGINTQMASKVQVDYANSYHADAYALLGARLGWDSPKQDWQTWLDLRNLTNKRYAATVTPGYDDAGQDIARSTPGEGFGVYAGVSYSFR

SEQ ID NO: 21484 - protein, 860 aa, Ralstonia solanacearum
MKLHPDSKSVTSDDFEVCKSPGENLCCRAAGHLLRRRRDVRAVIGVVKARPPALPLCARRGDDVLTRDLHHTGNLLMNKALVSPAVMAVLYAAAVTAFAQDAAGTDAVPRGSFTTTSTTTTTTTSNTTTSNTTNSNATQRALQLDAVKVTGSSVSLGSGNMEVQSAPKAVSTISRQAIIRGVPGANFTQMLSSIPGAIAATNDMTGLSDGSFTVRGFTADEIGVTLNGVPLNDSGDYTIYATEYGDTENMGDITVEQGYPGVTSPVIGAAGGNIAWVTVDPTADAGLDVSQSLGSNHYRRTFLRYNTGDSGPVRSWFSYSNNQADQWRGDGQSTVTKIDAKSVWTLDDGDAITGALQYTRHVRNGYRNLTKEQIAATGYDFGYVQSYKSADASDWVGTQTNPFRSWIANLDGEFTLSDSLHLSVVPYFVYGYGGGGYGYASTYVFYTFDTFRPGIHVKFKQDVGMRDSLEYGMLVERPREQGSNVFLPADPQGHPADVWGHDSRYYYKNANGSPQVAYRFYSTTPTYRAFATNTWTPNDQWTLTVGGAYTWVQRKGWYSTWPGADLGIDLATPGNSSLYASGANTYKKFTPTGGVKFQLDEQNQLFLGVGKTSRAPINTAALYDFWNAAYASAIGSQTSISDAEPEQALTADLGWRYYGDNLSTVLDLYATNFEHKQFSGADPMTHAPVYYQLGSVQMRGVNAELSYKVNDLWSVYASYAYNKSQMKSDVALGATTYATDGKTLVNAPRNVGYASVNYTGQALWASLSVNAQSRIWGTFLNAGGSDAGGFATVNLNSGYNFHDIGNLKKPYLKVNLFNLGNRKALIFSATTALDATASAASWQLLQDRTLMVTFGGSFAL

SEQ ID NO: 21485 - protein, 813 aa, Ralstonia solanacearum
MNDKRFRKYCSFSLFLSLLGMFELEAKEEEKEERKTERKKDKKKNAQHTLGKVTTQAAKIFNYNNQTTISSKELERRQANQISDMFRRNPNINVGGGAVIAQKIYVRGIEDRLARVTVDGVAQMGASYGHQGNTIIDPGMLKSVVVTKGAAQASAGPMALIGAIRMETRSASDFIPKGKNYAMSGAATFLTNFGDRETVMGAYRNNHFDILLYYTHQNIFYYRDGDNATKDLFRPKADNKVTGSPSEQNNVMAKINGYLSERDTLTLSYNMTRDNANRPLRANFTGTFLPYSCGDFNAFPNEKNPSDCLFENDASLFKTYSVNLVHNVSLNYEREGGSRFGDPKLKINGYTSIRNVQIDPLFRPNDIAAIIPFTPNPELGEENECVAQGGIYDATKQTCSITFKSLGGGSVVANKNLFIINSGFNANVIHTIDHKNDNLFEYGLNYQNLTTFDKAIPNSELVKPGDAPDACLRVRGPNDPNMNGRCQRNGASANVVGVYAQANYTLHPMVTLGAGTRYDVYTLVDKDWQLHITQGFSPSAALNVSPLENLNFRLSYAYVTRGPMPGGLVWMRQDNLRYNRNLKPEIGQNVEFNTEYSSKYFDFRAAGFVQLISNYINQFSSTLFVTNLPAQDIIYVPGYEVSGTAKYKGFSLGLSVARSWPSLKGRLIADVYELAATTGNVFILTASYKIPRTGLSITWLSRFVTDLSYCSYSPYRNGPTDIDRRPSNCPKTPGIFHVHKPGYGVSSFFVTYKPTYKKLEGLSLNAVFNNVFNQQYIDQASPVMSPDEPNQDKYARGMAEPGFNARFEISYKF

SEQ ID NO: 21486 - protein, 1109 aa, Ralstonia solanacearum
MLAMKITLFLLFFVAFQAYSENGYSQSTKISIPRSSLKVSELLSKIESQTEYLFVYNKKNVDTRRWVNVQADNKTVSEVLDQAFKGTNIKYVMEGNNIVLTRNNDNAITAQQDRVTVKGVVTDQNGDPIIGANVLEKGTTNGCITDMEGNFTLNVPSNATLTITYIGYQPQNIQVNGRQSFNVKLQEEAMALEQVVVTAMGIKKKEASLTYSTQQVGGDELTRAKDPNMINALAGKTAGVQITKSSSGLGGSAKVSIRGSRSISGNNQPLYVIDGVPMLNNSNEQASTAIGGTADAGNRDGGDGISNLNPDDIESMSILKGASAAALYGSQAANGVILITTKKGKAGIQKITFSSNLTVDHAICLPEFQNNYAMDPEAKNSWGKNQTLKDYNNADNFFQNGVTAINSVSFMNGSEKMQTYFSYANTTAKGIVEKNKMQKHNLNFRETANFFNDYLKLDANVNLMTQTIKNRPTSGGYYMNPLVGLYGFPRGEDLSEYKNNFEVFDPARNMNVQNWYTSYQDMEQNPYWITNRINSNDKRTRAIASLTANVKITDWLNIQARGTADYTHDQYQQRMYASTAPALAGQNGRYIDLNHTETLYYGDVMAMVNKKWNDFSLNGAIGGSINSTNVNSLRLDSKTASLYYPNVFTVANIKMTQAAYIDEQMNQKRVLQSLFGTAQLGWKESLYLDVTARNDWSSTLAYTKHSSFFYPSVGLSWVLNNTVKLPEWISFGKIRGSWSKVGNDLPLFISNTIPGSNDIIGAGGAIVTYSKAPFNDLKPEMSTSYEIGTEWRFFNYRLDFDITYYRTNTKNQLFTLPSSAGADYKYYMVNAGNIQNEGVEITLGATPVMNDAFRWKTQFNFSTNKNKIIKLHPDLKTFVYGDESFSSSYSMRLVEGGSFGDIYGKAFERDENGKVAFTTDKDGDKIPNVIGGGNTEKVGNCNPDFMLGWSNTFTYKGFSLYFLIDGRFGGDVLSQTQAELDQRGVSLNSGKARDAGYINIDGTQVKPRKFYTAVSGRDGCTEYYMYDATNIRLRELSLGYSLPQSWLAKAGGAFKDVQLSFVARNLFFISKKAPFDPDAVLSTGNDNQGIDVFGMPTTRSLGFNIKFTF

SEQ ID NO: 21487 - protein, 729 aa, Ralstonia solanacearum
MIPFQPRALVLALAAALPSLAAAPALAQEAANPAAAAASSTSTAQATASKVRDLNETRVTAKRLDAARNALSPDTGSSVYRFDTDDIARLPLGDSTPLNQVLLQAPGVVQDSFGQLHVRGDHANLQYRINGVIIPEPISGFGQVLDTRFANQINVLTGALPAQYGYRTAGIVDIQTKGTATDEAGEPKAISGEIGTVLGSNATHEVNLQLQGTKDRFSYYLSGVFAENNLGIENPTGNRNATHDHTTQNKSFGMLSYLLDNDSRVSFMFGTANSRFQIPTRPGLEPQFTLDGVTPPASEALNANQREKTDFQILTYQQKVSPKLDYQVSVFRRASRIDYSPDPVGDLVYNGVASDVSRRNEAYGLQGDASYKLNDRHTLRAGLFVQRERFGVDNASTVFPADSTGAQTSGTPLTVIDNSSGSGTTLGVYLQDEWKPTDRLTINYGARYDHVNTIVSEQQLSPRLGLTFDLTSRTRLHAGYARYFTPPPTEKFDTTTVQKFAGTTNALSPDANTAVKSERSNYFDLGISHQLTPHLTLGLDAYYRDVRHLQDEGQFGNALLFSAFNYERGRIYGLEASANYREGDFGAYLNLGVSRAQGKGIETGQFHFDDAELAYINSHWVNLDHDQRLTASAGVSYKYWGTTWLADALFGSGLRNGFANTDHLPAYWQLNLGAARDFNLPMVGKLKTRLTVLNVLDRSYELRDGTGIGVGAPQFAPRRTFLLSVSKPF

SEQ ID NO: 21488 - protein, 387 aa, Ralstonia solanacearum
MRKLGFVLFVLITAVMTAQEEPLVSNIFQDTYILDALADISAQTGIPIIADTTVTGFITMELNEVPLEQALKMILMPGGYVFKKMDGFYLVGSPDPANPAFRYLAVTKTYKLKYITTADAQELLPAVYKSYVKFNEKNNMVTITAPEEIIQEFEEDLKKIDIPIPQVKISVIVTEVSKDYSNELGLNSLDYSFGSGQEFNENWSATLGLVTGIIDVQTDVFGQILAQLKLLEEDQKAKITADPWIIVKSGEKASLFLGERQVVLLQAEGAVSRIESIDVGVSIDIQPRVMDKEELELTLSPKVSHFAGEKLGTFAVKQNELSTTLFLKNGQTVVISGATIEDSAQTSSGVPILNKIPLIRYLFGGTTKKDSQKELYIFIKAEIQGSE

SEQ ID NO: 21489 - protein, 1046 aa, Brucella melitensis
MLAALMASSALVAPAYAQTPEQAPIPAPQDPTEVGEIVVTGIRASQAQAINIKRNESALVDAISAEDIGKLPDVTVADALQRIPGIQVQRSAGEGSTVNIRGLPQVITLLNGEQYLAPGNLGTAQPNLNDVPSQLMNSIVVFKSQDVSNALSGISGTIDLRTRRPMDFDYGPTVFTAAEYQTGERTAEDDYLVNGLLNWRGDRLGVMISGVMSKSNLGNNYSGISQSVLGNNDWSGPDSTDPNWISPHGYDSFSRAVERERYSLNGAFQFDIEDGVRLTAEVFYTHQQEYNRAAGLNISNRWSGLGWTTPTDFVETGVNGGPNGLPWLNVSEYDLDVWWMNSFTVNRATENESKNFNLELDYDKGGPFTFSARAIKAEANLESMNGQVQGDLSNWEYGPDRTFTLFRQGADRTRGTFYPASIAALYPASRYSNGVVGSQGGRYISPNPFGYGADPQLHISQTGSSLAWSGFDTPLPGGLGTVPLTDYMSNLDSYTVGAYSSEGNQRNNSDLTVVRFDGGYEFQDTPLFGFVNKIDVGVRHSGREVEIRNFHLFSDFYAGQGAGNQAGCAAQWKAIDVVMDNTQCQSGEFVTNPGFNASLPVDATPNSCTAGTVANTPTCFQGYTVNRPTLLRENNNTYFMSDYGSITSGLPGVWVADPRDFDDVRAFQERVFGNAYEVIIPGNTYDVDLYEDSAYTNFALGFGNLTGDLGVRMVRTELRARQNLTGDTRAYGDTNNDVGDTISSRSYTDWLPTANFRYDFTDKLKLRASYAKTMIPLDLGNYGGGVTISTVDSLGPTPDDPSAPPLGIRRVTGATIGGTVELDPWRSTNYDLALEYYFGPATMFNAGIFRLNIESFVKRETVPLSGSYPDGDGIIRRMVDVNRPVQGEGGELQGVELGAKIGLSDFIDTPIWSDFGFDGSYTYSDSSQNAQNLSGEDLPFPDNSEHSMNAAVWYQGDRLQVRVAWNYRTPRLANTFGAIPIYQDTSQYVDANITYDVNDMVTVYANGSNVFGEIEEYYFEFEPGQKQFHSRNQFEPRYMLGVRARF

SEQ ID NO: 21490 - protein, 826 aa, Brucella melitensis
MPAVPMPHPVFHPLAHAARLALLGMALAAGAVQAAEPAPAPTPAPAAQTYQIAPGPLGRTLAGVATAAGISLSFDPALTEGLTSPALSGHYAPQQALQRLLAGSGLDMVARSDGSYTLRRQAAPAGAAAGSTTVLNEVQVTARAERSATSEGTGSYAARAVTVGKGEQAIKDIPQSISVITRQRMDDQNLNTVDDVLASTTGITMYDSPMGGRYVYSRGFRVDTYQFDGVNRAFYYPQADNFTSNAATLDRVEVVRGATGLLQGAGSPSAAINMVRKRPLAERQLEVSASVGSWNNLRSEIDATGPLNEAGTLRGRVVASLNSRDYFYDVASSRTGVLYGVLEYDLSSQTRLTVGATHERLRSTPFFQGLPRYADGADLRLPRSTFLGADWNRWDSEQTSLFAELQHRFNADWTVKATAGYTREKHDMKYAFALGAINPATLAGNEMYAGLFDVTTDNKTLDVAVDGKFDAFGRRHSLSFGANTGRMVNDSDYSLIRMGLPNNVFDPSAAIREPSRAEFLANRYRGDESRTRMTQSGAYGVARLGLTDALTLIGGARVTRFTGSSNYRNTGEAYNDPYKESGVITPYGGLVYALNDQWSAYASYSDIFQAQNAVTAAGDLLAPIKGRNLEVGMKGELLDGRVNAAVALFRIDQKNRAEEDLVNPCSASTYCYVSVGKVRSQGLDAEISGEVARGWQLFAGYTFSHFKYLDNTSNAGVEFASTYTPKHMLRVWSDYRLPGEWSAWNVGGGVNFQTASSRAVGAITDVQPAYAVWSARLGYRIDRNWSVALSVANLFDKTYYQTIGAPAWGNVYGAPRSATLTLRGKF

SEQ ID NO: 21491 - protein, 697 aa, Brucella melitensis
MLQSGRRRQSEDPEVRRPAVSGHPCLNTGRIQARSSVAVTLLKCCRQERNSFALALLQPAVRGKLDRENPSGRLRDKMHILKLSALLASACAATLSPALAQDGGDKDDGVTLDTIVVTPLRRASSLQRSTSSVSVIDAADIERSAAPDLQSLLQTYSGISVKTNGGQGSSADIYMRGMSSKQTVVLVNGVRTASATSGSTALANIPLTSIERIEIARGAHSSQYGADAIGGVINIITKQGGACGERAWCGSVSTGVSHPWGGYASGSLQGRSSDGIDYAVGAAFTGTQGYDFTTPEAFGHEPDDDGFLQGSFNFALSKDFDWGKIYADGLFSRGRNQYDATAPAFNEADSTAFTGKVGTRIDHTADWSSTVEFSTGIDNSRNFRKGIEGSDRFETRRYGVFASTEKSFDTGKVSHVVTGGVEAYREKINTTIDYDETGRDLAAVFGQYSLEYDALRFDGGIRYDHNGQFGNVTTYNLGASYEILPDLVLRSSYATGFRAPTFNELYYPGFANSDLQPEKSRSVEVGLNWQATASTSLDMALYQTRLSDAIMSTAPSYIPYNIASAKVTGLEATLSHRFNEQWGIKGMVDLKRPVDEDSGNDLPYRERFKAAAEVNFKPVEKLDLTARVLYGGSRYTNAKNTKKLGDYVTADFVALYSIDKQSQLKFSVENIFDKDYETSSGYVAPGRTITIGLTRNF

SEQ ID NO: 21492 - protein, 876 aa, Brucella melitensis
MGGSLVFCRVMLVFLTGWSAHATARDYFDPALLGFGSNSGQPVDLSQFETVGGQAPGTYRVDIYVNGTFFDTRDITFQRHGEGNAELTPVLTPDLLEAAGVNISGIPALKALPVDKPIESPLGKLIPQAAARLNFSQMRLNVSVPQIAMKPSTNGLVDPTLWQEGIPAFLLNYSINGSQNQRSQFGNKQTNQSLFGSFNSRLNLGAWRLRNTATYSYSSQTDNRYDSFDDAVKKTTESQQRWNFQQTYLQRDVVALRSDLTIGDTSTGSVAGQVFDGFPYRGIGLATSDPMMPGRLSGFAPIISGIAKSNAQITVTQNGSVIYQTNVAPGPFRITDLVGSSVGGDLQVTITEADGTHHGFTQAYSSLPMMLRQGQFKYEVAAGRYYSSGYGSGIRKPVFGMASMIYGLPGNVTLYGGGLVAQSYQSAALGTGLSLGMMGALSADITTSRTRLQNTPDILRGESYRAKYSKSMLTTGTTVDLTAYRYSTRNYLSFSDANTQGYSVWGELPSWMSERRRSSWQMRLSQSLPGNYSLWLSGQRDNYWGSSKTNTTLSMGLNGSFYRVGWGLNYSIDRMRGNGDWPENRQISLNVNVPLSLFGSYAALNNAYANYSFSRDSTGRSNNQLGIGGSVLDDNSLSWNVSQSQANKGRGRSGSVSMGYLGSFGQANLGYNYDSWGGRGVNYGFSGGLIAHQHGVTLASRIGDAAVLVRTSGVAGIRVMNSSSVTTNRWGYAVVPYAQTYSRNSISLDPSSLPEGADMAQGSKNVFPTSGAVVMVDYPVRIGQQLLMNLTYNGKPVPFGAMAGLKGDTDTNLAAIVGEGGQVYLSGMPPSGVLKVKWGSTPDKQCEVAFNLGPPPVKAKADKRWNPMRQLNETCR

SEQ ID NO: 21493 - protein, 911 aa, Brucella melitensis
MAQDADPAAEAGGEEEIVVSGFRASLESAVGAKKERDQVVESISAEDIGKLPDASIAESIARLPGLTSQRVSGRSNSISIRGFAPDFSTTLLNGREQTSTGDNRAVEYDQYPSEVINQVLVYKTPMASIVGQGLSGTVDLRTIRPLEYGKSVISIGARGSLADLGKLNAGSKKYGYRVNGVFVDQFANDTIGVALSASYVDEPYQIQEFNAWGYAGAGTAASPVVIGGSKSYATSTQLTRLGLQGTLQWQPHPNFTSTLDAFYSDFKDDQIKRGIELPLAFGGAGVNVTDIDESGEFVFARAGTFTNVEGVVRNDVFERKAKLYSFGWNNRWEGDDGWNVTADVSLSKTDRNELIFESNAGTGRGGGVGAVDTIGFRSDRNGTVFSPTLNYGDYDLIQLTSPLGWGGDQTSVDGRRILGGQDGYYNNRIIEDELWQYRVEVERELEGFFRSVQFGVNYTDRSKSLVPDEAFVGLVANTDGLTSVPVPEQFRLGTTDLEYLGLGPVISYDPRDLLAAGLYQLVPNPYGDVVVKAYDVSEKLMTTYVQANIDHEMGSSLLTGNIGVQAIFTDQNSNGASASFIGTNPNGSPNIQGIPQRRSTDYVDVLPSLNLSLRTAGDFVIRFSAAREIIRPRLDDMRASLSYGTTVGDPGGMTCPAGRLCAVVRGDAGNPDLRPWRANAVDLTFEKYFGSKGYLALQLFYKDLKSYIYNQAIPFDFTGYPIAPVGNDSNGNPIIVNFMGTVNAPINGEGGELYGAEVAGTLPFGEIVGALDGFGVTGGASYTKTKIAPTPGAPAEDIPGYSKWVANGTIFFEKWGFNARASARYRSSFVGELSGFGGNRVRRRARPETIIDAQIGYDFQPGSALEGLSIFVQGQNLTDEPFVTDDPRDARAVIDYQVYGRRFLAGASFKF

SEQ ID NO: 21494 - protein, 241 aa, Brucella melitensis
MAASVNAADLDDIIYAKELPVTQPVEIGTGWYLRGDLGYSVDTSGGATSYRVFNAGPPVSYGTGLFNGSSISSDWSGSLGFGYSFTDYLRSDLTLDYSTGTFGSGTGAGADCAGQCANVNGQDFEQYTVMANAYIDLGTYAGFTPYVGAGAGVSRVSWDPISSTQSGEDDWRFTYALMGGLSYDISKNLKLDLGYKYSKVNSGTQFNFTTANVALGATGGQAEDDGIEKHEVRVGLRYALW

SEQ ID NO: 21495 - protein, 797 aa, Brucella melitensis
MQYRYLSLMILVISHSSFAQDDMPYSPPISDDDITHPEVVLPTITVKSAASPVSSHTVTIQDQQIDTHTLGEALEKISGVHSGSFGPHSGSPIIRGLQGNRVSINEDGTNVNGLNAISPATNLLFDPVFSQQITVNKNNSVIESGGRAIGGSVEIDSGLISRQIEDKPQNLTLAIKDGTNAPRSQGIKANMNNEDNLSINLLYSAQRQGHYDIPGDSKAKVCQTDLVRSNEYGLGVNTVLADACQKHVEKTTIFNPKSRQYFYTDYVDPSTLEYTQTYYDYGLSPGDVYTNYGGYGTAENPQYEPDQPEYAERISKINDVTENYHNKLGNSHLDNRRLGISGSYFFDNGYVAAALDNKTSRYGLPGFSMSNLNYNQDYTANVPVQIDAEQTKYLLESQVDLTYDWFNQLNVNMAHIKERNEELLGDDVANHYDFDTYNATVVTQHQPSLGKLGVLSGKLGADLSYRDIRGRGEQRYLPDVDTQKQALFVKESLPLDYLTLGAGYRYEKVTHKIQGSDFSPSSKSPNYEKLLDTDFNLNSYELSAKLDVNDYLAFNLRYANSERAPEVNELYASQAHFSSMAHEEGNQTLDSEKVASTELSALINYQDIDVVATAYQHDFDGYYSLRPSGTTFLANRLPLKYWQQIDTKVSGFEIDASKRFDFDQYGDVTAHLFADLVKNKPKDGETNGEYLTNIPTDRYGIGLNWQNNRWESEINFVHYAKPKYLGKEINTEVALPSYNMMDVSIAKTINGWADSRVKLFANASNLLDEEARPHASPLRYIAPLPGRSINAGITVDF

SEQ ID NO: 21496 - protein, 361 aa, Brucella melitensis
MNRSLSTALKTTLKAVACVAVLASASSAFAQSSVQLYGQVDEWVGSQKFPGGKTAVVVSGGGMSTSYWGFKGAEDLGNGYKAIFTIEGFFRAQTGEFGRFTGDTTFSRNAYVGIESPYGTVTAGRLTTPLFVSTILFNPFIDSYVFSPMVYHVYLGLGTFPTYSTDQGVTGDSGWNNAVSYATPNFNGLSATAMYALGNTTQNGAKKWSGQVLYFHGPFAATAVYQYVNFNNVPGDLGSFETSGVPGLRSQSVAQAGVSYDLKFVKLYGQYMYTYNNQQVTSWHVNTGQGGVTVPFGPGSVMASYAYSRNGGGSNQTRQTAAVGYDYPLSKRTDVYAAYLYDHITGQSSGNTYGAGLRAKF

SEQ ID NO: 21497 - protein, 140 aa, Brucella melitensis
MVDDTTGITYVQGEKTPFTGTVEVKYDNGKVQALMEVKDGFLEGKTETYYPSGKIQSKENYKKGYEDGLNVLYYESGQIEYEKNTTNEGKTVHTKHYYPSGKIDFESTYKNGKLNGEVKKYDENGQLIQQGIFKDGVQVK

SEQ ID NO: 21498 - protein, 2240 aa, Anabaena sp.
MGSGPSGMNERVTVNQGARIETNASAAISVGTSGQVRIEGGAVVQSTVNTAASGQYAKTLEAASNNNISIQVNAQLLAKGSASQSSALGLSGAGNTVTNHGTIRADNAAAIWVTANTANAANTIDNYGTIETVLNGGYANAIGSTRNNSATGAGVTVRNHANGRIVGNVKFEAGDDSVILDGGSTITGSLNGGSGNNSLTLKAGDGTLGRAIRNFGTITKQEAGTWTLNGQVGRNDNNLKSTVKVEGGTLVLRGDNSGATQGGVLQVSAGATADVTAASAMQSISNAGTVQFTQDSNAAYAGVLSGTGSIVKRGGGDLTLTGNNTHTGKVVVEAGSLSVSAANNLGGAGSSVQLKGGALALKKTIVVNRGLTLDSGAQTLIIEPGTTTTWQGQVSGAGKLVTQGGTLVLEHASNTYSGGTEINNGTLRAAHDASLGSGTLALKNSQLAATDSFTATRALTLAGNESIDVAATKILSWNGEISGAGTLVKEGQGTLLLRGTNQQNGGTTVNAGTLQISRDANLGRGALALNDGTLQSTGSFATSRAATLRGQATMEVDASHTVTWNGELSGGGMLRKSGQGTLVLAGANTYSGGTVVEAGALRAGHEDNLGRGAITLQGGDLLAGGSFSSNRDLTLVRGSLDVARDATLTWSGAISGAGDLVKKGDGRLTLTGVNEYAGQTVLRGGKLRVARDENLGRGALVLEDNTVFESMGSHAATRQVTLKGAPKVETLDGTTLEWRGTVDGDGKLYKQGGGTLVLSGNNTYAKGVEVWGGVVQVSRDQNLGAANGAVTLNGGGLAANGDFTSNRQLELTAGAKAIDVAAGKDVTWRGVVNGAGALTKAGDGTLALAGANTYTGGTRLQGGTVQVSRDNNLGQAAGAVTFDGGRLANTGSFATARTATLNKAGQIDTDRGTTLTWNGAIGGKGELRKQGAGTLVLGGANTYQGDTRVEAGTLQVSADANLGQGAVHLHDSRLATTGTFATSRRLELTGRGAVQAAAAATLDWRGTVAGAGTLVKEGAGTLVLAGDNQHAGGTEVRAGTLQVSRATNLGPGALALENAALATTASFTATQAATLTGNAAIDTAAGTTLGWEGAIGGTGSLHKKGEGKLVLVKDNHHDGGTTIHAGTLQVSRDANLGSGQSAVTLDGGALAVSAGFSSGREIVVGAGHGALSVTGGHTLQWQGQVGGAGALTKTGDGTLVLEHDNTHAGGTRITGGVLRVSRDENLGEAHGMLTLDGGTLSTTAGFASRRNATVGNGGGRIVVADAATLDLQGDVAGAGRLVKEGAGTLALGGTNTYAGGTVVEAGTLRVARDANLGGGALTLNNSRLHATAGFATGRDATLSGRASIDTDDRATLQWRGTVNGAGRLVKQGLGTLVLDGDNRYAGGTEVNAGTLQVARDANLGAGDVALNGSSLAATASFATARTATLSGAAAIDTADGATLDWNGLLDGDGALVKQGNGTLALAAANRYGGGTIVKAGAVRIARDANLGRAGTGVTLDGGALATTADLATGRAATLGAANGTLDVAAGTRLDWNGAIGGAGALTKTGAGTLALNHDNQHAGGTLVHGGTLRIARDANLGAAGTAVTLDGGTLATTASLAPERALRVGARNGVLLPDAGTTLDWRGVVAGAGKLTKAGPGTLVLSADNRHGGGTAVTGGTLQVSRDANLGAAAGALTLDGGTLLSTASFASARVATLDAAGGTFVTRDGTRLDWDGAIGGAGGLVKEGAGELRLGNANTYQGPTRIAAGRLAVNGSIASPVTVEQAGVLGGTGRIVGDVANRGVVAPGNSIGALTVAGNYAGTGGSLEVEAVLGGDAAPADRLVLDGGAASGVTPVVVKPQGGVGGLTLRGIPVVVAQGGATTAPGAFRLAQPLVAGAYEYQLLRGAGDGAAAQAQDWYLRTSRVERDKAGRIVKVVPFYRPEVALYAGTPMLMRMVGTEALGSYRERAGQPGAAAPEAGAAARRGVWARTFGRRFERSAGSEAAPSFNGSLAGMQLGADLYTRRSATRHADAFGVFGGYATARGDVRGLARGEIQAVGTSTLRAAQLGAYWTHTGPSGWYVDTVLAGTRYKQQTSSSAHVGATSRGWGMMASVEAGYPWQLNPRWQIEPQAQLVYQQLGIANGADRVSSVSYKTPDALTGRLGTRLAGQYAYGKAQLRPFMGVSLLHDFTGADTVTFAGVHSVRASRQNTAVDLKAGVDTQLGKSVGLWGQVGYGKSVGSGDGSDRGWSANLGLRVAY

SEQ ID NO: 21499 - protein, 342 aa, Anabaena sp.
MQKSLRGTASALALALATTTGMAHAQSSVALYGLADAFVGELHPAGAVGSAWQVGSGGMTTSYWGMSGSEELGGGLKAVFTLESFFRMNGGQIGSFNGQAFFGRNAFVGLSGHFGELTLGRNTAPLFVSTLLFNPFGNSFVFSPIVVHSYLGSAMGSASLQSDTAIDNSVLYQTPEVGGLSGSVLYSNAGVAGHVGQANYSANVLYFAGPFSATAAVQSLHTASLFLNGATAQTAWLIGSAYRFRAIKVFVQYERVDDNNHVADDTVQVGASVRVGIGSVLVSWAGTRRRPEAGDHIHWSTAALGYDYPLSKRTDVYAAWRYDTISHVSSGNSLGAGIRMKF

SEQ ID NO: 21500 - protein, 420 aa, Anabaena sp.
MMQKVSISRLTLAAGMTSMIPPAFAADAGFITDATATLQARNYYFSRDFSDIVGPNQQSKAEEWGQGFILNFRSGYTPGTVGFGADAIGQLGIKLDSSRDRSGTGLLPVGSDGRAPDEYSRMGVALKAKVSKTELKVGELQPNLPVLTFSDIRLLPPTYQGVSIVSNEVDGLTLQGGRLRSTSLRNEAGDDRMRAMLGRTPQAAFSDAFNYAGGDYAFNNKRTSFGLWYAQLEDIYNQRYIGLKHSEPLGDWVLGANLGYHDSQADGGKLAGNVDNQAFYSLLSAKRGGHIFYIGYQAMYGDSAFPRVFANVSPLGNEVPTYEFAERDERSWQARYDYDFAAMGWPGLIATVRYITSDNVSTGMGFEGTAQERDLDIGYTVQSGPLKNVGIRLRNVAARSNYRSDIDENRLILSYTLTLF

SEQ ID NO: 21501 - protein, 393 aa, Anabaena sp.
MTKLFKLSLITATMTMAAFNANAAVEIYEKDGMSFSADGLVNVFYSNSSIDSTNAAGMEEDRTQSRVRTGFLPSNIGFNFAKQLSDVKIGMRSSFWVSLSDSDNNRDASPADLGTGSLIDVRQFYATVSGSWGEVLLGKDFGLYNRANILGDELLLGFGQTSDFFGLVDGGNVSFGNIATGYTYPMPKAQMTYRTPEMNGFKLAVGIMDPNKTAGDSSEELPRFEAELMYNTSFNENSSMKAWVSGVAQTSEINDVEQNQSGIGYGVNVMFSGLSLTASGYSSKGLGHVAGLDHIVGVDTIESDGYLVQAAYTMDDNRFVLTYGESETTNAGNVEVVGIVGDAVHSNTGVAYFRTIVPGVTAVFEYNNTEVDATNSLIAEDNNTFSIGAVVTF

SEQ ID NO: 21502 - protein, 185 aa, Anabaena sp.
MNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 21503 - protein, 809 aa, Anabaena sp.
MVFTSYSIKSKKLCPTILALSVSSILSSQATYAEETTAELSEVNVVAKEDVKASIEKKNKEIIQQELIQNNRDLVRYSPDVGIVNQGRHQKGFAIRGVEDNRVGISIDGVSLFLIQNENSLYKRYGNLNTSRQSIDPELARTIEVSKGADSFNQGSGNLGGGVNYRTLEPYDIVRNGNKFGAFYRTGYGTRNNEWLNTFGVGYLGEKAEAILVYSNRHGHEMKSAGGYTLPEDSLQTRSLRSSKQTPDDSTHNHHNYLAKFAYRFNDNHRVGVSYSGQNNKNYIIEDSAVTITSFWREAEDRSKRDTVNVFYEYFPESKWISLAKIDADYQDTETSAYNYEGTRAEDATDWSPAKQRKPSDNNIRIFNTELKRLNFRLDSQALEFGKWTHQLSFKASTAERDFDVLHKDSVYLSGVWVNSPDSTMMYPIKTKQHTFSLHDKIDLTHDWIATLGIRYDWAKYEQQELNGLVCRNCVKTDNAKFNQLTWVTGLEKHLTEAWKVGYNIGTGFRIPNASEMYFDYRDNAAGAWMSNPNLKAERSLSQNLSLQGSGNVGLLSVNFHHTKYKDFLWEQETWDVYQAYGREFWRPVQQMQNIDSAKIYGLEVSGKWNLNSAMPIPEGWKLFGAFGYSKGSMSNGADLLSIQPIKAVVGLDYEQPEGKWGVFSRFTFLGAKKAKDAKYLKTLPEKCLKEDRTPNPYYPYWGDEYDIRCTEYSHETGLDTWKHLNAKAFVVDLYGFYKPTENITLRAGIYNLFNRKYHTWDTLRGLNTTGGIVNSVGVRENATYGGYPGLQRYYEPGRNFSANFEYRF

SEQ ID NO: 21504 - protein, 735 aa, Anabaena sp.
MRKSEALCGSLGMALLAASSGASAQVSQTSNIDGGIADIVVTAQRREESAQRAPIILNTLTAGDLQGVSDVRELQYAVPGIQFANAGNAVQTYIRGIGSFNAKSVQESAVAYSVDGVYLFTTTQVSPALFDLTRVEVLKGPQGTLYGRNASGGAVNIITQGAKLGEIEGFVSGEAGNYDLLHLTGAVNIPVAETLAVRLAAQHVRHDGYLSDGTSDDDTTAGRLRALWEPRSNLQVKLNVDIARVRTKGPGSVVFPFVDPDHPWRGALDPALDTGLSRVSGFRPLERPRNRLDQWSASAELDWDFGFATFTLLPAYRHEHIDQVSYVPGYGTAEDAHIKQSSLEARLSRDSGKLKWVAGAYYLDVDIAQTFQINNPTPPVGRPAVNFLDNPNKLESWAVFGEATYELTERFRLTGGLRYTWERSISGGFQNQTFPAPLATPAFLPGTEPGDFVVDERVTDDAITWKVGAQYDIAAESTIFATVSRGFKGGGSYVDAASVDPTFEPETVVAYEFGSRNRFFDNKLQVNLEAFWWDIKNQQIAFLGFNSLNQPKFQTVNAANAKAYGGSVDLVWRATRNDTLRFSTEFVKSDYSNFVRVQPAAPIGTRCATAPLAGRVAIDCSGFPMMRTPKWAGSAGYEHRIPLAGGAKVTLAGDMTFASSRFTSIDFSPVTRDKGYAVFNAEAAYHAPDDRWSLSLFGQNLTRTAFLTGGLQSGTINRPTINQPRTYGLRARMNF

SEQ ID NO: 21505 - protein, 686 aa, Anabaena sp.
MKYYCLPLILPFSQAVVADQKSTDSIEVITTTASRVEALSTPLPLSISTLTEAQLKSIAPTHIEEALQRVAGANVQRGNGQEYLPALRSPVLSGAGACGGVLTLEDGIALRAAGFCNVNELFESHSEMAQRIEVLKGPGSALYGSNAVHGVINVITPDTTQGGGLFGVDYGSYGYARVKLRAGQDYGNSGIGINASITDDTGYRDDESVKQQKVNIRHRLERDNLLLTSGITYTHLDQQTAGFITGFESYKNEDIAQQNFDPDAFRKATSLRAWSNATWQLANNDVLSTTVYMRDQSMDFFKHFLPGTPLEKNSQTGIGVQSLYKHSINNNVTLNLGLDGEYTQADFLQSQNEATQGSAFLVATVPQGKHYDYNVNATLYAPFASVNWQLNKWLLTAGVRYEHMQYDYTNNMLAGRTKEDGSECGFGGCRYSRPASTKNSFSNASPKLGISYQYNSNNTFYANFSRGYRAPQAAELYQLQREQTTANLNPEIANNAEFGIKGLYNTFNYGLSVYAMSKHNTIYRDSDFFTVNDGSSRHRGVELELNYQLPNNVSVNFAGTHAKHSYTNNQVINGLNINGNDIDTAPRNIANIDITWQALNNTQFALQWHHVGHYYTDPENLNEYEGHSVLSLRAQWQATKNLEVMARIINVTNKAYAERADYTSFTGDRYFPGKPRNAMISASYSW

SEQ ID NO: 21506 - protein, 133 aa, Anabaena sp.
MTWNPLALATALQTVPEQNIDVTNSENALIIKMNDYGDLQINILFTSRQMIIETFICPVSSISNPDEFNTFLLRNQKMMPLSSVGISSVQQEEYYIVFGALSLKSSLEDILLEITSLVDNALDLAEITEEYSH

SEQ ID NO: 21507 - protein, 177 aa, Anabaena sp. [sequence omitted]

SEQ ID NO: 21508 - protein, 812 aa, Anabaena sp.
MRHEGRVGRTGRRAALVAGASVAVLVMGGVGAAGAASAPQVSQAAAVRSFDIPAQSLAGALTLFGDQAGVQIAAESAVVAGRAAPAVSGAMAPEEALRRLLAGSGLLWRFTDATTVVLEKPAAAGGVTVADPVTVEAAPLRQSPTGPVAGFVAERSITATKTDTPIVETPQAIAVVTADQMDKRAVQNVGQALGYAAGVVAQPSGADARYDVPQIRGFSVAEGQYLNGLRIMRGFGAPSVEVYGLERIEALRGPSSVLYGQASPGGLLNMISKRPVDEAFGEITVEAGSEKRFQGGFDLGGPIADDLPLTYRLTGVVRDSGTQMDHIDDDRYFLAPAVTWKSDDQATRVTLLTQVQHDRSGSPLGLPLAGTLYDNPLGKLSRDLYLGEPDFDESARTQWSLGYEAERRVNDQVTLRQNARYMALDWDYQGLYYAGLASDNRTAYRGTSYQNEDLDTVNVDTQGEVTLGTGPLAHTVLGGVDVRYFDAHTKSLFGSAPSIDIYNPVYGQAIAAPTGSATDKTQRMTQVGLYVQDQIRWHDWQLTAGLRHDVATIRTKIKGKGGGKQDDAATTGRVGLSYIFDFGLVPYLSYSTSFDPQTGTAAPQRGGGNFDSSQGRQYEAGMKFQPKGYNSFLAASLFDLTQTNVKSSDPLYSGYSVQTGEITVQGFELEALASLYEGLNLSASYTLQEAEITGGAASEKGNRPANVPSQTASLWVDYTIQPQSAVGKLGLAGIGLGGGVRYVGERYGDNANTIKLESNTVFDAEIGYERETWKVALNLNNLTDEDTIGTCTAFGCYYGDGRTVVGKLTYRW

SEQ ID NO: 21509 - protein, 1158 aa, Anabaena sp.
MSTVGRFRHLSSLLLCTTFLVSAPMSAVLYAAESPSKSKSVAKSVLSPELQTKFSDAMRQGERALIAQAYDSTYRDPGLRDAVVRHVSTLAPTALRDVTTAADLGVLTSGQRMVLAPNAAQVLATRTASASGLTASSYQNVAMAVNNSPNLPNPMPSRTEQTWNLDMIGAQGAYNRGFTGAGVTVTVADTGFDTTNAGLVNKLRTNLGKNYMVEIGKAFDPNDLSPESAQKTDIHGSHVAGIIAAEKFDNVDAHGVAYDASIIPLRAIAEKGYTTYGNVDSSALALNYFASLSGTMVYNASYGPNSDGLTNLKLWTVGNIDDEANAAFNVLKAGKIIVAAAGNDRADNPIAARNANGLALLPFFNPAHAAVGVYDDQGQQLDGSALQHQQGQIISVMSVGITKAAASYSNLCGVTASWCVAAPGGDDATGALVYSTVPVNTYGFAQGTSMAAPTVSGAIAVLIQANPSYNAQDLSRLLFSTTEDLGAPGVDAVFGYGLIRLDRATDGPTTLAANTAVSVVADQTTYWSRLLTTDGDFSKVGSGILSISGRTNASGNVFAQLGTLAVDGTLTMSAGHRLEVAQPATLAGFGTIAGDTVIAGTLSPGKMANIGDLVSNNVVPAGTVLNGNSVGSLTFNGNVTLTSTATTRIDIDGSLIVPGGPGTYDKIYVTGAGNVFYAAGTLTPVLRGSVGTVSNYTPAIGTEFAFVQATDGASTAGSFSKLVQPTSGLPANGRFDLIYNPTSITLVVTPSSFSQLADADKLGPTQRSIAGILDKDRAASGEMPTANEKALYDALYKLNSEAEFDKALNQLSGPGQPAMASAPLQAFTGFLGAIGDRQDMLTSGSEIGQNGTAQSFAMSYAGRNTMSAGTNAAMNAFASISPAERVQDGWSVWGQGFGRNSRVGDSGDLSGSKAVSAGFAVGVDRRFSNSFNAGGAFGYTRTTATSTDMQGTVDTYAGAAYASWTPGAAVLDFRIAAGPSQMATSRQILLSPTSLQGSANGVGVGTTFEAGYRFAMGHDVTLKPFVGMTWQGFRRDAYSESQLPIGLVYAARTYDKLTSTVGAAVSARLRTTDGTTLAPELKVGWGYDLRDTTLVSEAALLDEAFLVDAAQPGRNAALVSAKLSGWRTETFRMFAAYTGEYRSNATSHQVSAGARVNW

SEQ ID NO: 21510 - protein, 348 aa, Anabaena sp.
MGPYDVYGPAFLEGYNFQWTTNVMQFHLQDSIQLAQGLTLHAGFKSMTATTSGGAQYNNADWTGADALPNGSLTASQAFLPHVNLDWHINRHHEIYVDVAENMRAYEVSAYGVANSVYSVQDQATFQAQKKSLEPSKAWVYLGGYRYTSKYLQANATVYHASLIHPILAAAVGSLTNPVSQVIDFGHISMTGANGDITVTPIDGLSISNNLSYNKGMYDRNVDTVGGYYALAGKNIVNYPAWMYKAAIAYSWKGMTAHFDANYYSRHYYSFMNDTSIGGYWLANAGAQYRFGKLSVLKDVTASFNVYNLFNTKYISMMGENDNPAVGDYQSMERGAVREFFGTISASF

SEQ ID NO: 21511 - protein, 998 aa, Anabaena sp.
MLIIVNITVKLTIMKQFSLSYFKVIFFLLFPSLLLSQEVLEGKTINDATGEVVPFVNVIEKGTSNGTTSDFEGNFSISVPSLPTTLVFSYLGFETQELNVTENSPLTISFTESAAALDEVVVTGLATSVKRTNSANAVASISADELTGTTPPPTLDGALYGKFPGAIVNANSGAPGGGLSVKLRGATSIQGNTQPLYIVDGVYIDNSSIAAGLNTVSAAAAGGSASNQDNPTNRIADINPEDIANIEILKGASAAAIYGSRAAAGVVIITTKRGKAGETKFRLSQSVGWSEAINLLGVRDYTEERVLDSFGEDDLEAFIAARDAGRLVDYENEIYGEKGIIAITNFSMSGGSENTKFFAGVTHNNEEGIVKGTGYEKTSLRLNLDHSPEDFLKFTLSSNYIYSASNRGFFNNDNSGTTIGIALTRSRPWDQLFPNEDGIYPDHPNNSSNPLQTRDLVTNREIVNRLIMGGTANLDIYRADSSNLELILRGGLDFYGQKSRAIFPKALQFQKISNGGLNGVSVQGDTQNKNYNLSAFLVHNYFTDSDVNFRTQFGVTREYFDQNIELITATGLVASETNVDQAANTGVNQTRLLQEDSGFFAQEEVNFQDKFIATLGIRGDKSSNNGNANDLFYYPKASLAVNLNEFGFWNESSAWNQLKLRAAYGEAGNFPPFGALFTSYNAFSTDGILGISLIGIRGDGDLKSERQKELEFGTDVSFFENRLSLSATYYIKTIEDLILQANLEPSTGFTTQFVNAGSLRNKGVEIGLNATPIFTDDMHWNVGVNFFKNTSEITELDVPPFNIGAFGASLGTFRIEEGKSATQIVGGYPEGLRVIGNAEPDFQMGFNSDFNYKDFQFTMLWQWKNGGDNVNLTTLLTDLNRTSHDFDDFGADPSGELTNGEYRPGAPPEVHVEDASYVRLREVGLYYTLDDDIISGILNGSIDSVKFGLSGTNLLNFFDYNSYDPEVSNFGGASIFTGVDVLPFPSSKRFLFNVAVNF

SEQ ID NO: 21512 - protein, 723 aa, Anabaena sp.
MRGCAAGCIALSFGLAIAAARAEQALPQVTIDAPAEARPKPPRRHAPEATARHGQAIPAPTPGASSSAAAPSASATSDAMSAPQNQTASSRVITGVEINALPFMRPGEALEAAPGLVVTQHSGEGKANQYFLRGFNLDHGTDLAITIDGMPVNMPTHGHGQGYADVNFLIPELISTMTVRKGPYFADVGDFGSAGALGIEYLRAMPKNLAEVTVGSFGYRRLLGAGSTRVGDGTWLAAFEANTYNGPWDVPDNVRKLNGVLRYSQGTATDGFSLTGMAYSNRWTSTDQVAQRAIDQNLIGRYGSLDPTDGGTSSRYSLSGRFAKSSDLGQTDINAYVIRSSLQLYNNFTYFLDDPVNGDQFNQHDRRTVLGLNGTQRFDYRFAGLPVETRVGLQTRSDTINVGLNKTYQRDWLSTVRADDVSEQSLGLWTDTTVRWTDWLRTTAGVRQDFFTGRVISDTPANSGNASAAMTSPKAGIVLGPWVGTEFYGNAGTGLHSNDIRGATITVDPNSGDPVNRVPLLVRSKGAELGIRNKSIPGLTTSLAVFVLDFDSELLFVGDAGTTEPSRPSRRVGVEWTSQYRPLSWLGVDLDVAYTRARFTDIDPAGDFIPGAPAWVASAGITLGEQRGWFGALKGRYFGPRPLIEDDSVHSLSSLIFNARAGYRFDNGVRVQLDVLNLFNAKTNQIEYYYLSRLPGEPLGGVNDRHVHPVEPLAVRLTLAGTF

SEQ ID NO: 21513 - protein, 715 aa, Anabaena sp.
MRRVLHPARRAVLAAVACQPIMVVAAFAQENTAAPTSATTDMLPAVSVNASAVRDPGEGYNPTNAVSATRIDAPLRDIPQTVNVVTAEVMRDQHANSLQDVLKNVAGVGFSTGDGQRDQVTIRGFSAIADQFVDGIRDDALYFRDLSNVDRVEVVKGPAAVLYGRGSSGGLINRVTKKPGVDVTNLGVSYGSWADRRVEADVGRVLANGAAAFRITGAHEEAKSYRSQQFLNRTAVAPSFEFRIAPKTTVLLQADYLEDRRVTDFGIPAYKGRPVDVPASAYYGAANAGEVDYSRSRVYSSTATIKHEFNEQWSIRNATRYYHYSLDRNNTLVGSVNEASRTFTLNHGNVYREEHGWFNQTDLTQKATLFGMKHELLYGMEIGQQNKDLVNYSAPVAGANGKPMNFDLFAPALPTLPLHTSTTPATNNLGIFKTLGFYTQDLISFNDQWKALVGIRYDRFEQETLDRRPKQPGLSRTDTAWSPRLGLVWQPTRTQSYYVSWSRSFQPSGEAFSLAANNAELAPEITTNTEIGAKYDWLGGKATTTISVFRLDRSNIKITNGAGTALIPIGEQRTDGVELSGAAELSHGWRVLAGYAYLDATVTNSTAALQGKRATLTPRHSGNLWLTKNLGNGFGVGGGLNFVGARMADPQNTVTLPGYVTADMMAWYARGPMSLQLNLYNLFNKGYIVSAHGSNANLNLPGAPRSVMATLRYEM

SEQ ID NO: 21514 - protein, 388 aa, Anabaena sp.
MMKRNVLAVVIPALLAAGAANAAEVYNKDGNKLDLYGKVEVQHKFANNKSGEDGDNSFARLGFKGETQVNDQLTGFGRWEYNIKGNRAEGTDEETKTRLAFAGLKLSNYGSLNYGRNYGVVYDVNAWTDVLPVFGGDSMAQTDNFMTGRSTGLLTYRNTDFFGLVDGLNFALQYQGENSENTANSRINRKDNGDGYGFSATYDVGYGISVGGAYSNSARTSAQKTAFSVVEEKGKKDKPTGSTALGDRAESWNIGAKYDANNIYLAAMYGETRNMTRFGGNVDGVNWENIANKTQNIELTAQYQFDFGLRPSLAYVQSKGKNLLGDDGKESSSRDLVKYISVGSYYYFNKNLTTYVDYKINLLDSNEFTKATGTSTDNVVGVGMIYQF

SEQ ID NO: 21515 - protein, 774 aa, Anabaena sp.
MKKLFLYVIGSLIIQPVYSQHLIKGTIIDSENTVMPMVNVAFLNQADSTLVTGAVSDSCGVYSTSLAGGNYIIRYSYLGYETLFRNIQVNANLTLPVVKMELAQTELEGVEVTAYRKPFKLDREGITADVPNTILAKQTTLDDLLCKIPGIQKRGEDIEVIGRGLPTYYINGREVTDQTELDNLAIDQIQSVRLVTNTGVRYHSEQRAVIEIKTKRLGEGLAFNVSGNLLQGNYLSQNYKMNGSYNYKNWDFFFSYNYDRGKKDSNLDVYQQTQSDTIWNLTDLNRKQIFNESHAYTGGVSYHFSPESEIGLKYEGKYNEGNTFSKDTLSMIPDKGTSTFIRNLSDVSDKSVSNHLNLYYTNDWKNGWRMNAFGDYLHKTDRSRGNIREWESDGVETSMDYYRKADWDLFAAKLSLSYETGKAGTFSFGYDFSHTTGTDYIEYVRALNNGSTSNTEMKNSLYLSYDYTWNKLSLGAGLRYEHIRSDLKENSSNKSQNQTYHNFLPSVSLSYNTESLQQSLTYSVHTERPPFGMMNDNAVYTDRFTYQKGNLYLKQALTHDLNYMLFYKFLFFNLNYTHTHNPLITAFYSMPGNSAVTVSYMDNFDRMHNLTGMVNVQYPVKWWLPSLTLTCLKTFFNYPGPNESVLKAGRPLVMLNFNNSFTLPSGFLLSADFNYGSRGYYQLYEAKSYTSFNLSLKKSFLKDKLQLSLDAYDIFNKNNTRASARLNDIIMHSVGKEETRKVGFTITYRFRTEKKMNNQSAAETEMSRLNMDNQ

SEQ ID NO: 21516 - protein, 1126 aa, Anabaena sp.
MRGLRSICAVFLLCALCAGIAFSQAVNGTIVGSVTDASGAAVANAKVTLTETNTKISRTALSNETGTWGFPNLQPGTYEVAIEMTGFKKDVRSGVILEANTSPRVDSKLEPGALNQTIEIVANTAVLQTERADTGRSIDAVTIEELPLGVNRNFQSLLDLVPGTSVETFQHSQFFNASSSLQTNVNGMPRQGNNYQIEGIDNNERTGLLQILITPAEAIQSVSISTTNHDPELGRGTGAVTNVIIKSGTNKFHGSANEFLQNSAMDARSFFNPTVGHLAYNYFGGNIGGPIKKNKLFFFANYLRTLDHEANTNQTNVPSNEFRKGDLSGDPGHIVYDPLTGSQDGSGQNRTAFPGNIIPTNRINPVSLKLLAFMPPTNEPVVATSQTNDYFALLPARKHNNQIDSKIDWTLSDKDRISGRFSFARPVIFQAPIFGDAGGPAQSAFAGTGTQKTYSTGINYNRVVTPTLLTEVRLGVAHYHNEAFPSDYGKDDSTAIGIPGVNLGPFTSGMVGISVGGYSSPMFGYSASLPWDRAEANIDIVNSWTKIAKNHQIKWGIDLRRVRDDLLQDQTFSPRGVYTFGTQQTAKQTCTVVPVSGPPSGCTGSSQGLANDMASFLLDVPNQVARDVNTYFPALRQTQVFAYVADNWQVSPKFTVNLGVRWEYYGPPTPHFAGGFSNYNPSNNTLEIAGVGSNPMNLGLKPDYKYFAPRLGIAYRLSSKTVVRSGFGISYTPFPDNTWMYNFPVRSNNSYVSPKGTDNYAPAVLPNGQDPTFQNGFPAPAPVFVPSNGIITNPDPSTAQFYIPTDYKNGYIETWNLAIQQQLPFALSLDVAYVGGHGVRIASAVNLNAGQVIGAGSAGQPFFAKYGTTASITQDFQGFSSTYNSLQVKFDRRFVNGFRLTTAFTWQKAMSTQTGDDGGLYFYAGQGLDRNYARADFDRTLNFVQSYIWELPFGKGKHFAHGGGIAGKVIGGWQVSGVMSYRTGGPLSFTGSNSLNLGSGGNTTLDQIAPVHILGGINTGNPWFDTASFARSATNVQGTTGRNIWSGPSLFSLNAGLSRWISFNEGKEKLQLRFETLNTLNHAQFSNPNTGFGSNFGFITGTLSSGTGVNGTGGGRVVQLGAKITF

SEQ ID NO: 21517 - protein, 863 aa, Anabaena sp.
MWGAQKMIKILEQTSLAVLIGLTALHSGVALGSVGESNLSEKEKLEDQELQNEYKANVKIENWQQQISQAQIKEVIQIELKDTQTGIELILKTADQSQLIPLIISEDNILIIDILDAVLRLPDGENFIVENPSEQISQITAVQTSSNSLRITVTGNGTVPAAQVIPSSENLILSLTPPINTVESEEEIEIVATREEEAAVQEFFVPNTSVATGTDTPIMDTPFSAQVVSEEVIRSQQAITLEDVLTNVSSVTFGGTTGGRETIFGIRGFGNQFSDTVPILRDGFRLYGGFQGITEVSHLQQVEVLKGPSSILYGQIEPGGVINLNSKKPLNEPFAEVEVQLGNQGLVRPRFDISGGLNPSGNLRYRLNGVYSNEASFRDFNQPLERFAYAPIVTYAITDDTDLSLAVEYINDTNPADFGLSSFGDGVAPVPRSRVINDPSDIVNKNFISAGYNLEHRFNENWKLRNAFRYMSYNYDYNVIALPTIVNGPTVTRFFADQDGQQGSYSFYTNAVGKFSTGSVKHELLAGIDYNWSEESILTLFGGPTSINVFDPDYNAIPKPNRSDLPLFGDTFTSSNRLGIYLQDQVSLLENLILVAGLRYDTITQNTNNLQTDFNQGGNTQQTDSAVTPRIGLLYRPIPEISFFSNYSQSFTPNSGIDISGNPLEPERGEGFEIGVKAELFEQQLLTTLTYFNISKNNVAVSDPVNPLFLSTIGTQQSQGIELDIVGEILPGWKIIGNYSYINAKVTEDTDPNFVDNRLFGIPYNMANLWTTYEIQSGALQGLGFGIGFNYVGDRFGDLANTYTVGDYIIGNAAIFYQRDKYRVALNLRNFTNANYVRAVSGNQTGIEPGEPFIIIGSFSVQF

SEQ ID NO: 21518 - protein, 596 aa, Anabaena sp.
MSMIWRKLGLINPALVGLALLLPTTAIAAESLELTEEVVPEISAVEQLDTEAVEASEPLVLADADVPTTSVSELMSETQDDNLAQVTSVSQLSDVQPDDWAFQAIQSLVERYGCVAGYPNGTFRPSRAMSRREAAALVNACLDNLSNRFATKEDLDALKALQDEFAAELATLRGRVDGLEARVATVEAQQFSTTAKLNGEVVFGSAFVFDGDNDPLDSILGVDTDTGNTQNNGVVVEDRFFLGYRTRLNFDASFSGTDRLRVRLEAADIPELDEFGSAGTSLARFGFDENDPAGNTVILDELNYRFKPAEDLTLKIAIVGGDYKDDVETFNPFLKSSGSGALSRFFRFNPLTQRGPGGTTLSAVYDVSEKVNLSVVYAADDAQFATTAGNGANNGLFDFENGTYGVFAQIGFNPTDDIGIGVQYSRNEYTAGNVDITSDTGDAPVLTGGLALGGDTSDPFNGLETITDNFGLSFNARVVDGFHVSGWGGLTLARTPDIANSQIKLLTWAANLVFPDLLLEGGRGSLSFGQQPYIIDGGNLNIDDGTSSNFTAEAQYQFKVNDNIKISPGLIVIFNANNTSSNDPIFIPVIRTTFKF

SEQ ID NO: 21519 - protein, 707 aa, Anabaena sp.
MRISLLLSTCSAIAIFTLSNPALAEDERAEKAALHEQTPANIIVTAPFQRDRSDILSGASVLQGSDLTQAIRPSIGETLQHTPGVSATSFGPSASRPVLRGLQGERVRVLVDGIGSIDVSNTSVDHAPVVNPLLAERIEVLRGPQSLLFGASAIGGVVNVIDKRIPRSVPDEPVHIDAIATYGSAADERSGAGSVDVPLGDKFVVHADGSYLKSDNMRIGGYALSPSARAQALASSQLPAEEPEEGEEAIDFAGNAAIRGKLPNSQAKTWTAGVGAALITETGNLGVSYSHYDSLYGVPVRYATLPGQEQEAPRLDLAQDRLDLRAEVETGGGFLKAIRARASYADYRHFELEESGEVGTAFYNKGMEGRIELVQADHGPWQGASGVQYYSRNFNVVGEEAFLPKNDTQQFGAFTLQTLDYGAVKLEAGGRYEHSELQALPLEDQDQFFAGKRTFDTFSFSGGASYGFNSDWRLGVNLSRSERAPSAEELFANGPHAGTQAFEVGNPDFKTERAWGVEAVLRGKGDNYSFEASAYHNWFSNFIYEGLTGEEEDGLPVYQFSQAKARYYGFEAQGSVTLATFGEAKLVADALGDYVHARIVGEGPAPRIPPLRLLGGLGVTSPKVDVRGEVEWTDDQKRVSDFETETKGFTLVNAQVNYRPWGTERPLSFALSANNIFDVVARRHASFLKDFAPLSGRDIRVTARVSF

SEQ ID NO: 21520 - protein, 1075 aa, Anabaena sp.
MKRAVLFTFLILLVISSIAFGQQTTGQINGTLVDSSSAVVPNATVTAKNVDNGLTRSTKSSTTGGYTINDLPPGTYTITTEAPGFAKTVNERVPLLVGQALTLNFTLKTGGANETITVTEEAPLIESTRSDIGGSVSPLEVKELPIVDRNFAGLMATVPGVRPAEAFDPTKTRSGNVSVNGSDGRSIDYNVDGGDNKDVVIGGIVQNFTMEGIQEFQVTTDRYTAESGRAAAAVVNVISKSGTNAFHGTAFSLFQNSGLNSNSYFNEIAGNPKNKFHRYQFGGSAGGPIIKDKLFFFGAYEQKREPQDIGVDPSAFDNLTLFAAAFPDYAVPIRKLDYSYLDQQLTAKVDHRISDRQNMFYRYAWEKWTNPNDQLGFPFVADASQSTSDSNSFHDFVAQHNYTISPTKVNSFNFHLQDFTNDILPAPGRTFTYDVAGGGTATNPEICFGIGGGCGGGVPEVGNNVNVPQETLIRKYQFRDDFTWVHRNHNMKMGVNWDYVDVMGGFFYFGANGYQVIFQDDPKTILANPAAYPDGFSTRGAVGELTYNGGSGSTAQPPSHQLAFYFQDDWKVTNRFTLNAGVRWDANPLFLIPQLTNNFSSTNRTVRVLRDVLAANLSDPAAQAGVQRADYLAGNTSLASKNTADWKEFQPRIGFSWDPTGSGKSVIRGGYGIARDTIFQNLTLFAVQETNPTIYNTIIDYFPSQAPGSCPAGGTADPTDLCNFRFGIDPLPAPQAATTDLAPGAVGRMQDPRLTDPWSQQMSIGGERQFGNDYAFGADYYHVLGTHEPRVLNMNPKIGSTCDPAYGGDPTNPTCVNGAGTRLMDAAFSEAPDSQIAGQNLGIGRLGAIYDYSTSNRSLYDGINFQLRKRMSHHFQFQASYVLSWARSWGGRPTSSYSGSGVNVTPEQQFASNEFNYSSFDERHRFTLSGVFQLPWGFEVAPLVQAASARPYDFIAGSDINGDGRSTIDRACVGSTPGNPIFTKGCTMLKPDTLRGDPFFQIDTRVAKAFKFNEHMTLQLIWEFYNIGNVNNFCNYYFNNASQSNFGTPQGYCGGQGGPAFTGPFRQQFGFRFEF

SEQ ID NO: 21521 - protein, 432 aa, Anabaena sp.
MKRVVSSMLTCAAVLAMATSAVAGEREGAFSISPFLGGYTFDGDQHLKTAPVYGLRLGYDLTKNWGVEAVADYLATEGTHNGRSVNALSYRLDVLYNFLPDGPLVPYLAVGGGGITYGHGHEGLKVSDRTTDATINAGGGIKYFVTDSVALRADARQLFLLESPDSPKYNWEYTAGLTFLFGGKTAPAPVKAPTPAPKPVVEPVPVQKPVPAPVVAPVPPPAPPAPSADMTVAPSSITKGEAAILAWKSSNATNCEIQPEVGSVKPQGTIKVVPADNTEYTITCNGAGGTANSAAKVAVIAPAPVVVAPPAPAPKLCSPAVINIQFDTNKADLKPQYRAELKALADFLNEFPNATGVIEGHTDNVGPKALNMKLSQLRADKIRNSLIKEFGIAPERIKAIGYGPAKPVASNKDKAGKAKNRRIESNFTCNNK

SEQ ID NO: 21522 - protein, 620 aa, Anabaena sp.
MKIFTLLSLIFSIVFASESNLDDLLSKYRKANELHNQTKDESAGHVSVFSRSDLDKMQAYTLNDVLKTIKLFTLKNTNFGFTSLVKTPYSENSMSSIKIYINSYELASVTSGSGLAQFGKMGLNHIDHIEIYQASNAIAFHGEAGNMVIKLYTKNPSRENATVAQAAADSKGGARGQVIDAQSFGEYSYLANADVSSNKYDKKQSPNGSIFSRDGDRGQFYFNFAKRDDYTIEAGVAVESYDLYSGFGNKINDGDIKSKYSYLNFTKQLPQNIELIFSTTYETIEIENSDFSGIKLFDGSLSKNMQVENGSYVYDFILQKRDTYKDNRFFYGVQVKQKTFFLDKLKSNGVEKSVILGPKNLDIYMLFFEDTYSINESNKIIFGAKLDYFKNHTTPSDIQNIMRLAYISNLTNELSFKTFIQNMYVYPQIAQTTFSPIYDANPNLKPSKSHVMKAELEYEKDDITITLSGGKAKAKDGIVFNRTLNMFVNNDGNSNFSQVSLNAEYRFSTENKIIAEYFKAFKENANLSPDSGVLLQLYTTFGKFDIYNELVYRSSYTGIDNVYIAEGYDYTAGAIYHYNKKINIKLKGENIFDKAIQSSIKGTTLPSLERRAILTMEYIF

SEQ ID NO: 21523 - protein, 296 aa, Anabaena sp.
MFTAIEQKISSHDYGVNCSYRFVAGEKGYFRILGGVSYQELKGEQTRLIPGISPNMNPTKFPFPGPVRVASLDAEDQSVGWRLGAAYEIPEYAMRATLVYQSEVKYDLEGTIDNLVLNPITGRGMPLNVESDVATPQSVEFKFQTGIAPDWLAFGSVKWTDWSSITSVDFVSSDNKIAPKGTKITSLNLYYQDGWTVSGGVGHKFNDQWSAAATVTWDRGTSTGLTSQTDVWLFGLGTNYKPTDQFEVRLAGAAGWLSAGDLDDTMIAGVSNPTGSKGEFGNDFVGALSLTAKVKF

SEQ ID NO: 21524 - protein, 1009 aa, Anabaena sp.
MFYKGMRERPMRGLRTGLWRGASLAAISIAMVSTSVYAQDVEDEDDSNTEVITVRGIRSSLQSAQEIRRNSDVLVDAITAEDIGALPDRSVAEALQRVPGVNITRFEGENDPDHFSVEGSGAIIRGLNFARSELNGRDVFSADNGQQIGFNDVSPEMLGSVEVFKNQSADMIEGGLAGTVNLNTRLPFDQGGRMMAFTLEANYSDFAEEVTPTMSGIYSNRWELGNGSEFGLIFGASYSELQSRADGTLVAEWLDRDPSDGQSLYVPSGAGIRTQLFDRTRDSISAAAQWRSADGELEATAQFFRASYENAWSERAVEPSIDSGPAITPAPGTSFTYDDNGLFESGVISENVGWRSNDPTHPLNGVRQLALARGKTDESLTTDIGFNLRWSPTDRFRASFDLQFVESEVNIADVTVHGAFFSDIDLDVTGDVPSVIYRRPADGSDPYFSDASNYYLRSAMDHLSDNEGESVAFRADAEYDFEGDSWLRSVRFGGRVSNREQVVRSSVYNWGNISATWNSPFALDNPAIPPGTFELYNFDNYMRGMTTGLEGGIPMYTGALGEDYDQAVAAIMAMRNAAGNGGWVPLAQRGGVVAGTPFLPSEITDVTQDTTAFYGRLDFDNEHRSDGIRISGNVGLRYVETQTSAVGALSFPDRALVFNGMTPAAYCAGIVGTTPGICLEGAATQTAFYDWADGSNQSNTDSHTYENWLPSANVVFGITDEFQIRLGLSQAIFRPDFGLMKSNLVIQQGGDDPVTGAWLGPDASTGNVQLDPITADQFDLAFEWYFDDVGSLTFSLFQKNLSDYIVPAILQRDVTNNGETFAVDVDGVGNASDSGEIKGFEIAYQQTFDDLPGIWSGLGVQANYTYIDAQGVPNIGPKNDEPNGRGSAPNFDVSQLRLPLMSEHTVNLVGFYETDSWSARLAYNWRSEYTLTVRDVIYPFTPVVHESTGQLDGSIFYDITDSLTVGVQAVNLLDEVSETSAVINSNLVQAPRAYFRNDRRFAFVLRGRF

SEQ ID NO: 21525 - protein, 874 aa, Anabaena sp.
MLFSFLPAIRPVAGIGIVGIVFAQSFSAMTVLVRITLLTIGIISLMTPSLFPGQSMDGQTGSPTDNPSSFNRKDRSTNKEDKTGTAKQEKPLAEKNDRSIALEGSQSGGETLKADPIQPGAGYTQRTLEETVSQLPEVQVVAVTPLPGMGQPMENLPGNYQLAKGESWLRQEEFSLPQFMERNMASVNEVNLNGNPFLPNINYRGFAASPIPGTPVGISVFYDGVRINEPFTNNVLWDYVPQLAVSTMEVVPGSNPIYGQNTLGGALVIQTKDGRHNPGSMIQDYAGAWGTNDLEFQHGGYKGNWDWFLAGNWFSQQGWRQESSSYVKQLFGKIGYHNETTGTDVHLEYTGADNELNILGPTPLDMLGGPFGNSMIYTGPNPQQDNLNFVNLYGTQALGEEWTLGGNVYFRESDFSFNNGNIANDVVQFLGFNYPLNAQAIVGYNPDGTPQFGPAGEWDFGNINQTGAGARVQGQWDKKFSTMENYLVLGASYDWSQSIFNSGFYPAAMGANYNNILIPGFPFQQQFVVPGFSQFVGLYLTDTFSPTPWFHLTGALRDNYAQMIIGGFGVDNNGQTVSLSAAERFQQLTPAAGFTFQPLAALGLKEPAIEDLTFYFNYSESFRAPMPGEIVGANPAIPVILPIAQLGDPSLAPVLAQTFESGFRGTIQPGAISWALSFYRTDISNNIVFQNTGHSSAGFFQNVAAQQNQGVEVTIQGNYKKLGWFANWSFLEATFQSFLFLENAISTSVPVSPGDRLPNLPEQMFKAGLNYQIFPWWLVSLDFQYYSSRFLYGDWANMYPMMRGFSVLNIQSYVTLNKYLQLFVFATNVFNEFYAGAGLISQNVFTGAPNGGTIVPFITPGSPFGIWGGARFTF

SEQ ID NO: 21526 - protein, 654 aa, Anabaena sp.
MDCVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 21527 - protein, 234 aa, Salmonella typhi
MIVRKRRGRRTLRCLAGLMACSFFINTTYAWQQEYIAEAAPGHTTERYTWDSDHQPNYNDILAERIQSTQNTVGPVLSLADETPLDATSGISMGWNFPLSRRVTTGPVAVLHYDGSTSSMYNEYGDSATTLALTDPLWHASVSTLGWRVNSQFGDVRPWAQISYNQQFGENIWKAQSGLSRMTAGNQAGNWLDVTVGADVLLNPHMAAYAAFSQAENSATDSDYLYTLGVSARF

SEQ ID NO: 21528 - protein, 829 aa, Salmonella typhi
MKITRLAILITLTFSVLKSQATEFNASLLDSGNLSNVDLTAFSREGYVAPGNYILDIWLNDQPVREQYPVRVVPVAGLDAAVICVTTDMVAMLGLKDKIIHGLKPVTGIPDGQCLELRSADSQVRYSAENQRLTFIIPQAWMRYQDPDWVPPSRWSDGVTAGLLDYSLMVNRYMPQQGETSTSYSLYGTAGFNLGAWRLRSDYQYSRFDSGQGASQSDFYLPQTYLFRALPALRSKLTLGQTYLSSAIFDSFRFAGLTLASDERMLPPSLQGYAPKISGIANSNAQVTVSQNGRILYQTRVSPGPFELPDLSQNISGNLDVSVRESDGSVRTWQVNTASVPFMARQGQVRYKVAAGRPLYGGTHNNSTVSPDFLLGEATWGAFNNTSLYGGLIASTGDYQSAALGIGQNMGLLGALSADVTRSDARLPHGQKQSGYSYRINYAKTFDKTGSTLAFVGYRFSDRHFLSMPEYLQRRTTDGGDAWHEKQSYTVTYSQSVPVLNMSAALSVSRLNYWNAQSNNNYMLSLNKVFSLGDLQGLSASVSFARNQYTGGGSQNQVYATISIPWGDSRQVSYSVQKDNRGGLQQTVNYSDFHNPDTTWNISAGHNRYDTGSNSSFSGSVQSRLPWGQAAADATLQPGQYRSLGLSWYGSVTATAHGAAFSQSMAGNEPRMMIDTGDVAGVPVNGNSGVTNRFGVGVVSAGSSYRRSDISVDVAALPEDVDVSSSVISQVLTEGAVGYRKIDANQGEQVLGHIRLADGASPPFGALVVSWKTGRTAGMVGDGGLAYLTGLSGEDRRTLNVSWDGRVQCRLTLPETVTLSRGPLLLPCR

SEQ ID NO: 21529 - protein, 727 aa, Salmonella typhi
MGMRVKKFIWLITVVSTGINSPLSAAESTDDNGETIVVESTAEQVLKQQPGVSIITRDDIQKNPPVNDLADIIRKMPGVNLTSNSASGTRGNNRQIDIRGMGPENTLVLIDGVPVTSRNSVRYSWRGERDTRGDTNWVPPEMVERIEMIRGPAAARYGSGAAGGVVNIITKRPTNDWHGSLSLYTNYPESSKEGDTRRGNFSLSGPLAGDTLSTMRLYGNLNRTDADSWDINSSAGTKNAAGREGVTNKDINSVFSWKMTPQQILDFEAGYSRQGNIYAGDTQNSNSNAVTKSLAQSGRETNRLYRQNYGLTHNGIWGWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEFVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITNALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 21530 - protein, 253 aa, Salmonella typhi
MKKILTLTLSSLLIIPALTHAEFKGGFADIGLHYLDWTSDTTEKTSKKSHKDDFGYLELEGGANFSWGEMYGFFDWENFYNGRHAKPGSEQRYTFKNTNRIYLSDTGLNLYLHAYGTYGSPHRANFHDDMFLYGLGYNFTGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 21531 - protein, 312 aa, Salmonella typhi
MKKHAIAVMMIAVFSESVYAESTLFIPDVSPDSVTTSLSVGVLNGKSRELVYDTDTGRKLSQLDWKIKNVATLQGDLSWEPYSFMTLDARGWTSLASGSGHMVDHDWMSSEQPGWTDRSIHPDTSVNYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 21532 - protein, 86 aa, Salmonella typhi
MGISKDVALVHFAGIYTGIGLGAYIKSKSRDDMRVNFAFTFGEKAFLGWNFGAFSTEAYIRHFSNGSLTDKNSGHNFVGASISYNF

SEQ ID NO: 21533 - protein, 663 aa, Salmonella typhi
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 21534 - protein, 185 aa, Salmonella typhi
MKNIILSTLVITTSVLVVNVAQADTNAFSVGYAQSKVQDFKNIRGVNVKYRYEDDSPVSFISSLSYLYGDSQASGSIESEGIHYHDKFEVKYGSLMVGPAYRLSDNFSLYALAGVGTVKATFKEHATQDGDSFSNKISSRKTGFAWGAGVQMNPLENIVVDVGYEGSNISSTKINGFNVGVGYRF

SEQ ID NO: 21535 - protein, 706 aa, Salmonella typhi
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQNVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGLNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNFYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEEWYAGTDVRYMGDIMANDENTAKAPSYTVVGLNTGYKFNYSQLTIDIFGRVDNLFDKEYIGSVIVNESNGRYYEPAPGRNYGVGINLAWQFE

SEQ ID NO: 21536 - protein, 230 aa, Salmonella typhi
MKINRYLLGMASFIAFSSYLQAATLDYRHEYADRTRINKDRIAIIEKLPNGIGFYVDASVKSGGVDGEQDKHLSDLVANAIELGVSYNYKVTDHVVLQPGFIFESGPDTSIYKPYLRMQYNFDSGVYMAGRYRYDYARKTANYNDDEKTNRFDAYIGYVFDELKLEYDFTWMDSDQIKFDNKKTNYEHNVALAWKLNKSFTPYVEVGNVAVRNNSDERQTRYRVGLQYHF

SEQ ID NO: 21537 - protein, 190 aa, Salmonella typhi
MYVAMIIRKYFLIIALLVMPWLAIPSVSAADKGWFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 21538 - protein, 751 aa, Salmonella typhi
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 21539 - protein, 656 aa, Salmonella typhi
MTQKRTLLKYGILSLALAAPLSACAFDSLTVIGDSLSDTGNNGRWTWDSGQNKLYDEQLAERYELALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVIAAGLGAAAPPALKAALDALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQATVFSHLRAGQAWLDSDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLSDGNQTRYNVGFSARF

SEQ ID NO: 21540 - protein, 733 aa, Salmonella typhi
MKKTTTPIALTCMAFLLAATAQAAETPPDSTLLRFTSEEITVSGQKGDILQQVTGSESAVLNPSQMSVYKVINMMPSLSQQSVDPYGLADISNYHEAFKFRGVEATAGGVPSTTANVEGLPVTGRPGGGATIYDLENMQNITIYTGVMPANKGLGLSTVGGKIDMEIKRPADEFSVDVKQTVGSNDFSRTYLRVDTGELGQGLKAFVSGSTSYADKWKGEGASNRNNLMFGISETFSDRVKLEAFLTYSKGLIHPYRSLSYAEISNLDTAYSRDFSANPADYYYYDYNKNEFEDWMVMANLEIKTGDSSKLNIKPYYWSDKGYYMETITGPFIRRWDIDHDLKGILAEYATKIGDVELDMGYLYHTQERPGPPSSWKIYTLSGSDLVFNKWSILSNTSSHELHEPFVEAKYRTGDWLVEGGLKYVNYTLPSIITYDMAAVDVSYDDALATNPSIITAKSALDEKLFSRVFPNLTLTRTLNDNASVHLAYGENYVTHVDIYPYFISNFKDNGITFQELWDAREMETAQNFELGMKMKGTNWSLAPTIYYAIHNHKQAVLYDPALNATYPMNNADAKGYGIELEADYKPSRDLKCYGSFSWNRFYFDQEIYSDVDKTPIDVKGDQVPDAPEFMAKGMLSYRIGDFTISPIVRYSSTRYGDVLHNEKIDGATVCDLDLTWSRPMLGFKNVDCSLSLINVFDKQYVSMISTSDYKTLKTSYQPGVPFTLVATLAFHY

SEQ ID NO: 21541 - protein, 377 aa, Salmonella typhi
MTIKITALAASIGAAVAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGSTDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 21542 - protein, 1003 aa, Salmonella typhi
MHSWKKKLVVSQLALACTLAITSQANATTNDISGTTYNTFHHYNDATYADGVYYDGYVGWNNYATDSYYNGDIYPVINNARVNGVISTYYLDDGVTTNTNANSLTIKNSTIHGMITSECMTTDCVNRDTGYVYDRLALTVDNSTIDDNYEHYTYNGTYTDGTADTHVVDVYDMGTAITLDQEVDLSIVNNSHVAGITLTQGYEWEDIDDNTVSTGVNSGEVFNNTINVADSTVTSGSWSDEGTSGWFGNTNNASDYSGSYTADDIAIAAIANPYADNAMQTTVNLSNSTLMGDVVFSSNFDENFFPNGADSYRDTDADRDTNGWDGTDRMDVTLNNGSKWVGAAMSVHMTDTGTDADGDGVFEYTVDTDGDGILDATSPDGVYDSYAVGTEATANLIDIAANSLWPLSTVGVDNIYTDYSEYNHIVGNEVYQSGLFNVTLNTGSQWDTTKTSLIDTLSINSGSVVNVADSTLVSDTIGLTGGSALNINEDGHVATDTLSIDNSTVTIADDVSAGWSVNDAALYANTINVTNNGVLDVGNSASNALQVDTLNLTSYTDANGYVNAGVFNIESNRFVLDADLTNDRTNDTTKSNYGYGVIAMNSDGHLTINGNGDTYDTDQTEAGQDEVDNVGDNVAAATGNYKVRIDNATGTGSVADYKGNELIYVNDKNSTATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYEIGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 21543 - protein, 696 aa, Salmonella typhi
MFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVSLTSRKPAFDAGGEVKLFAGNNNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREQHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPPGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 21544 - protein, 219 aa, Salmonella typhi
MKNFFAVCIIPLVVTWSATASAKEGIYITGKAGTSVVNVYGINSTFSQDKIVNGHATLPDRTKGVFGGGVAIGYDFYDPFQLPVRLELDTTFRGETDAKGGQDIIAFGQPVHINVKNQVRMTTYMVNGYYDFHNSTAFTPYISAGVGLAHVKLSNNTIPVGFGINETLSASKNNFAWGAGIGAKYAVTDNIMIDASYKYINAGKVLRDPLIISPKRNHV

SEQ ID NO: 21545 - protein, 253 aa, Salmonella typhi
MKNKKYINSLLAACVLFSCFNGQAAELKRVYGKLSFGYGDWNKGFVNVDRGEVWKAVADFGAVFDRGEFASFYEMNVLNHPVEGRNHVTQFLGHYRVVEGSNFTAMMKLYMSMENKFGDELNMMYGVGYLGLTSPSGFIKPYFAVHNLSNDYTSKKYGQATGFNGYVLGWVAAYNFDMFNEKFVISNWNEVEMDRNDAYAEQQGGTTGLNGAVTFTWKFMPRWTASVSYRYFNNKLGYDGYGDRMNYLIGFEF

SEQ ID NO: 21546 - protein, 726 aa, Salmonella typhimurium
MGMRVKKFIWLITVVSTGINSPLSAAESTDDNGETIVVESTAEQVLKQQPGVSIITRDDIQKNPPVNDLADIIRKMPGVNLTSNSASGTRGNNRQIDIRGMGPENTLVLIDGVPVTSRNSVRYSWRGERDTRGDTNWVPPEMVERIEMIRGPAAARYGSGAAGGVVNIITKRPTNDWHGSLSLYTNYPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSNSNAVTKSLAQSGRETNRLYRQNYGLTHNGIWGWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEFVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITNALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 21547 - protein, 2021 aa, Salmonella typhimurium
MRNMYVVASELARGHSKVKAQVCASEIHSPNQKSEYGQIIKATRAALACAVAAALGFFSPLAMADNQVSYADAQTHVLDASTPPMSYSGTDEGAALYVSGVATVGWQPTTVTGTGLVIETSGGGADDPDGGKYVSNAISLDHYAILELTDAKITTTGIYTQGISAADGSTLTLTDSTLTIDGNFGVMTLYTGSEATLDGTIVEAANSSSAQVQQGSTLNVLDGSTITLAQGQINVVAGNTATDEGSTLNLSDSSVSSAGTMSTIQGTNKAALNLTNATITHTNASGAAVQANNATTLDITGGNITSAGTGVYILASDARIDGATINADGDGIFITSKRKLDGYEDLNALTVNKAQVNSDTIALHVDTGTTINAPIVLTDSTFEAPEVIKLGSKAVIQANNTTLIGDVAQSDMSSSSLSLSQGATLTGSVDAMFTTLSLDDTSQWNMTDPSTVGNLTNDGDITLGNASGSTGTLLTVDNTLTLQDNSQINATLDTANSAPIIKAANVTLDGTLNLSSTATFVAPETDEHFGSITLIDSQSAITTDFDSVTLDADTSAMPDYLTINAGVDANDNTNYELSTGLSWYAGANSARAAHGTFTVDAGSTFTVTSELDETTATSNWNGSKLTKQGDGTLILSNTGNDYGDTEIDGGILAAKDAAALGTGDVTIAESATLALSQGTLDNNVTGEGQIVKSGSDELIVTGDNTYSGGTTISGGTLTADHADSLGTGAVANSGVLQVGEGELENTLSGSGSLVKTGTGELTLSGDNTYSGGTTITGGTLTADHADSLGSGDIDNSGVLKVGEGDLENTLSGSGSLVKTGTGELTLSGGNDYSGGTTIIGGTLTADHADSLGTGAVANSGVLQVGEGELENTLSGSGSLVKTGTGELTLSGDNSYSGGTTIIGGTLTADHADLLGTGAVANSGVLQVGEGELENTLSGSGSLVKTGTGELTLSGDNSYSGGTTIIGGTLTADHADSLGTGAVANSGVLQVGEGELENTLSGSGSLVKTGTGELTLSGDNSYSGDTTIADGTLIAANVNALGSGNIDNSGTLMLDANGAFELANITTHTGATTALAAGSTLDAGQLTQEDGSTLSIDLGAATDDAVITADSVTLGGTLNVTGIGSVTDSWTPEAYTYTLIDSDSAITSDFDDLTIAGMNREDVDFLTIDGKVDEADNTHYDLTASLSWYADRDNATTDAHGTFTLSDPDGSFNVAATLTDVDDTLDPGSRWDGKSLTKEGAGTLILSGDNDYSGGTTINEGTLVAASTTALGTGLVDNNATLVLDVDGEVSAVGGITTHSGATTQLALGTSLDLGDSALIQQDGSTLNVELNSDSVQPLITGGSATLGGDLVVSDASLQARASDAEFQSFKLMDMDSDISGDFTSLTMNLTDQPDYLTVTGTINPADASEYLLTEGLSWNATATSATPAHGTFTLGAGDSFEVTSVLGDKTGNGDWDGKSLTKLGAGKLTLSGANTYTGDTNVQEGTLWLSGDGSIGEMGSQQAVNVASGATFGGSNGTTVNGKVTNEGTLVFGDSEETGAIFTLNGDLINMGTIASGSTSSTPGNTLYVDGNYTGNGGSLYLNTVLGDDDSATDKLVITGDASGTTDLYINGIGDGAQTTNGIEVVDVGGVSTSDAFELKNEVNASLYTYRLYWNESDNDWYLASKAQSDDDDSGGDDSDVTPSDGGDDGGNVTPPDDGGDGGDVAPQYRADIGAYMGNQWMARNLQMQTLYDREGSQYRNADGSVWARFKAGKAESEAVSGNIDMDSNYSQFQLGGDILAWGNGQQSVTVGVMASYINADTDSTGNRGADGSQFTSSGNVDGYNLGVYATWFADAQTHSGAYVDSWYQYGFYNNSVESGDAGSESYDSTANAVSLETGYRYDIALSNGNTVSLTPQAQVVWQNYSADSVKDNYGTRIDGQDGDSWTTRLGLRVDGKLYKGSRTVIQPFAEANWLHTSDDVSVSFDDATVKQDLPANRAELKVGLQADIDKQWSVRAQVAGQTGSNDFGDLNGSLNLRYNW

SEQ ID NO: 21548 - protein, 663 aa, Salmonella typhimurium
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYTGRKRADSATAKTPGGYVVWDTGAAWQATKNVKLRAGVLNVGDKDLKRDDYGYTEDGRRYFMAVDYRF

SEQ ID NO: 21549 - protein, 706 aa, Salmonella typhimurium
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLQPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 21550 - protein, 1015 aa, Salmonella typhimurium
MKQVKFRIVQTILPLLIGMFLSLGAYAQQITVKGHVKDAMGEPVIGANVIAKGTTTGTITDFDGNFTLNVPQNSILSITFVGYKAAEIKAAPSVMVTLEDDSQVLDAVVVVGYGTVKKNDLTGSVTAIKPDKISKGVTTSAQDMITGKIAGVNVISSGTPGGGATIRIRGGSSLNAKNDPLIVIDGLAMDNSGVQGLTNPLAMVNPNDIETFTVLKDASATAIYGSRASNGVIIITTKKGKAGSKPQVNYEGNVSAGILQKTIDVMDANEFKGYVSKLYGEGNAPSPFGEANTDWQKEIFQTAVSTDHNVTVSGGLKNMPYRVSFGYTNQNGILMTSNFERYTASVNLTPSFFKDHLKFNINAKMMWANQRYADDGAIGAALTMDPTQPVYDSSDMYKNFGGFYQPTSDGSSYNDPEWPLTLESNSTANPVSLLKLKKHTSRNTSFISNVEVDYKFHFLPDLHIHANVGGDYSEGKEKNVNSPYAPGSYYYGWNGTDYGYKYNLSVNAYAQYSKEIGDHYVDVILGGEEQHFHYTGYKVGQGTNPLTGEAYNPNLRSQTAWGHHSTLVSYFARVNYTLLSRYLLTATFRQDGSSRFSKDNRWSSFPSVALGWKLKEENFLKNVEVLSDLKLRLGWGITGQQNLGDDYDFPYMALYRVNAAGGYYPFGDTYYGTMRPKAYNEDLKWEETTTYNAGFDFAFLNGRISGSMDYYYRKTDDLINTVKIAAGTNFNTQLISNIGSLKNTGLEFTINAKPIVTKDFVWDLGYNITWNKNEITKLTGGDDSNYYVETGGVSTGISGATCQVQKVGYPMNSFFVYQQVYDKDGKPIENMFVDRNGDGVINASDKYIYKKPAADVLMGLTSKFTYKNWDLSFALRASLNNYVYNDVLASKSSVGKGGIFNHGYYSNRPTAAVNLGFEGKGDYYLSDRFVENASFLRCDNITVGYSFKNLLKSQAYKGINGRIYGTVQNPFVITKYTGLDPESVISSGNDAGVAGIDRNIYPHPITILFGLSLQF

SEQ ID NO: 21551 - protein, 83 aa, Salmonella typhimurium
MYTYTRASFGATPGARHPTYHSVGLMADYLLSKRTDVYLQGMYQYVGGDATGSILDAAYVAGAENVSSNRNQLLLRAGVRHFF

SEQ ID NO: 21552 - protein, 751 aa, Salmonella typhimurium
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 21553 - protein, 729 aa, Salmonella typhimurium
MARLKTAQPNSSLRKIAVVVATAVSGMSVYAQAAVQPKEETITVTAAPAAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNDGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 21554 - protein, 568 aa, Anabaena sp.
MSNLLWKSLVVSPAVLGATLLVSTTAIAAPNTTTEVSAVKQAGVAEVAQQPEMLAQTTIDQVNRYSNEGNQNNSQSQVTSVSQFSDVQPTDWAFQALQSLVERYGCIAGYPNATYRGNRALTRYEFAAGLNACLDRVNELIATATADLVTKQDLATLQRLQEEFSAELATLRGRVDSLEARTAELEANQFSTTTKLVGEAIFAVTDVFGGNTGDNNNTVFQDRVRLDLQTSFTGRDILHTRLAAGNATAFTQFDNAGGAINTAEGTQTFEIGSTGNNAVRIDRLTYEVPVGPANVYLAASGGRHSHYAAVNNPYFFDNTDGGNGALSTFASESPIYRIGGGAGIALNLPLGKGGGILGNSSITAGYLASQANDPALSSGLTNGDYAALGQLNFSVGDRLALAATYVHGYSAGGFLFDSGSTTDGNIVPVGTGQANTLLGAGSSNSYGVSAAFRPSDKLSVSGFVSYHDVSGFGANDDYEAWSYGLGVALPDFGKKGNVLGIFAGAEPYSFNRPGFVGNDIPYHFEGFYKYRVSDNISVTPGVIWLTSPGQSSANDDAIIGTLRTTFTF

SEQ ID NO: 21555 - protein, 824 aa, Rhizobium meliloti
MPSKPSNPPVTVTHADHRVPKVSRLLFTAILFALYPALDAVAYASTANNSDVSKSTPTEKVVKLREIKKKYEKILVGERNIASAMSVIGPDQIKHSSSAESIYSLLKQTPSVNEYQQNIGPGTPVMTVRGVRMSQLAQTLDGIPMTDLLSGGQGAYLSNNIGTVISNGQISGIHVYPGVAPPDRGGFATVGGTVSYTTKTPPKKRYADIFTKVGSFSTDTYGFDASSGKIPGTDGLRVYTRLSQTQTDGYIQNTPARYTDFLFTAIKPYDYGLSKVTGTVIYNTAHGYMISAPNAVAQLDKYGIFYNYPLSEASTLQRNQYLTAILGDSTYINSHLVIGAKAFYIHKHSYLAGYLAPNLISESYPYQVNFNNPYSGYGPLPPTAASPGVIPHTYDPVAMFGSYPAGEAAQINISGNTTIGIAPKVNIFIPHNDITIGGLVAQETAGPGGGNYFYGTLDMPKIYGYNSYGNPSSPTNNKQQRTIYSGYLSDKINLLNNKLHIEPGVTITGVSTSNYVPVNQYGTPPQAYTLSNYDKEVLPYLGLSYDVTNKVIAYASYGKGARFAPVADYILGPSGSTTLAPGPETVNAYETGLRYVGKHLYLNFDGFLQNMHGMFSFYTNYLTGYSQYANIGEEQMKGLEFSGKYELNPEWTISGHVSYTNAQYMNSFSATVTPFEGQYGYVFAGNPLASVPNWLAGLRLGYHNHNFHAALMESYTGPQVTTYDLPPTESNPLLQDATTPNPGVKLAPYFLTNLQASYRVPIHQDHLSSITVSLNIDNLLDNHYYLHYYQAYKEYAFAGVGNPYAEAYPGMPRFIEVGLSGRFS

SEQ ID NO: 21556 - protein, 797 aa, Rhizobium meliloti
MKCRGQGGPGNGWKPCVKWLPATTCRWCLGLAMVSPALVLADDLPPPPTEMSAIAEATLYLDLVVNQMPRVDLIPVQQRAGRLYLDSDVLRAAGVSLPGNPQGEVALDSIAGLHTDYDSQNQRLLLQVPPAWLPEQQVGDRNLYPASDARSSFGALFNYDLYINDTDEGGTYLAAWNELRLFDSWGTFSSTGQWRQSFKGAQADDTRRGFMRYDTTWRFTDEQRLLTYEAGDFVTGALPWSSSVRVGGVQLSRDFAARPDLVTYPLPAFAGEAAVPTSLDLFINGFKSSTTELQPGPYTLTNVPFINGVGEAVVVTTDALGRQVSTTLPFYVTSSLLQKGLSDYSVAAGSLRRDYGVRDFSYGPGIASGSLRYGLSDMFTLETHAETAESLMLGGLGGNMRVGNFGVLNAALAQSRFEGDKGHQVALGYQYNSQRIGFGYQRLQRHGDYADLSRVVSPDMQLSKSSEQVTLSVNLNEYGSIGAGYFDVRAGDGTRTRLINLSYSKPLWGSSSVYLSANREVGDSQWAVQAQLVIPFDLHGTLALSMERSNEGETLQRVNYSRAVPAGVGVGYNLGYAAGSDRDAYRQADVTWRLQSVQLQAGTYGSSGEMTRWADASGSLVWMDAGVFAANRIDDAFVVVSTAGYADVPVRYENQEIGRTDAKGHLLVPYSSGYYRGKYEIDPMNLPPDVLAPDVEQRVAVRRGSGYLLEFPLKRVMAASVELVDGNQQVLKLGSRVTHAESGTQAVVGWDGLVYLENLSSHNRLQVALEGGGHCEVAFDLPEAQGSVPLIGPLVCR

SEQ ID NO: 21557 - protein, 168 aa, Rickettsia conorii
MAGINKVIIVGHLGNDPEIRTMPNGDAVANISVATSESWNDRNTGERREVTEWHRIVFYRRQAEICGEYLRKGSQVYVEGRLKTRKWQDQNGQDRYTTEIQGDVMQMLGGRNQNAGGYGNDMGGAPQSSYQARQTNNGNSYQSSRPAPQQAAPQAEPPMDGFDDDIPF

SEQ ID NO: 21558 - protein, 861 aa, Rickettsia conorii
MDCEARRLRKRLLSGVSSTSFMLGIALGALPHDLHAQDAHAGMKGMHMGSEPAADNAAPANAQSTTGASDAGHVDDVVVTGQAAQDDGEALMMEVMMKTPRGGDVVTGKQAQQQQIRRLTDVQQIIPNFRPNIAQPRQSRQAIRGVGIAAGSAGTGSPSDTGYMVDNVSWLFAGWQWGNLVDFSSIELILGPTGTAGGHNTNVGTISIRTQLPSFVPSATAETTVGNYNHIIENLVFTGPLIDDRLAYRVTFYVDKGDGWIRDQGTGTTYLDNNRLGFRGQLLGVGDGMTDRLIFNFNASNEHDDYLLGTVGDTSLIYANGTRPTATFFQNMQTKLGKQALTTNPYAPYATRMGRDPTHTYTLSNELNWQIGQNTLTVISAGGYGSFENNGFQGVQNTTLGFGAEGMGGMNTYLWQVSQEVRLSSPTDQPVEWKAGLYSVFENAWDKMHHTYFGWDSAAWLNNPAAMPGLYTRWHNNARDFQIAAYGQTTIHFDPSFALTFGLRDSYDIRYGSDTFYPMFIEGTPFSHAQQEAALIQAGSYGSADTGGFTKYHNAVTGIVNPEIKINDNIRLWGLIGRGDKVSAVNTQDVPIYINGQFNGFTPMFNKPETSWDYEIGVKTSFFDDKWISNVNLYWNDLYNFQASSNQTFTSPAGVVTNVAFLANVPHVRLRGIEFVERLAINEELNFHATGAYTEARYISYPNSPAPPDFAFSGGPAIVSLSNTRLTGIPWWSFSIGYNYEHPVGALLRDLGDAFHVELGDWANASLVGYSYGNVDWFYKTQLTSPVSYVQYWQAPYSIVNAGIGLRTEDNKYSLTLWGKNLFNALPFTSWAYGNANASTQVGISTLGPRFFGATVMMTLW

SEQ ID NO: 21559 - protein, 786 aa, Rhizobium meliloti
MINYKRMMQSVGLCFLILLGASFAYAQKSTLSGYVKDASNGEVLLGASVYLTELQNGAVTNEYGFFSIKIPNGQYTVKVSYIGYKTVTKQVNLANDQKLNVELPVEGQALETVVVTSEKQDANIRSTQMSVNKLEIKTIQKMPAFFGEADIIRSIQLLPGVTTVGEGASGFNVRGGNIDQNLILIDEAPVYNSSHALGFFSVFNPDAVKNVKLVKGGIPAQYGGRLSSLLDVRLREGNNKKFEMNGGIGLLFSRFSVQAPIQKGKSSFIIAGRRSYIDLFFPLLGGALSNSSVYFYDLTAKLNFTLNDKNKIFVSGYFGRDKIGLDVFGFNWGNATATIRWNHLFNDQLFLNTTAFYSNYDYQLGVPNDTDGFDWKANIVNYSFKPEFTYFANASNTINFGGQAILYQFVPGTATFTSGGNSRDISLDDKFGLETAVYLSNEQSIGDNVTLEYGVRYSWFNYLGAGKAITFGDAPAGERREPVSSREYGMWETIQEYGNFEPRFSAKYMLNRTSSLKLSYHRMAQYIHLVSNSTASIPLDTWTPSTNNIQPQLADQVALGYFKNFGENNDYEFSAETYYKLYQNQIDYIDGADLLLNENLEGDLLTGEGKAYGLELYLKKNNGKFTGWVSYTLARTERQVNGINNDSWYPTRFDRTHNLYVVGMYKLSKRVELSANFMFASGTPTTFPTNRFEFEGIVAPHNAENSRNNFRIPAAHRLDVALTLLPKNTKKRWQGFWVFSIYNLYANRNPFSIFFQADADNPTITRAYRYSIIGSVIPSVTYNFKF

SEQ ID NO: 21560 - protein, 847 aa, Rhizobium meliloti
MKKIFLWPSACALAVSVSITPNVIAAEKSVERIEVTGSRIKRTDIEGPSPVQSINKDDIANMGFDNLQQLLERMPANGSGAFSTRGNSQDSTANGGASISLRGLGPDATLVLINGRRVGASAFAEGISNSFVDINNIPVSAIERIDILKDGASAIYGSDAIAGVVNIILRKDIEGIELSLGYGDDNGTGYDETKGSLVWGVKADKGSASIILDYFTNGTLSAEDMGRFGTANQSPYGGDDSRSSRGFPGYFYVNGVQTIDPDCPADSIDGEYCLFDYGPYNMTIPTSERVGAIGQFDYMLGDDLTAFLELSVQHNTSEAGGAPTPLDEKAKMTVPGTHPNNPWGQDIKIGRFRTVDAGARRWDIESDTMRVVAGLRGVVNDWDWEVSAQRGRSESTQTGDRSQGWVRTDFLQAEIDAGNYNPFGGTINSQDVIDRITTNLVRQGKSSITAYDASISGHAFTIADRDIMMAAGAEYREESVSDVPDDQFQRGLIFGTEAVSAFGSRDQHAAYVEFSIPVADNFELQLAGRYDSYSDFGSTTNPKIAFQWGISDEVTARGSWSTGFRAPSLAQIGLGPSEKSDFLVDRYRCAADNLDCGKLDYNFLFAGNPDLEAEESETWNLGMIWAPSQQFDIGFDIFNILQDNKIDALQNKDLYAANCNDQNSTVCRRTAPQAGQTFGSIDVIQSAFINIGSQEVQGVDLSTHYGLELDNYGDIKFGVEYSYLISFEKEIDGKTIDYTGEYEYPQHRWLATTNWNMDDFAANVNFSYIGEFEDFNKTRTVDAQLLVDMSGSYRFNDTVKLTLGVNNLFDEEPSFAIGDGDADLYGYAMGVHNPLGRYIYTKVTMNF

SEQ ID NO: 21561 - protein, 856 aa, Rhizobium meliloti
MAFAQSNEEEVIEEVVATGTRLKGTATAVMEERKNQAFVADIMGAEQIARTGDSDAAGALRRVTGLTLVDGRFIYVRGLGERYSSTQLNGAIVPSPDPTRNVIPLDLFPSSIIESLAVQKSYSPSMPAAFGGGNVNIRLKSIPTQRVFNVSAAVGIDTENSGDVLDYAGGGRDWTGEDDGTRGVSAAIQERWDSKNFLDDLEPEEALELFKGVNREYGLERESADPDMRVNVTYGDSYDYDEDWRFGFLVTSRYSAQTRSSEEYELQDPDLVGDDIINVRFFDDIQGTEQTVTWSSLLTLGVDYNRQHRIDYSLIVLNDTRDEIREMFGNTENLNQAEGLRIRDIDVQYEERSLYTNQLKGQHTIPELNFMGIDWTYSLGRSVRYAPGNFNARFVMEDVNEDGIFDDENEIFLSDAQTAARYTFQNLHDRLENFGYNVTYPMTMGKWETEYKVGASFVTKTRTAENRRFDINTLGVEDRSILDGNDFSEIFSDSVLDTLSLSSRPIIRDTTIAGDDYVAGQKIDAYYLEADFFYDNKWRFTGGARYEDFRQVVAPLDPRTNQFDLSDEADRSQLAFQEDGFYPALAVTYFLEDDMQLRASIGQTVVRPDLREVSSATYLDPLTNFPIAGTPGVSTTDIINYDLRWEWYREAGNNVSVGLFYKDMEAPIESVQSPAQDGPPLIRIANAESGEVYGVEVEFLQDLAFIGDGIWDNLFTTGNITVSDSEIVLDRQNIVEQTGVSAAITNVERRMTGHSQYVLNMQLGYDSDNGEHSASLVYNVFGERILIPGIDGFDDNFEQPFHSLDMVYKYYPDFNSTVTLRVQNILGEDREIEFNDTLLRSETRGTGIRLSYKYDF

SEQ ID NO: 21562 - protein, 450 aa, Rhizobium meliloti
MLNQKVWLGFLALHGVFLNAFEYQISARVGSFSRIAFNQSVINSKKGIYPTGSYVTTTGALQVDLSLLPKGIENHKLGFGVGGEIGSLAYDSTKFLMDEANPKAGFQPANWYYMGRWEGYLMQHSQNWTREQKAQNARPYVLYNLYLDYQYKDIFGIKLGRYPSKALFLSGFNQGFEVFYRWKKFRIEWFSTFGRALANEQSIRDFYAPVNYKQKINYGMHNLNLIYENKYIRVAPFIWFYPKNFNAPGFEITHDTKSYWESLWRIQTTFYAWFPLYSDYLSKDYYRASLIGKKSASLFVFQRVHFRSYRFGWSVYKNFGNGNAQLGWNGSPVDPFYDTKDDTPYEDAYSNFYNANSITINAFIGKSVKNLLVQLYGKLTYSPRADSQSLGVTFKYNLKKHIYLMLMFNGYQITMHKGYKVGFFTSGYNPDFAQTIQNRSYLMSSMSYRF

SEQ ID NO: 21563 - protein, 772 aa, Rhizobium meliloti
MILVYVRLRRSIKNVRDSTDASRRPDSDLPPWDGSTTTPDLRPMSTLSLPVRRLTRIAFGIALACTFPAAARAQQATSAAVNANAASDATMLPSINVTGAAEPLPGDLAPTYAGGQVARGADFGVLGRQKASDVPFSMTTYTSKLIEDQQARTLADVLDNDPAVRSASGYGNFSQVFVIRGFELAGDDVSLNGLYGVTPRQLVQTDAVERVDVFKGANAFLNGASPNGSAVGGGVNLQLKRADDKPLTRVTVDGATSGSLGTHVDIGRRFGSEGQFGVRVNQSISGGDTAVDDERRRSNVTAVSLDWRGDKLRLSGDFLYQRQRIDNGRPVVLVSGDQLPAVPSATHNYAQPWSFSELEDTVGIVRAEYDFLPAWTAYVSAGARHTNEHGDYYTPTYSSSGTTGSRLSVPHKEDAQSAEAGVRGRFTTGPVSHFVTAGASFIRIDSQSAYTMSNAFPTTLYDPAPIASPPTAYTGGDMNDPGTVTKTWLRSLAVSDTLGFLDDRVLFTIGARRQSISVDNFSYTGAVTGVYSDAITTPVLGLVVKPWRNVSIFANRSEALAQGEIAPNTARNAGQALSPYRSKQYEAGIRYDTDKYGASLALFQIEKPMAYTDPATNLFGADGTQRHRGIETAVYGEPWKGVRLIAGATYLNATLQNTAGGANDGHRPIGVPSFLLNAGAEYDVPMLRGLTLTARWLHTGPQYLDVANTMSIQAWDRFDLGARYATNVFGKKTTLRATVRNVANKSYWSSTIGGYLTQGDPRSVWLSMTTDF

SEQ ID NO: 21564 - protein, 977 aa, Rhizobium meliloti
MAYFMKNIVIPTSLSCFFLLFSHSTWSETNISQTKQRIIDQRNYWLDEIKNGVITTSPQKGSRTAELDRIISNNYQAITGERRELAEADKSQSHTYVFNTYANILFGDKARSINFSDIQAYQDLNKLHSTGTYAYDTNKKRVRSIDFILKELFLRGRPYQVLDKEGHYLDNYTTITGSSYPSGHTWNGYKQAAVLSILFPEKGSEMFARAIEYGESRVIVGAHFATDTIASRIGNYYLLSQMLADDDTTRTFVELAKEVRQNVASQCKNPHCLTTSTTITNDETGYYATKDPEPAPRITPNEIPTSANALLRLRFAYLTREQRQSILASTTYPSNSLAGWAANKDDPNANWGLINLPKAYNGPSYFYNHFIVNQITNEFDFAEFGQLDEWKNDISGPGKLIKQGNGTLILSGNNHFAGIEVNQGHLLLTGENHYAKNSSINGGTLLLEGTLNTLLDVNKGALLLNGGSVDSQVNINNKGILSGKGKINKLAVYSGGIVSPGHSIGTINIDDTVIFNSGSNYHVEINSQGDSDKIISLGTATLNGGMVNVSLENSQNLLTKDDVQSLYNTKYTILTADHGVNGQFTDVNPNYLFLGTTLSYDKNSVILNVGRNNTAFSSVAKTKNQLSIANAIDALPLGHPIYESIIRMDTGNDARSAYNQLTGQIHADILSNQLNNSRQIKETLLSQIKNAEIINREKESAGNKGHVWAKILSNWEKTSNDGNANSYDASTYGVLLGADQRVSHDKMLLGIATGVTKTSLSGDNSHANSENYHLSLYGGYDFDTIVLRAGASNTFHRIHTTKSVNYGVQSDKNKANYNGNTSQIFIEAAYPITLSDTQLEPFVNFEYAKTKNATINEQGGRAALQAHSQTLESTTSTTGLRLNNQWKFNSKSRGSLYGELGWRHQYNDVERGIHLRFTQTQPTFIANSVDAARDALVVKAGTTIQINETSKVSIGYSGLTARNQHDNGIDMKLSIAF

SEQ ID NO: 21565 - protein, 210 aa, Rhizobium meliloti
GSIVATAEAVWQLEQDVSVPCGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVPKKVAAVVGKPGSDVYYAGLHYKNGGFAGIYAYIYAKHANVGRDALESYMLGSGSDQDTGTDPVKYHNAHRQTGYYEGRGVHLLGAAQ

SEQ ID NO: 21566 - protein, 215 aa, Rhizobium meliloti
MIRNVLVAIFAAFMLGGKAHAADLAQPPEPTPTVETVHSFVWTGGYLGLQGGGGWLNSDLSVPGGGGSKRFSGGLLGAFAGYNYQHGDWVVGVEGDVSYNWNDETVTVFGTNTDVGTDVSGSVRARLGYTVNDRTLLYATGGWAVTRGFVDVAGAPKEKETFNGWTIGGGVDYGFTDSVFGRAEYRYNDFSDKDVGGVDVDLDQHQFTIGVGVKF

SEQ ID NO: 21567 - protein, 979 aa, Rhizobium meliloti
MARHVSGLLKAVCFLFVFAVLFAVTLSSARALSTACTALNAASPVSSGLSTYNASSFSADETLTVSFTDSGAGTGGLPMNADTVIMQSRDFSQHYLMHYSSDGNAGSFSTTLTGAQLTAGGLWLKVSTANGFISPVTVSCTAAATLSSDATLSGLSFSGGALSPGFSASNTSYHATVDYAVSSVTLTPVTTHNASTVTVNGNVVSSGSASPSVNLSVGTNTLTIVVTAEDGTTKNYSVVIQRNEQTPVAGNVSAQVASNSQNNPIALALSGGTATAVNLVSPPQHGTLMISGTTVTYTPLAGYSGSDSFTYNASNSAGTSANATASLTITAPAAVTISPASGALTPATVGSAWSQNVSVTGGTAPYIWTAHGLPAGITQNSATGALSGTPTTSGSFSISLTAQDAAGVSSTVTYTLVVSNGAPPDATLVMTPAAGALPSGTVGTALSQTFAVNGGAAPYRWQLSGSLPAGLTFSGGLLKGTPGVAGDSAFTLSVTDANGTTVHAAYTLRINAAAAQAVDQSASLSAGRVTRVSLTRGATGGPFTGARLLAPPDKRQGTASIQPQGGDYELTFTAAPQASGTVVLRYVLLSASGITSPATITFSIASRPDPSKDASVTGTVSAQYQAAQNFARAQIRNFNDRLEQLHGSEDVPSSLNGVHFALPSSPAERGLDTDLWNAALQQQAQLDAQNSLPPALPFGMQTPGQRLSYWTGGYVDFGRDKDATMRLSHTLVGVSTGVDYRFTPTVTAGVGMGFGRDVSDIGDTGTRSNGRSLSTALYASYHPDAVFVDGLLGYSRLDFDSKRHVSETDVYARGSRAGSQVFVALTSGYEFRLPQSLVSPYGRVQISKTHLESYSESDAGMYNLAFAPQRFSQVTGSAGLRAEHRVPVSWGDLRLQSRVEYSRLMNDTGSARVGYADTGNDTWRLSLYEQNRQTLALGVGLDMALPNGVTPGLAYQGTLGLDDRGSRAQTIMARMNVAF

SEQ ID NO: 21568 - protein, 212 aa, Rhizobium meliloti
MRTLTTTLMASAIALVALQAAHAADAVDEVPAAPAAEYTDPAVKNWSGAYVGGTANWHHGEADATGGNTSAGFGGGLYGGYNVQDGQMVYGGEADVNYAGNDSHSSGRRVKQGVNGSVRGRVGVDLNPVLVYGTAGLALGNAKLSTPAGSDDKTLVGWTAGAGAETFVTDNVTARVEYRYTDYASKDFRTGGSTVSSGYDEHSVKLGMGVKF

SEQ ID NO: 21569 - protein, 278 aa, Rhizobium meliloti
MSRTLATVMLAGGLLAAGQAVAEDHDMTPTHETDSGPMLWHNESLTYLYGKNFKINPPIQQTFTLEHASGWTWGDLFIFFDQINYNGKEDASNGKNTYYGEITPRLSFGKLTGADLSFGPVKDVLLAGTYEFGEGDTEAYLLGPGFDLAIPGFDYFQLNFYYRKPDGNRVRAGAWQITPVWSYTIPVGNSDILIDGYMDWVINNKSASTSRRNQSDYHANLHFNPQVKYDLGKALGYEPKHLYVGLEYDYWSDKYGVKDSQYFTTDQNTASFLVKYHF

SEQ ID NO: 21570 - protein, 425 aa, Rhizobium meliloti
MRGRRQYARKGRRHGKGAIWLLSLGLPMFASAMPLDQAVRAGLAIHPEVRSAMAEADRAGTEVEMAKGGYYPSVTMSGGPQEFDFGEIVYDLTASQMLYDWGRVTSKVDSASATQRKLSEAVLVARDDAALDIVETYLDVLASERRVEAVREHIQRLDGIREMTQARGGDGYADRSELDRANLELSRAQEQLSLEKGNLQDARNQYAILVGQEPADLVEPEPMSLQRYLAASDMARVIRESPLQRKALEDANVAEAEVREAKASLLPQLNLEASALRREIGGHPESDSVVSLRFRMDTFQGLSNFRRPTAAQQRLESAKWSADAMQRDIRRQLQNLFDNGDTLRWREQSLTQQVTESEQVGELYREQFEVGRRDVIDLLNVQRERFEAERQLINLRIERKRIEYRAAAQVGLLGPLLENRLNHGS

SEQ ID NO: 21571 - protein, 431 aa, Rhizobium meliloti
MPWAQTDKEVTNIGADLTYQINTDWKVKLGYNEQQYDRNYVASQPNQCYKNNCYDDMADGYFIKPFDRYDDWNFQTGYVDLTGRIETFGLEHQLLLGANILDYDYSQTRYTYKDANGNNFIEVKPGDVVEKPDFYNNSTRSTSDSSYKHFGFYVQDLMTINDYWKVLAGVRYDEQHKEGYGNNSYAVSPKAGLVFNPTIDSSIYVNYSKSFMPQGSVNNKTDVNDGLNLKPQYGEQYELGAKWALFDESLLLTGAIFDIEVSNIKVTEEIVDDPNFDQITTQAGKQKHRGFELGAQGQVTDQLFLTGSMMYLDAKYERPAGDSLDGKRPADTPEWSANVWSRYEVNDQLALNLGAVYEGKRFADNQNTVSKDGYIRFDSGVSYGMSVAETDVELRLNVKNLFDTEYFGGGGKTSTTVADGREFTLGVNATF

SEQ ID NO: 21572 - protein, 1122 aa, Rhizobium meliloti
MNMAVKISGVLKDGTGKPVQNCTIQLKAKRNSTTVVVNTLASENPDEAGRYSMDVEYGQYSVILLVEGFPPSHAGTITVYEDSQPGTLNDFLGAMTEDDARPEALRRFELMVEEVARNASAVAQNTAAAKKSASDASTSAREAATHAADAADSARAASTSAGQAASSAQSASSSAGTASTKATEASKSAAAAESSKSAAATSAGAAKTSETNASASLQSAATSASTATTKASEAATSARDAAASKEAAKSSETNASSSASSAASSATAAGNSAKAAKTSETNARSSETAAGQSASAAAGSKTAAASSASAASTSAGQASASATAAGKSAESAASSASTATTKAGEATEQASAAARSASAAKTSETNAKASETSAESSKTAAASSASSAASSASSASASKDEATRQASAAKSSATTASTKATEAAGSATAAAQSKSTAESAATRAETAAKRAEDIASAVALEDASTTKKGIVQLSSATNSTSETLAATPKAVKSAYDNAEKRLQKDQNGADIPDKGCFLNNINAVSKTDFADKRGMRYVRVNAPAGATSGKYYPVVVMRSAGSVSELASRVIITTATRTAGDPMNNCEFNGFVMPGGWTDRGRYAYGMFWQYQNNERAIHSIMMSNKGDDLRSVFYVDGAAFPVFAFIEDGLSISAPGADLVVNDTTYKFGATNPATECIAADVILDFKSGRGFYESHSLIVNDNLSCKKLFATDEIVARGGNQIRMIGGEYGALWRNDGAKTYLLLTNQGDVYGGWNTLRPFAIDNATGELVIGTKLSASLNGNALTATKLQTPRRVSGVEFDGSKDITLTAAHVAAFARRATDTYADADGGVPWNAESGAYNVTRSGDSYILVNFYTGVGSCRTLQMKAHYRNGGLFYRSSRDGYGFEEDWAEVYTSKNLPPESYPVGAPIPWPSDTVPSGYALMQGQAFDKSAYPKLAAAYPSGVIPDMRGWTIKGKPASGRAVLSQEQDGIKSHTHSASASSTDLGTKTTSSFDYGTKSTNNTGAHTHSVSGSTNSAGAHTHSLANVNTASANSGAGSASTRLSVVHNQNYATSSAGAHTHSLSGTAASAGAHAHTVGIGAHTHSVAIGSHGHTITVNAAGNAENTVKNIAFNYIVRLA

SEQ ID NO: 21573 - protein, 1023 aa, Aggregatibacter actinomycetemcomitans
MSKLKLGYLSSHIIFLALSVSTAYAQNDTQEKLNEIVVSGSSEGNGNSDDRTPPKIGETVKSAKKLEKQQAQDVKDLVRYDTGVTVVEAGRFGNSGFAVRGVEENRVAIQIDGLAQAETISSQGFKELFEGYGNFNNTRNSAEIETLKQVTIRKGADSLKSGSGALGGSVSFETKDARDYLTDKNYYASYKRGYNTADNQNLNTLTLAGRYKYFDAIAVFTSRKGHELENFGYKNYNERVQGKTREKADPYRRTLDSKLLKFAFQPTDNHRFSVMADLYKQTSKGHDFSYTLKPNTQFRTYDEEELRHTNDKVERKNFAFTYENFTTTPLWDTLKITYSQQKITTRARTDDYCDGNDKCPTSQNKLGMKYNEDNKLVGNDNKLAKYTNTPAQTKTIKEQVPLDPSSTAKYRWQKAQWHVLEQKYPGVKYSKYCEEDETDPSNFCTVELKIPGAPAKKSFEINGKEYDLKSEEVIGDEQTLTTNTSHILSCDAINCNKKTIGGFQRDGTPVDIPFEVFERDGKKYAKTKVMSKDQLSGPVFFMPNKSGYQENLWTQRDLTTKTKQINIDLTKHIEISGTEHDLFYGGLWAESKKEMINISGISARNIKWWAQYPKDCSPSINNPDRYNALCNRKNVYSFLIPVKTKTGALYFIDDFKLNDYFSFGVGYRYDRVKYNPEYIPGVTPKIPDDLVTNLYITDPKFDPSDLTSPENQARREANANANIKKIAQPKKFSASSYSLNTTVDPLDWLRLQAKYSKAFRAPTGDEIYFTFKHPDFSVLPNKDLEQETAKTKELSVTLHNDMGYISTSVFETRYNNFIDLVYKGNKQLQGHSKLRPFNVYQNINRPNAKVTGFEIVSQISLNDLAKILNGFNLSYKYTYQKGRMDGDIPMNAIQPRTAVYGIGYVHSDDKFGLDLYITHAGAKQAKDTYNMYHKEEGKKDSSIKWRSNSYTTIDLLGYIKPIKNLTLRAGVYNLTNRKYITWDSARSIRPFGTSNLIDQKSGLGINRFNAPGRNYRLSMQLEF

SEQ ID NO: 21574 - protein, 198 aa, Wolbachia endosymbiont
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARCFGSYGANFGKTAKDDGGIKVLYSTVGAEAGVALIF

SEQ ID NO: 21575 - protein, 753 aa, Escherichia coli
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTAHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNELEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMAEVIGNDWEGISDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDESHPANSARGRTWIFGGDIRF

SEQ ID NO: 21576 - protein, 1023 aa, Aggregatibacter actinomycetemcomitans
MSKLKLGYLSSHIIFLALSVSTAYAENDTQEKLNEIVVSGSSEGNGNSDDRTPPKIGETVKSAKKLEKQQAQDVKDLVRNDTGVTVVEAGRFGNSGFAVRGVEENRVAIQIDGLAQAETISSQGFKELFEGYGNFNNTRNSAEIETLKQVTIRKGADSLKSGSGALGGSVSFETKDARDYLTDKNYYASYKRGYNTADNQNLNTLTLAGRYKYFDAIAVLTSRKGHELENFGYKNYNERVQGKTREKADPYRRTLDSKLLKFAFQPTDNHRFSVMADLYKQTSKGHDFSYTLKPNTQFRTYDEEELRHTNDKVERKNFAFTYENFTTTPLWDTLKITYSQQKITTRARTDDYCDGNDKCPTSQNKLGMKYNEDNKLVGNDNKLAKYTNTPAQTKTIKEQVPLDPSSTAKYRWQKAQWHVLEQKYPGVKYSKYCEEDETDPSNFCTVELKIPGAPAKKSFEINGKEYDLKSEEVIGDEQTLTTNTSHILSCDAINCNKKTIGGFQRDGTPVDIPFEVFERDGKKYAKTKVMSKDQLSGPVFFMPNKSGYQENLWTQRDLTTKTKQINIDLTKHIEISGTEHDLSYGGLWAESKKEMINISGISARNIKWWAQYPKDCSPSINNPDRYNALCNRKNVYSFLIPVKTKTGALYFIDDFKLNDYFSFGIGYRYDRVKYNPEYIPGVTPKIPDDLVTNLYITDPKFDPSDLISPENQARREANANANIKKIAQPKKFSASSYSLNTTVDPLDWLRLQAKYSKAFRAPTGDEIYFTFKHPDFSVLPNKDLEQETAKTKELSVTLHNDMGYISTSVFETRYNNFIDLVYKGNKQLQGHSKLRPFNVYQNINRPNAKVTGFEIVSQISLNDLAKILNGFNLSYKYTYQKGRMDGDIPMNAIQPRTAVYGIGYVHSDDKFGLDLYITHAGAKQAKDTYNMYHKEEGKKDSSIKWRSNSYTTIDLLGYIKPIKNLTLRAGVYNLTNRKYITWDSARSIRPFGTSNLIDQKSGLGINRFNAPGRNYRLSMQLEF

SEQ ID NO: 21577 - protein, 185 aa, Wolbachia pipientis
  misc_feature (100)..(100): Xaa can be any naturally occurring amino acid
SLLIRLQYNGEILPLFTKVDGITYTKDNSDYSPLKASFLAGSGAFGYKMDDIRVDVEGVYSYLNKNTVTDARFMPDTIADSVTAISGLVNVYYDIAIEDXPIAPYIGDGVGAAYISTPLKDAVNDQKSKFGFAGQVKAGVSYDVTPEVKLYAGARYFGSFGAHFDKDAAAGKDKGELKVLYSTVG

SEQ ID NO: 21578 - protein, 810 aa, Haemophilus somnus
MKSKWLFLLLWMCVIVRPEAWGQEVKSANTVAEEWIQVSSSSATVLQWFEWIEKSTGIVLSYNPAQMELGDVCRIEHGGKMTVETLVRRILSGYQVKIAVVPPRKLVIHARKIESYDVSGTVSEEDSEERLYGAVVTLEDKDGKQWNTISNGKGIFRLHVPEGTYTLKTSYMGYAPQSQSVKVTRDCFVRTCLKPLLFEIEEVTVESGKRENELGELTPSNLLAFSGGDLFSQIWILPGVTSSLAGQNFMVDGGGYGENQLLLDGVPVFHPGHFSSLLPVFNGDAVKNMVFHKGFFPTPLEGRISSVTEVNLKEGNKKEHVRTLTLDMPAASVMLEGPIIKNKLSYMVGARRSWLDFFDSLLSEENRLNHSTYDYNAKLSYNLSPVTTMNFLAYGARDDFHLPIEENGENVSVLRWDNQAYQLSFATQKGRLGNSTAVFYSAHTNRAYMGEIKEDTDGYIHSGIKSLNVTTDFSYSLENLYHARWGVKYAYEVYDLVSQGEEMRVRHEPVNQVSVYYDNLLRISPEFSVQVGVHGVAYCPQHHRSYYSIQPRLSVKYFPSERNLLYLNFSKMEQFYHFLRFDSFSLPTDFRMPSIDGFKPRSSEHYEMGWKHFMDSGQCEVSVYYKTRRNVLALRPDTWVEDESWQKYLMVGNGDSYGVKGYLYQRWKRWSLQLSYAYSRSREWFGELPEKGKVPSLYDVPHQLGGALSYQLTTRSSFSVGGMLRSGKVRFLNEDYEPLSVEDFREKREPLNYRVDVGYSYRKSFGEKLLLLRLGVYNVVGNPSEEDILSFYSVHWRGNCLPYGSISFKF

SEQ ID NO: 21579 - protein, 760 aa, Haemophilus somnus
MKSKYSIILNQLFLSSSLMFPALSLADSNPAKTKPHKAEELGEISVVANVEPIFSSTQSSEQLRKNMVSNERDLFRHEVGIGVPEAGRSGSNGFAIRGVDKDRVAVIVDGIPQAESTMSTSARYSTERHNGNINNTEYENISSVKVQKGANSVINGSGALGGAVVFTTKEIEDFVDPDRTFGFLSKTGYTSKNREWREVIGGGVKGEHFFGFAQLTKRWGHETVNNGKGADILGEHRGKPNPLNYYTTSWLSKVGYDINNTHRFTLFYEDRNEKKFTEEKTLGLSDEHRFANDRTPYRRYGIEYRYNGLSWLETAKLFVAKQKIEQLSALRGINAYTNKLFQLASYQYIQNQTITRGELSTYPLALWRTTHRLSGKVEFRDQFLENSNSQRYFGGNYWVKKSRPNYTEIVPVKSRIFSLSLLDEIALTDTLKATIGGRYDRYNYNPQQKMNQQINFAIVKFPPRKLSHLSWQLGLEYQVHPSHQIGYRLSTGFRVPRVEDLYFVARDSGTTHQFRPNPLLQAETALNHELSYRFQNQYTHFSIGLFRTRYHNFIQERERCQPSFLNEKECGFNLITQFVNEPKAVIKGIEVSGAVNGSALGLSDGLTFRLKGSYSKGQNHDGEPLRSIQPWTVVGGIDYETEKWSISLTGRYSAAKKAKDAIVITYETVDVNAKKKVNQWPHLSPSYFVVDLTGQVNLSKNVILNLGVFNLFNRDYMTWDSAYNLFTRGYTSRSVSRNSPGINRFTAPKRNFAASVEVRF

SEQ ID NO: 21580 - protein, 583 aa, Vibrio parahaemolyticus
MINRFFLLNPIILGLGMILFSASTTQALPQQDSAFRESRDDFFRRQGTISLEEKETSPLPKLPTPDRNFQLRQSRDGFLNPASRRQSSMSQVTSVSELQDISPTDWAYEALRGLVERYGCIVGYPDRTFRGNRALSRYEFAAGLNACMNTIERLIQENVAVLREDIEKLKRLAQEFEQELIALGARLSNLEERVAYLEDHQFSTTTKLTGEFVVGLTGITSGERDGGSEEINKVTNFGYRGRLELNTTFDGNDLLYTRLATGTVPAYSDITGTFEGELGFSQPDGSDLAVELIIYEFDLAENIRMFVEPVGGAFDDFVPTVNFLDGDGAFGAISAFGSRNPLYYMGEGPGIGFQGRLFEVFEWSGGYLATDGNDPSLGAGMFNGPYGLIGQFAYEPSDRLKVAFTYVHGYNNLDSGTGTLRSNFQTFVEEEFEQSVNTVNNSYGMEFTWRIFDKFVLGGWGGFTSTRTLGPIDIGEEFDVIQRGKLDIWNWAVTLAFPDAFKEGDTGAIIVGMEPWVSKADINFPDDLRRTDQDSSFHIEAIYQYPINDNIAITPGIIVITEPDFDDRNEALVIGTIRTTFTF

SEQ ID NO: 21581 - protein, 1833 aa, Wolbachia pipientis
LQNSHSKKYVLTFFMSTCLLTSSFLSTSARAASFKDLVSKTPAWAKHNSTQQQNIWKDLTPTEKIKKWQEAALVPSFTQAQNDLGIKYKETDLSSFLDNTRHKARQARAEILLYIERIKQQDFDTKKQAYINQGVVPTDIEAATNLGISYDPSKIDHNVEHDQKVRRAEKDKKAVIELYISSINRDIKYKHYVDNDIIPEMQEVRTALNMNKDDAQSFVASIRTEIMENAKGQYIADSHIPTEKELKKKFGISRDDNRDGYIKSIRLKVMENAKGQYIADSHIPTEKELEQKFGADKGEATNYIASIATQMMLGKKSYYIDNNIIPNTDELMNEFNIGPVKATSYINQIRAGIEAKQFLNNNDTTKPSTGHSQKKSGSKNDHWYMSNQSINDTGTSSRIFTGREKKQRYFFDPISTFKTHFNTKASKGNLTQSQHTIKRIIQQEENIAEFKNLIKTDPIAALTLQVGSSYKQEAVTTILSDFNDNTIQRVLFSNDKGQLDFKTNIDVKNRPILQELLENSSSEEKTKFAERIQDYATRNISHSQFEEKARLDLIKLAASKDKRSVENFLTLQLELKNRMQPYIVNSAYILTPEIVKEINIELKNKGLIRDSLTKDYMIKLAKEVNNHTLNSVIKVILSDSNILSNETNKILGLAVGNNANNLEQTQSGIPNPPPLPLNGDIPNPPPLPLNGSMPPPPPLHSQGFSSNSKHFDLNQLQTEYPHIHSLYIQFTHNTTVQSKAPLQPTASSATSTGRSTPETAYAKLYAEYRTETGGTKANDLQDQLIKRQADLTNVIRQILTESYANQGADEKTLVNLFSISTPEIAEKAKEAFNTLAQDQYIKDITVNGKKTITSEEIIKNLFNEDTDDAVKRILLSSCKISEELKRPIKLEFNKSALIRELQGKQNPFEQLEFAYINAKNFDQDIFSNRVDELINNPNILTIVQQANFLITEDTNLRKTINSDQAQAKLDDLRTAILNTIKFEELITTNLPQHDFIAIVKEKDPALLQEFLKATTLKLTGNNNLDQLRLALPSFADMSNEQIRILANKLKMPIILKAIQECSQEKAKQHIHTENMPPPPPPPPLPNAHDLELAYLTSLGITKFNANTSTFKTTPKTYHFSSDIALRYKEFTLSGQKSAGYKAKYSDADLLQKAIVESVAFEHSKNLSKAYQNNKYFEQIQEAVDTMHPRFIGPRTEIGQNIHNIYTSKLLELTKDKEFIKYVEDIILSKKLTEAFTSADSDFIGPRTEIGQKIHDIYIQQLTKYPEEAVKEAFNTAHPDFIGPRTEIGQEVHNIYKSQLLELAKDKELFLFVQQVLVDSAELEQKYGSDIQSENSNDEKKVGRLDKTKLRLFQQENEATNDESSTKDDTQPEDSNKKSEQSDSKTALSPRLLSSNDSKNDKSSDYKKSLLELRSSDEDDQGYATGYTTDEEELEESNSTTGEELKKDISDYKKSLLALRSSDEDDQGYATDEEELEEGNSTTGEELKKDIVLESEDEAIDVSFKTEAITEQDKVTQRQQVSDDTSGKVAILVQATSTLHKPVHYNINDRLTVAAIGAGDEETSINRGVWISGLYGINKQSIWKNIPKYQNRTTGITIGADAEFINSHDVIGIAYSRLASQIKYNKKLGKTAVNGHLLSIYSLKELIKGFSLQTITSYGHNYIKNRSKNINNIIGKYQNNNLSVQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGL

SEQ ID NO: 21582 - protein, 669 aa, Acinetobacter lwoffii K24
MGTFSFNESNKLSKIAILVSSVLTLSVVSSNTMATEVANTGESQVNSVDEVITVIGRSVNTPLNIAANVNIIDSAQIEMSGATTLTQVLRGQSGIQISDSNSGAVFSMRGFSASQAANNTLILVDGRRLNNIDIAAPSINAIPLNQIERVEILSGSAGVLYGDQAVGGVINIITKAPTGTGGSIQLSGGSFNTYEGKADVSGAINDTWRYYAAASYNQGDNYRDHNANKTSSVLARLQYQTDSDNFFIETSYYDNDREMAGSLNEDQIKEDPTQANPSNSDDYQHEMTTAIRSGYQHQLNDAWSLGADINYTDSKVNSISWGKPGTNKRSFLEFTPKAVANIATEKGDLSIVTGIDLSRGESEFDLAFTQRSNVQKVASAYVQASVPLTQSLSYVVGGRYSEAKDDLVDGSVYPEGIELDQDAHAFELGLNYRPTATHRLYVRVDDNFRFAKVDEQAYTSPGVVGLNPQTGRSYEAGWDWTPKSHTLRLSAYRLDLEDEIVFDSSAETPIGGGFPGANVNADASRRYGVSADWDWQLTDKVQLGAEYNYIDAEFTAGVNEGKQLSWVAEHTGRGYFSIDANQNWQVFTEVVYTGERFIEGDNGNVDPKLDAYWLTNLAINYTKDAWLASFRVDNLFDEEYVSSGYYSSWGNGYYVGTGRALRLTGSYRF

SEQ ID NO: 21583 - protein, 341 aa, Pasteurella multocida
SSGFTQGTIGVGIDAHTLSQVKLDSGRGRTRGADSFATNSEGRPEDTQSEAGAAIKFRLSDTVLKYGNQFVSSPVFATDDSRLLPEVATGTLITSNEIKGLELTAGRFTGLNSQVQTGHDSAKQGSSIYTLRSANIVGASYKFTENFSGAIHASDVEDFWKKQYVNLNLVIPVSDDQSFTTDFNAYRSKDDGRKLAGDLDNKVWSLSGAYSIGAHTFTVAHQRSSGPTGYNYGVDGGGTVFLANSVQISDFVGPNERSWQARYDLNMASYGVPGLSFMTRYITGDNISTDTGVGNEHEWHVEAKYVHQEGPPKDLSFRLRNAIYRGTNSDHPATHYDNLND

SEQ ID NO: 21584 - protein, 329 aa, Pasteurella multocida
  misc_feature (213)..(213): Xaa can be any naturally occurring amino acid
SNLANAATVYNQDGTKVDVNGSLRLILKKEKNERGDLVDNGSRVSFKASHDLGEGLSALAYTELRFSKNVPVQVKDQQGEVVREYEVEKLGNNVHVKRLYAGFAYEGLGTLTFGNQLTIGDDVGLSDYTYFNSGINNLLSSGEKAINFKSAEFNGFTFGGAYVFSADADKQALRDGRGFVVAGLYNRKMGDVGFAFEAGYSQKYVKQEVEQAXAPKVFKDEKEKAFMVGAELSYAGLALGVDYAQSKVTNVDGKNVLLKWLNYDLTQSEVTRLIWKRSLKCVQNRLPELVQLTTGNFVNTGKKLVVHKHYRWSALLCLKPEPLWVYSQM

SEQ ID NO: 21585 - protein, 245 aa, Pseudomonas sp. HSM0414
MIKQTIVALLLSVGASSVFAAGTVKVFSNGSSEAKTLTGAEHLIDLVGQPRLANSWWPGAVISEELATAAALRQQQALLTRLAEQGADSSADDAAAINALRQQIQALKVTGRQKINLDPDIVRVAERGNPPLQGNYTLWVGPPPSTVTLFGLISRPGKQPFTPGRDVASYLSDQSLLSGADRSYAWVVYPDGRTQKAPVAYWNKRHVEPMPGSIIYVGLADSVWSETPDALNADILQTLTQRIPQ

SEQ ID NO: 21586 - protein, 182 aa, Anaplasma centrale
  misc_feature (3)..(3): Xaa can be any naturally occurring amino acid
SNXVRMLYYREILPLCTKIDGIDYKKGSDAYSPLKASFIAGSGAFGYKMDDIRVDVEGIYSQLRKNNVDGATFTPIDAIAENLTAISGLVNVYYDIVMEDMPITPYVGIGAGAAYISTPLKTAVNDQKSKFGFAGQVKAGVSYDVTPEVKLYAGARYFGSYGANFDKSTGGKDKGGYTVLYF

SEQ ID NO: 21587 - protein, 356 aa, Haemophilus influenzae
AVVYNNEGTNVELGGRLSIIAEQSNSTIKDQKQQHGALRNQSSRFHIKATHNFGDGFYAQGYLETRLVSAQSGTESDNFGHIITKYAYVTLGNNALGEVKLGRAKTIADGITSAEDKEYGVLNNSKYIPTNGNTVGYTFKGIDGLVLGANYLLAQERHKYTAAAAAAAGGARAVAGEVYPQKISNGVQVGAKYDANNIIAGIAYGRTNYREDITITPAYKLGKKQQVNGALSTLGYRFSDLGLLVSLDSGYAKTKNYKAKHEKSYFVSPGFQYELMEDTNVYGNFKYERNSVDQGEKEREQAVLFGIDHKLHKQVLTYIEGAYSRTRTTTVGSKTNASKVKTEKEKSVGVGLRVYF

SEQ ID NO: 21588 - protein, 349 aa, Haemophilus influenzae
AVVYNNEGTNVELGGRLSIIAEQSNSTIKDQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPTNGNTVGYTFKGIDGLVLGANYLLAQERYKYTAAAAVPGAVPGAVAGEVYPQKISNGVQVGAKYDANNIIAGIAYGRTNYREDIITGSDSGKKQQVNGALSTLGYRFSDLGLLVSLDSGYAKTKNYKAKHEKSYFVSPGFQYELMEDTNFYGNFKYERNSVDQGKKEREQAVLFGIDHKLHKQVLTYIEGAYARTRTNDKSKAEKTEKEKSVGVGLRVYF

SEQ ID NO: 21589 - protein, 345 aa, Haemophilus influenzae
AVVYNNEGTNVELGGRLSVIAEQSNSTRKDQKQQHGELRNAGSRFHIKATHNFGDGFYAQGYLETRLVSDYESRSDNFGNIITKYAYVTLGNKGFGEVKLGRAKTISDGITSAEDKEYGVLKNKEYIPKDGNSVGYTFKGIDGLVLGANYLLAQERVAYSSNGNTPGEVSTQKISNGVQVGAKYDANNIIAGIAYGRTNYREDLAAPQAKSGKKQQVNGALSTLGYRFSDLGLLVSLDSGYAKTKNYKDKHEKRYFVSPGFQYELMEDTNLYGNFKYERNSVDQGKKAREHAVLFGVDHKLHKQVLTYIEGAYARTRTRTRTNDKGKTEKTEKEKSVGVGLRVYF

SEQ ID NO: 21590 - protein, 341 aa, Haemophilus influenzae
AVVYNNEGTNVELGGRLSVIAEQSNSTRKDQKQQHGELRNAGSRFHIKATHNFGDGFYAQGYLETRLVSDYESRSDNFGNIITKYAYVTLGNKGFGEVKLGRAKTISDGITSAEDKEYGVLKNKEYIPKDGNSVGYTFKGIDGLVLGANYLLAQERVAYSSNGNTPGEVSTQKISNGVQVGAKYDANNIIAGIAYGRTNYREDLAAPQAKSGKKQQVNGALSTLGYRFSDLGLLVSLDSGYAKTKNYKDKHEKRYFVSPGFQYELMEDTNLYGNFKYERNSVDQGKKAREHAVLFGVDHKLHKQVLTYIEGAYARTRTNDKGKTEKTEKEKSVGVGLRVYF

SEQ ID NO: 21591 - protein, 332 aa, Haemophilus influenzae
AVVYNNEGTNVELGGRLSVIAEQSNSTADDQKQQHGALRNQGSRFHIKATHNFGDGFYAQGYLETRFVTKASENGSDNFGDITTKYAYVTLGNKAFGEVKLGRAKTIADGITSAEDKEYGVIKNSKYIPTNGNTIGYTFKGIDGLVLGANYLLAQERYEGEVNPQKISNGVQVGAKYDANNIIAGIAYGRTNYRENTIGIPGLGKKQQVNGALSTLGYRFSDLGLLVSLDSGYAKTKNYKAKHEKRYFLSPGFQYELMEDTNVYGNFKYERNSVDQGKKTREHAVLFGVDHKLHKQLLTYIEGAYARTRTTSGTNVTTEKEKSVGVGLRVYF

SEQ ID NO: 21592 - protein, 345 aa, Haemophilus influenzae
AVVYNNEGTNVELGGRLSIIAEQSNSTVNDQKQQHGALRNQGSRFHIKATHNFGDGFYAQGYLETRFVADQSGTESDHFGHIITKYAYVTLGNKAFGEVKLGRAKTIADGITSAEDKEYGVLNNSKYIPTNGNTVGYTFKGIDGLVLGANYLLAQERHKYTGVGVGAAGAVAGEVYPQKISNGVQVGAKYDANNIIAGIAYGRTNYREDIHKEDLGKKQQVNGALSTLGYRFSDLGLLVSLDSGYAKTKNYKDKHEKHYFVSPGFQYELMEDTNVYGNFKYERNSVDQGKKAREHAVLFGVDHKLHKQVLTYIEGAYARTRTNDQGKTEKTEKEKSVGVGLRVYF

SEQ ID NO: 21593 - protein, 353 aa, Haemophilus influenzae
AVVYNNEGTNVELGGRLSIIAEQSNSTIKDQKQQHGALRNQSSRFHIKATHNFGDGFYAQGYLETRLVSAQSGTESDNFGHIITKYAYVTLGNNALGEVKLGRAKTIADGITSAEDKEYGVLNNSKYIPTNGNTVGYTFKGIDGLVLGANYLLAQERHKYTAAAAGGARAVAGEVYPQKISNGVQVGAKYDANNIIAGIAYGRTNYREDITITPAYKLGKKQQVNGALSTLGYRFSDLGLLVSLDSGYAKTKNYKAKHEKSYFVSPGFQYELMEDTNVYGNFKYERNSVDQGEKEREQAVLFGIDHKLHKQVLTYIEGAYSRTRTTTVGSKTNASKVKTEKEKSVGVGLRVYF

SEQ ID NO: 21594 - protein, 344 aa, Haemophilus influenzae
AVVYNNEGTNVELGGRLSIIAEQSNSTIKDQKQQHGALRNQSSRFHIKATHNFGDGFYAQGYLETRLVSAQSGTESDNFGHIITKYAYVTLGNKAFGEVKLGRAKTISDGITSAEDKEYGVLNNSKYIPTNGNTVGYTFKGIDGLVLGANYLLAQERYKYGGAAGGAGAVAGEVYPQKISNGVQVGAKYDANNIIAGIAYGRTNYRESIHEKDLGKKQQVNGALSTLGYRFSDLGLLVSLDSGYAKTKNYKDKHEKSYFVSPGFQYELMEDTNFYGNFKYERNSVDQGKKEREQAVLFGIDHKLHKQVLTYIEGAYARTRTNDKSKAEKTEKEKSVGVGLRVYF

SEQ ID NO: 21595 - protein, 332 aa, Haemophilus influenzae
AVVYNNEGTNVELGGRLSVIAEQSNSTADDQKQQHGALRNQGSRFHIKATHNFGDGFYAQGYLETRFVTKASENGSDNFGDITTKYAYVTLGNKAFGEVKLGRAKTIADGITSAEDKEYGVIKNSKYIPTNGNTIGYTFKGIDGLVLGANYLLAQERYEGEVNPQKISNGVQVGAKYDANNIIAGIAYGRTNYRENTIGIPDLGKKQQVNGALSTLGYRFSDLGLLVSLDSGYAKTKNYKAKHEKRYFVSPGFQYELMEDTNVYGNFKYERNSVDQGKKTREHAVLFGVDHKLHKQLLTYIEGAYARTRTTSGTNVTTEKEKSVGVGLRVYF

SEQ ID NO: 21596 - protein, 316 aa, Haemophilus influenzae
AVVYNNEGTKVELGGRVSIIAEQSTSNKKGQKHQHGSLRNQGSRFNIKVTHNLGDGYYALGYYETRFMNKNIDSTENSIGSGFGTITTKLAYAGLGNKELGEATFGLQKTIADIISTAEDKEYGVIDKKPYIPTEGNAIAYTYKGIEGLTLGASYVFGGRNFYDYEIANGKISNAVQVGAKYDANNIVAGIAYGRTNYKAEQGKTQQVNGALATLGYHFDDLGLLISLDSGYAKTKNKAAKHEKRYFVSPGFQYELMENTNVYGNFKYERSSVDQGEKEREHAVLFGVDHKLHKQVLTYIEGAYARTRTTEQAKGV

SEQ ID NO: 21597 - protein, 311 aa, Haemophilus influenzae
AVVYNNEGTKVELGGRVSIIAEQSTSNKKGQKHQHGSLRNQGSRFNIKVTHNLGDGYYALGYYETRFMNKNIDSTENSIGSGFGTITTKLAYAGLGNKELGEATFGLQKTIADIISTAEDKEYGVIDKKPYIPTEGNAIAYTYKGIEGLTLGASYVFGGRNFYDYEIANGKISNAVQVGAKYDANNIVAGIAYGRTNYKAEQGKTQQVNGALATLGYHFDDLGLLISLDSGYAKTKNKAAKHEKRYFVSPGFQYELMENTNVYGNFKYERSSVDQGEKEREHAVLFGVDHKLHKQVLTYIEGAYARTRTTE

SEQ ID NO: 21598 - protein, 347 aa, Haemophilus influenzae
AVVYNNEGTKVELGGRLSVIAEQSSNTLDDQKQQHGALRNQGSRFHIKATHNFGDGFYAQGYLETRLVTNPNGFTHEDRDGFGDITTKYAYVTLGNKALGEVKLGRAKTIADGITSAEDKEYGVLNNSKYVPTNGNTAGYTFKGIDGLVLGANYLLAQKYDNAGVNDGEVQKQSISNGVQVGAKYDANNIVAAIAFGRTNYKEDNSPSASKRKEQLKGVLSTLGYRFSDLGLLVSLDSGYAKTKNHKKHRPAAAAYDEKRYFVSPGFQYELMEDTNVYGNFKYERNSSDQGKKTHEQAVLFGVDHKLHKQVLTYIEGAYARTKTNEKGQTEKTEKEKSGGVGLRVYF

SEQ ID NO: 21599 - protein, 344 aa, Haemophilus influenzae
AVVYNNEGTKVELGGRLSIIAEQSNSTVNDQKQQHGALRNQGSRFHIKATHNFGDGFYAQGYLETRFVAAQSGTKSDDFGHIITKYAYVTLGNKAFGEVKLGRAKTIADGITSAEDKEYGVLNNSKYIPTDGNTVGYTFKGIDGLVLGANYLLAQDRSKYTASGSVAGEVTPQSISNGVQVGAKYDANNIIIGIAYGRTNYREDIISKQLNNLVGTKQQVNGALSTLGYRFSDLGLLVSLDSGYAKTKNYKAKHEKSYFVSPGFQYELMEDTNVYGNFKYERDSVDQGKKAREHAVLFGVDHKLHKQVLTYIEGAYARTRTTESKKGVKTEKEKSVGVGLRVYF

SEQ ID NO: 21600 - protein, 344 aa, Haemophilus influenzae
AVVYNNEGTNVELGGRLSVIAEQSNSTRKDQKQQHGELRNAGSRFHIKATHNFGDGFYAQGYLETRLVSDYESRSDNFGNIITKYAYVTLGNKGFGEVKLGRAKTISDGITSAEDKEYGVLKNKEYIPKDGNSVGYTFKGIDGLVLGANYLLAQKREAYKTATATPGEVTSQSISNGVQVGAKYDANNIIVGIAYGRTNYREDVPQQNDVGKKQQVNGALSTLGYRFSDLGLLVSLDSGYAKTKNYKDKHEKRYFVSPGFQYELMEDTNLYGNFKYERNSVDQGKKEREQAVLFGIDHKLHKQVLTYIEGAYARTRTTMHDTKKTSTVKTEKEKSVGVGLRVYF

SEQ ID NO: 21601 - protein, 356 aa, Haemophilus influenzae
AVVYNNEGTNVELGGRLSVIAEQSTNTLDDQEQQHGALRNQGSRFHIKATHNLGDGFYAQGYLETRFVTDITKDKSDHFGDITTEYAYVTLGNKAFGEVKLGRAETIAGGITSAEDKEYGVLNNSKYIPTNGNTAGYTFKGIDGLVLGANYLLAQQRDVYHTVGKPGEVYPQSISNGVQVGAKYDANNIVAGIAYGRTNYRENIRLTALSPSRKEQVEGVLSTLGYHFSDLGLLVSLDSGYAKTKNHMKPAITTTTTTAAAEPAYDEKRYFVSPGFQYELMEDTNVYGNFKYERTYVNQGKKTHEQAVLFGVDHKLHKQVLTYIEGAYARTKTNDKGKAEKTGKEKSMGVGLRVYF

SEQ ID NO: 21602 - protein, 347 aa, Haemophilus influenzae
AVVYNNEGTKVELGGRLSVIAEQSSNTLDDQKQQHGALRNQGSRFHIKATHNFGDGFYAQGYLETRLVTNPNGFTHEDRDGFGDITTKYAYVTLGNKALGEVKLGRAKTIADGITSAEDKEYGVLNNSKYVPTNGNTAGYTFKGIDGLVLGANYLLAQKYDNAGVNDGEVQKQSISNGVQVGAKYDANNIVAAIAFGRTNYKEDNSPSASKRKEQLKGVLSTLGYRFSDLGLLVSLDSGYAKTKNHKKHRPAAAAYDEKRYFVSPGFQYELMEDTNVYGNFKYERNSSDQGKKTHEQAVLFGVDHKLHKQVLTYIEGAYARTKTNEKGQTEITEKEKSVGVGLRVYF

SEQ ID NO: 21603 - protein, 345 aa, Haemophilus influenzae
AVVYNNEGTKVELGGRLSVIAEQSNTTVDDQKQQHGALRNQGSRFHIKATHNFSDGFYAQGYLETRLISSYDGENTDGFGGIVTRYAYVTLGNKAFGEVKLGRAKTIADGITSAEDKEYGVLNNSKYIPTNGNTAGYTFKGIDGLVLGANYLLAQKYDTAGVAGEVQRQSISNGVQVGAKYDANNIVAAIAFGRTNYKESSVIALGRKEQLKGVLSTLGYRFSDLGLLVSLDSGYAKTKNHKELNKPTGAKPAYDEKRYFVSPGFQYELMEDTNVYGNFKYERTSSDEGKKTHEQAVLFGVDHKLHKQVLTYIEGAYARTKTNDKNKPEKTGKEKSVGVGLRVYF

SEQ ID NO: 21604 - protein, 353 aa, Haemophilus influenzae
AVVYNNEGTKVELGGRLSVIAEQSSNTLDDQKQQHGALRNQGSRFHIKATHNFGDGFYAQGYLETRLVTNPNGFTHEDRDGFGDITTKYAYVTLGNKALGEVKLGRAKTIADGITSAEDKEYGVLNNSKYVPTNGNTAGYTFKGIDGLVLGANYLLAQKYDNAGANDGEVQKQSISNGVQVGAKYDANNIVAAIAFGRTNYKEDNSPCASKRKEQLKGVLSTLGYRFSDLGLLVSLDSGYAKTKNHKKHIPAAAAAAAAAAYDEKRYFVSPGFQYELMEDTNVYGNFKYERNSSDQGKKTHEQAVLFGVDHKLHKQVLTYIEGAYARTKTNEKGQTEKTEKEKSVGVGLRVYF

SEQ ID NO: 21605 - protein, 647 aa, Vibrio fischeri
MNKKVFVVVMAGLLCSKGLMAADGQPMSVMGEEMVVTSSRFEEPKKNLTSNITIIGKDEIAQSSAQDLGELLAEKNLGQVQKYPGTMTSVGIRGFRSETHGNDLMGKVLVLIDGRRAGTGNTAKIMTENVERIEIIQGPAAVQYGSAAIGGVVNVITKKGDNVPSFFVEQKGGSNEFVKTAAGVQGKIGKLDFASALSRSEAGDYKTGSGKTYFNTGYDEQVLANLNVGYEIADGHRIGFGYHSFDVDKAGSPSYLSLNDLQSYTSNNNHAIDVSYEGALTNKRWLWSTRYFSGMDSYQYVDPSTSYTSSSDVEQQGAQAQISFTEKSLLITAGVDWLNYELTSTLAPKWSKYNNPAVFLLAKYGVFEDRLLLSAGVRYDDYKVDLQPAEGTSRSTDNFAHQVGAAWQVNDVVKLRASYAEGFRMPSARELAGNIVSFGKTYIGNPNLNPEVSETWETGIDVVWREITSSLTWFSTDYTDMIETQLTAPKTYLYKNIGSTSLSGIEAEFAWKSSATTWNIEPYVNYSYLLEHKDNATGDDLLYTPEWNASTGVRLQHTNGLSAALNVTATGSSNVQDYESNSGKVITKGGFSVVNLSASKKFTLDKQERRAITIKAEVDNLLDRDYQYVKGYPMPGRTFVIGLRADI

SEQ ID NO: 21606 - protein, 766 aa, Pseudomonas fluorescens
MIKKAYKLSLLSSLIAGSLAIPAVQADDIKTAANQKAEQTNASNPPEKQAARDKEINSGETMVVTAKEQTLQAPGVSIIDSEAIKKRPIQRDVAEIIRTMPGVNLTGNSNSGQRGNNRQIDIRGMGPENTLILIDGMPVSSRNSVRYGWSDERDTRGDTNWVPPEMIERIEVIRGPAAAMYGSGAMGGVVNIITKPATDEWHGSLNTYYNFPQHKSEGSTKRYNGSLSGALADNLTLRVYGNWNKTQADAQDINENHTTPRIGSYAGSYPAGREGFINKDINSALRWEFMPMQALELGAGYSRHGNLYAGDTQNTNSNALVKKYYGKETNVLYRQTLSLKYTGAWDSGVTTNNYVQFEKTRNTRLNEGLSGGISGIFSPSNEGFSTISLYDTNLHSEVNIPLDLWVSQTLTFGAEFNHQAMKDPSSNTESTTGGGSVPGIADTGRSKYSSADIYGIFAEDNLELTDSTRLTPAVRFNHQSISGSNWSPSLNLSQELGGDFTLKLGIARAWKAPNLYQTNPNYLLFSKGQGCYGGGACYLQGNRDLKAETSVNKEVGIEYNHDEVQAGLTWYRNDYHDKIAAGDSVAGKATSANIYQWENVPKAVVQGLEGTFNFPLADTLKMKNNFTYIIENKNKKSGDYLSVIPKYTINSTLEWQAANDLSVQGTLTWYGRQKPKKYTYQGNPTSGSETRQVSPYALVGMSATYAVTKYVDVTAGIDNLFDKRHFREGNAQTTGNATTGAYLWGAGANTYNEPGRTYYMQVGLHF

SEQ ID NO: 21607 - protein, 1095 aa, Klebsiella pneumoniae
MRRNCVPITTLRPSCGHIATGPRLKGYGAVIVVACRLSLIKVHPNLRAWGRGVVQLASMCGAGCVMEDLILKIQTIRERLLAGTMIGGVALAAAVALPVAAVVFSPTSASAQDFSSGTLTGAVTDASGSPVAGASVEIRSTAQGFVRNATTDASGSFRAALVPIGSYVITITAPGYGPIAQSASVGLGGASAYEFTLESASSSDAASLGEIVVTGARRTLDFNETTTGLTVDLEELVKTTPIGRSIAAVTLLAPSAVAGDSTFGDVPSIGGSSVAENAFYVNGLNITNFDNYIGGATVPFDFYRSVEVKTGGYAAEFGRATGGIINAVTKSGSNEFMLALHGNFAPNSLRDQSPDTFSTRNQFAESDSSSATIEIGGPIIRDRLFFYGLTEFRDNESASFGKLSNSKTVDKTDDPFYGAKIDAYITSDHRLEFTWFDTTRETNRTIYAYDPLTDEVGAQVGSNLYQYGGESWIGRYTGTFTDWLTLSAAYGVTEDRNVALAGDVVSNYAADVRDGTSNRVSQQTSASFTPERATKREAFRADADIYFNLLGDHHVRAGYDREDLTLTRFTERTGGYSLFYRRAAAGTLQAQGGNLAPGQDYLEVNVYRSGGNFENTNEALYIQDSWDVNDQLTLNLGVRLDKFELNNADGDSIVSFDEEIGPRFGFTYDPGNDGRSRIFGSYGRYYLPVASNTAYRMGASELYYREYFLLGGYTPNPTNPEAVAAYDQFGQPLALGAQVVGWNGAAICPDATLGTAGVQGCTVTGDGTASSTESLIAQNLQSTAEDEFIIGYERRFGDLWTMSATLAYRDLLRNAEDVAIDAAVNALCEDEGIAGCEDIWSGFHQYVIVNPGKGSTITLSDPLPGETDVRTVNFSAASLGYPEATRTYTSLTFEFERAFDGIWGLNGSYTISESKGNTEGYVKSDVGQADAGITQDFDQPGLTDGADGLLPNHRGHVFKVYGSYQLTRDLLIGANVNVSSPRKFGCMGFHPTDDYAYEYGAASWYCNGQLTPRGTVAESDWTKQIDVALRYNVPVGIPGDLVLRADIFNIFNFKGVTDIYEFGESNGVGDADPNFRAPIGYQTPRYVRIGFDWTF

SEQ ID NO: 21608 - protein, 375 aa, Moraxella bovis
MKKRYLTLAVAAGACGVTGAHAQSSVQLYGLMDLSVPTYQSHANANGAHVIGMGIDGEPWFSGSRWGLKGAEDIGGGSKIIFRLESEYVVANGEMEDPGQIFDRDAWVGIENDSFGKITAGFQNTIARDAAAIYGDPYGSARLTTEEGGWTNSNNFKQMIFYAGSATGTRYNNGVAWKKIFDNGIFASAGYAFGNSTSFGSNSNYQAALGYNGGPFNVSAFYSHVNRAGITNQSYSVGGNYTFGILRANAGYFRYLGNQGALGQRQDNAWTVSLKLAPKGPFDYELGYQQMRVKNAAYNADGNIPNANIGAFDPTSGLHNGYKETLYWSGFYHLSKRTEVYLAGDYMRLHGGYTVGSTFGASNQLELTTGVRTRF

SEQ ID NO: 21609 - protein, 163 aa, Wolbachia sp. wCer1
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 21610 - protein, 263 aa, Pasteurella multocida
SNKKGQKHQHGSLRNQGSRFNIKVTHNLGDGYYALGYYETRFMNKNIDSTENSIGSGFGTITTKLAYAGLGNKELGEATFGLQKTIADIISTAEDKEYGVIDKKPYIPTEGNAIAYTYKGIEGLTLGASYVFGGRNFYDYEIANGKISNAVQVGAKYDANNIVAGIAYGRTNYKAEQGKTQQVNGALATLGYHFDDLGLLISLDSGYAKTKNKAAKHEKRYFVSPGFQYELMENTNVYGNFKYERSSVDQGEKEREHAVLFGV

SEQ ID NO: 21611 - protein, 140 aa, Erwinia chrysanthemi
DKAPEEFWEYGVSTNVRMPWAWYSPSGWGLGTRLMGSAGALYGAGETALVVSLIPLVFLGSQDGKFTLDMGAGGALLSRHRFGTQDYGGYFQFALTAGVGVPLFERLGAGYRYMHYSDAGINGDHTTGADMHMLELSYRF

SEQ ID NO: 21612 - protein, 307 aa, Helicobacter pylori
MKKALLLTLSLSFWLHAERNGFYLGLNFLEGSYIQGQGSIGKKALAENTLNEAINNAKNSLFPEQNTKAIRDAQNALNAVKDSTKIANRFAGNGGSGGIFNELSLGYKYFLGKKGIIGFRHSLFFGYQLGGVGSVPGSGLIAFLPYGFNTDLLINWTNDKRASQEYVERRVKGLSIFYKDMTGRTLDANTLKKASRHIIRKSSGLVIGMDIGASTWFASNNLTPFNQVKSHTIFQLQGKFGVRWSGDEYDIDRYGDEIYLGGSSVELGVKVPAFKVNYYGDDYGDKLDYKRVVSVYLNYTYNFKNKH

SEQ ID NO: 21613 - protein, 240 aa, Brucella suis
MKSVILASIAAMFATSAMAADVVVSEPSAPTAAPVDTFSWTGGYIGINAGYAGGKFKHPFSSFDKEDIEQVSGSLDVTAGGFVGGVQAGYNWQLDNGVVLGAETDFQGSSVTGSISAGASGLEGKAETKVEWFGTVRARLGYTATERLMVYGTGGLAYGKVKSAFNLGDDASALHTWPDKTKAGWTLGAGAEYAINNNWTLKSEYLYTDLGKRNLVDVDNSFLESKVNFHTVRVGLNYKF

SEQ ID NO: 21614 - protein, 240 aa, Brucella melitensis
MKSVILASIAAMFATSAMAADVVVSEPSAPTAAPVDTFSWTGGYIGINAGYAGGKFKHPFSSFDKEDNEQVSGSLDVTAGGFVGGVQAGYNWQLDNGVVLGAETDFQGSSVTGPISAGASGLEGKAETKVEWFGTVRARLGYTATERLMVYGTGGLAYGKVKSAFNLGDDASALHTWSDKTKAGWTLGAGAEYAINNNWTLKSEYLYTDLGKRNLVDVDNSFLESKVNFHTVRVGLNYKF

SEQ ID NO: 21615 - protein, 424 aa, Shigella flexneri 2a
MLNTRMGMLALGIISASQAMAQGQADSKGFVEDSSLNVNLRNAYINRDFKNDREDKSEWGQAFMGTFASGFTQGTVGVGVDAFALYGIRLDGGKGRSGNGGIDFFKQGDSGAAADDLSRAGAAVKARFSNTVIKYGDQMPQLPVLNYDNSRLLPESYTGTLITSKEIEGLEVVAGRFTQEARKSAEGRDSGDLKSINVYGASYKFTDEFSAAFYASDNEDVFKKQYLNLNYVFALPQDQSLTFDFNGYKTRLDKDFTASDARDNKIWSLAATWAVGIHSFTLAHQRSTGDMGYAYGGYRNDGGFGDGGNTIYLANSYWSDFNGKDERSWQAAYGVDLSGLVLPGLSYKAAYVRGDNIDDGTAGSGDGTEREIFSQLTYVVQSGPAKDLSLRLRNSFLRVSDDAQAYNSEGNETRIFVDYPINIF

SEQ ID NO: 21616 - protein, 774 aa, Shigella flexneri 2a
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMNAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWMFNLNSDFQSSQFADNANTVKESADGSTGRIPGFMLWGARVVYDFGPQMADLNLAFGVKNIFDQDYFIRSYDDNNKGIYAGQPRTLYMQGALKF

SEQ ID NO: 21617 - protein, 604 aa, Escherichia coli
MKNKYFLSAFFLVSLIGNAQENNQKTDTLREVIVSSSRIDLPFKENSRTIQIITAEDIKKLGITNVADALQQLAGVDVRRQGVNGMQADLYIRGGGFDQTLLLIDGIKVDDPQTGHHTMNLALPIEVIKRIEVIKGPAARVFGQNAFTGAINIVTNDNLENSIIAKIQGGSFGQFIAEVTGAVNLEDSNHVIHFSKQSSDGYRKNTDFDNTNYVLRSKFNKLKLPINLISAFSERKFGAQNFYGVTSAAALPYEVTQASLIGFSTEFKSGNFTFKPRVYWRRNQDEYIFIRTNPSVYRNLHITNKIAVELNGSYESKIGITGFGLEFSKYMIQSNNLGDDEREIATFFLEHRFGLFNNVLDITPGVAVSYFSDFENKAFPGIDLGVKVSERVRVYTNVGYTYRVPTYTDLNYSDPSTLGNPNLEAERALAQELGFKYHANTVDFNVAFFNRNTENFIDYRRATPADLWRPVNIDVETKGFESSLKYNFSLGKIKNQLNLGYTYIDDNINTDLTSKNGINSMRHQVVFNYDIQLFKGFSQNISYRYVERTSRVSYNVYDLNTTFRTKSIELTMLIQNIFNTEYFENTFVPMPKGNVLFGMKYLFK

SEQ ID NO: 21618 - protein, 732 aa, Bacteroides caccae
MDGKGPSQFGLHEARHEVSEPRVEDPSIEIPTRYCEHPPSARSLSAVPVSSCMVFVTRRPPLFLLLAILWTGVGPDLAVGQSPDSTIVELPEVTVEAVRGAETEASAPFAVTVRSRSPAEVSLTSSTSLDDVLRPLPGVWVNDRHHFALGERISVRGVGYRSNFGVRGVQVLYDGIPLTLPDGQAFLDVVDPAVVRQVELVRSPASVFWGNGSGGVLFLSSSGTAPPPNRIRVQGGSYGQWQGLAEGGGTVGPWTVHGYASGQRQEGYRAHSQGYRVRAGGTARRGLGPDTRLRIVAAADQQDTENPSSLTREQFNDDPSQARAAFVDVNAGKQSSQVQLGASIDHDLGGATLSGTAYGLRRALDNPLNFAFVRYTRWSGGTRFTLRRTEGRLQGGLGVDAGIQSDDRIEFTSTTPDGNPGPEVGLDQLETVLNGSAFGYARLNATDRLALTGGLRLDQMRFEADDGLTKDGDQSGTRTFSSVSPSFGLSFDAGPAQVFAQYSTAFETPTASELSNRPGGGGGFNQQVEPQFTRGFEIGARGAFPEARLRFDVALYRLEVDDLISAYEDADGRDVYDNLAANTHDGIEASLTWQATDALEVATRYTGSRFVVDESNDDSLVGNRVPGIPSRRLYLHTEFSHGGWWGRISGQGVPSYYTNNANTAEAPRYVLVNLNLGHRGIDMAGLTLKPFVTVNNVLNERYAGSVVVNAFGGRYYEPAPERSFSAGLNVEW

SEQ ID NO: 21619 - protein, 255 aa, Helicobacter pylori
MKKIFLGMALAFSVSMAEKSGAFLGGGFQYSNLENQNTTRTPSANNNTPINTSMFGNNQAAPAQETPSVINTNNYGQMYGVDAMAGYKWFFGKTKRFGFRTYGYYSYNHANLSFVGSKLGIMDGASQVNNFTYGVGFDALYNFYESKEGYNTAGLFVGFGLGGDSFIVQGESYLKSQMQICNNTAGCSASMNTSYFQMPVEFGFRSNFSKHSGIEVGFKLPLFTNQFYKERGVDGSVDVFYKRNFSIYFNYMINL

SEQ ID NO: 21620 - protein, 319 aa, Helicobacter pylori
MKKIFLCLGLASVLFGADNNVKFEITPTLNYNYFEGNLDMDNRYAPGVRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRPAPQAKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPRSSNDTKEGRADNRRVDAKFILR

SEQ ID NO: 21621 - protein, 260 aa, Helicobacter pylori
MKKIFLGMALAFSVSMAEKSGAFLGGGFQYSNLENQNTTRTPGANNNTPIDTSMFGSNQTAPAPQAQATYTPSVINTNNYGQMYGVDAMAGYKWFFGKTKRFGFRSYGYYSYNHANLSFVGSQLGIMEGASQVNNFTYGVGFDALYNFYESKEGYNTAGLFLGFGLGGDTFIVQGESYLKSQMHVCNNTAGCSASMNTSYFQMPVEFGFRSNFSKHSGIEVGFKLPLFTNQFYKERGVDGSVDVFYKRNFSIYFNYMINF

SEQ ID NO: 21622 - protein, 315 aa, Escherichia coli
MKLKFFVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGSRNKKGAHPSGERTIGYKQLFKIPYIGLTANYRHENFEFGAELKYSGWVLSSDTDKHYQTETIFKDEIKNQNYCSVAANIGYYVTPSAKFYIEGSRNYISNKKGDTSLYEQSTNISGTIKNSASIEYIGFLTSAGIKYIF

SEQ ID NO: 21623 - protein, 185 aa, Wolbachia sp. wLma1
SYYVRLQYNGEILPFYTKVDGITNATGKEKDSPLTRSFIAGGGAFGYKMDDIRVDVEGLYSQLAKDTAVVDTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEA

SEQ ID NO: 21624 - protein, 185 aa, Wolbachia sp. wDpus
SYYVRLQYNGEILPFYTKVDGITNATGKEKDSPLTRSFIAGGGAFGYKMDDIRVDVEGLYSQLAKDTAVVNASETNVADSLTAFSGLVNVYYDIAIEDMPITPYVGVCLGVAYISNPSKASEVKDQKGSGFAYQAKAGVSYDVTPEIKLFAGARYFGSYSASFDKAAKDDTGIKNVVYGTVGAEA

SEQ ID NO: 21625 - protein, 185 aa, Wolbachia sp. wCmbi
SYYVRLQYNGEILPFYTKVDGIKDAKDKEKDSPLTRSFIAAGGAFGYKMDDIRVDVEGLYSQLAKDTAVVDTSETNVADSLTAFSGLVNVYYDIAIEDMSITPYVGVGVGAAYISNPSKADTVKDQKGFGFAYQAKAGVSYDVTPEIKLFAGARYFGSYGASFDKAANDDTGIKNVVYSTVGAEA

SEQ ID NO: 21626 - protein, 185 aa, Wolbachia sp. wBtab15
SYYVRLQYNGEILPFYTKVDGITNATGKEKDSPLTRSFIAGGGAFGYKMDDIRVDVEGLYSRLAKDTAVVNTSETNVADSLTAFSGLVNVYYDIAIEDMPITPYVGVGVGAAYISNPSKADAVKDQKGFGFAYQVKAGVSYDVTPEIKLFAGARYFGSYGASFDKAAKDDTGIKNVVYSTVGAEA

SEQ ID NO: 21627 - protein, 163 aa, Wolbachia sp. wBtab14
  misc_feature (7)..(8): Xaa can be any naturally occurring amino acid
  misc_feature (51)..(51): Xaa can be any naturally occurring amino acid
  misc_feature (63)..(64): Xaa can be any naturally occurring amino acid
  misc_feature (143)..(143): Xaa can be any naturally occurring amino acid
  misc_feature (163)..(163): Xaa can be any naturally occurring amino acid
SYYVRLXXNGEILPLFPKVDGITYKKGNSDYSPLKASFIAGGGAFGYKMDXIRVDVEGVYSYXXKNDVTDAKFTPATTIADSLTAISGLVNVYYDIAIEDMPITPYIGVGVGAAYISTPLATAVSSQNDKFAFAGQARAGVSXDVTPEVKLYPGARYLGSYGX

SEQ ID NO: 21628 - protein, 184 aa, Wolbachia sp. wBtab13
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAE

SEQ ID NO: 21629 - protein, 185 aa, Wolbachia sp. wBtab12
SYYVRLQYNGEILPFYTKVDGITNATGKEKDSPLTRSFIAGGGAFGYKMDDIRVDVEGLYSQLAKDTAVVNASETNVADSLTAFSGLVNVYYDIAIEDMPITPYVGVGLGVAYISNPSKASEVKDQKGFGFAYQAKAGVSYDVTPEIKLFAGARYFGSYGASFDKAAKDDTGIKNVVYSTVGAEA

SEQ ID NO: 21630 - protein, 182 aa, Wolbachia sp. wBtab11
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYVLVLIRQLRMILVSKMLFTALLV

SEQ ID NO: 21631 - protein, 185 aa, Wolbachia sp. wBtab9
  misc_feature (153)..(153): Xaa can be any naturally occurring amino acid
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAPYISNPSKADAVKDQKGFGFAYQAKAGVSYDVTPEIKLFAGXRYFGSYGASFDKAPKDNTGIKNVVYNIVGAEA

SEQ ID NO: 21632 - protein, 179 aa, Wolbachia sp. wBtab8
SYYVRLQYNGEILPFYTKVDGITHTSGKSPLKASFLAGGGAFGYKMDDIRVDVEGLYSQLAKDTAVVNASETNVADSLTAFSGLVNVYYDIAIEDMPIIPYVGVGVGAAYISNPSKASAVKDQKGFGFAYQAKAGVSYDVTPEIKLYAGARYFGSYGASFNKETVSATKEINVLYSAVG

SEQ ID NO: 21633 - protein, 185 aa, Wolbachia sp. wBtab6
  misc_feature (43)..(43): Xaa can be any naturally occurring amino acid
SYYVRLQYNGEILPFYTNVDGIKNVTSKGEDSPLKRSFIAGGXAFGYKMDDIRVDVEGLYSRLAKNKAVIDASEANVADSLTAFSGLVNVYYDIVIEDMPITPYVGVGVGAAYISNPSNAADVKNQRRFGFAYQAKAGISYDVAPEIKLFAGARYFGSYGASFDKAAKGDDGIKNVLYNTFGAEA

SEQ ID NO: 21634 - protein, 185 aa, Wolbachia sp. wBtab4
SYYVRLQYNGEILPFYTTVDGITNATGKEKDSPLTISFIAGGGAFGYKMDDIRVDVEGLYSQLAKDTAVLNTSETNVADSLTAFSGLVNVYYDIAIEDMPITPYVGVGVGAAYISNPSKADAVKDQKRFGFAYQAKAGVSYDVTPEIKLFAGARYFGSYGASFDKAAKDDTGFKNVVYNTVGAEA

SEQ ID NO: 21635 - protein, 185 aa, Wolbachia sp. wBafe
SYYVRLQYNGEILPFYTKVDGITNATGKEKDSPLTRSFIAGGGAFGYKKDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEA

SEQ ID NO: 21636 - protein, 777 aa, Vibrio pommerensis
MKKQLYYYFRIFLFSILISPISILALDVTLTGIVKDKNGNSISNVKIILQESRKTTITNEKGEFVLNHVPPGKYTLVAISRGYQSETISITIGEKDEKTQFTLLESSLDQSAINVTAKSTNSDFLTAPQPITVLSGRQLDRQRGETAMSAINNTPGVSNLTTGSGTSKPIIRGLTGQRVLVMTDGIRQEEQQFGDDHTVELDSFNIQKIEIIRGPGSLLYGSDALGGVVNVIRDKAPLSEEGIPKMAGIFNSNSYSNNKQDAGNFAIYGNLNGFGYRASSNSRKAGKITTPNGTLRNTGMIEKNQSASIGLDGDWGNFYLDSFKREQTQDLLDNPNENPGATVSQKLLHEKSHFHSFFIFSAGNLELDFSYQRNNRREIESKNKLLPIQDILLDKNAEVLDKSFQFYQVTSKEKYQGLNLFLDTTTADAKFHHKPIFNFLKGTIGISGLEQRNKTIGTEPLIPSYGIINIAGYFLEELKLGSLTFSAGIRGDKRSVDIRNNQTLGVSEQTKNYYMTTGSTGVVWRIYKSFSTIFNYGRGFRAPTPFELFSYGVHEGTGKFEIGNNHLKPEYSNNLDFSLRFASSKIQTEISIFQNHIQNFIYAASIAQIDLDSGLPKYEYKQGNAILKGGEFSIQAELFRKLVFSGGIDIVYSRNQSDTHPLPRTTPNRARAGLRWTEDSILGLKNFYFSINGRFYDSQYRVDPKETPTKGYNLIDAGLGFELPHFGDGTSKPTVDLSIQNVFNVSYVDHLSRYKDYALNPGLNAILKVSFPFTAIP

SEQ ID NO: 21637 - protein, 816 aa, Rhizobium leguminosarum bv. viciae
MLTRKSTVARLGLFLGACAALLPETARAQTSPEPTEEIIVTGTRRLDRTVSQSPVPIDVIPTADLQRSGLGELNKVLNSLVPSYNFPQPTVTDGTDHIRPATLRGLGPDHTLVLVNGKRRHQTSLLNLNGSVGRGSTGADLNTIPTAAIERIEILRDGAAAQYGSDAIAGVINIILKDGAEGGLVTGTVGQHYEGDGTLWHAQSNIGLPLGAAGGFVNLTAEYRDRGRTNRQGPDTRQQYNTLPNGQPDPREATIDRTDNFRYGDSAVEDINLFYNLGLPLADGVEAYSFGNYGRREGESGAFWRRPRDASNVRAIYPDGFLPLITSQIDDLSVAGGVRGETGRTNWDISTVYGRNYFPYRIKNTVNATFGTDSPTEFFAGDLLYQQVVSNADASREFDVGLPAPVSVAGGLEWRHENFQIGRGEFGSWADGGVKVLDNAAASPIGSQPSPGAQGFPGFRPADEVDESRSSQSAYIDLETNLTPELLLSLAGRVEHYSDFGWTESGKIAAKYDITDGFALRGAVSNGFRAPSLQQSFFTSTSTTYIGGVPYEIRTFRTDDPVAKALGAEDLKAEKSVNYSLGFTSRPFEGATLTVDAYRIEIDDRIVLSENLTGTAVQNFLAARGFLGVTGGRFFTNAIDTRTQGIDVVGTYRLDLAEAGQILFTAGANINDTKVTDVKPNPETLQAVGLDLVRFARVEEGRFTEAQPQDKVNLSAVWSWQGLDVTLKGTRYGEFTARNANPALDQTFGAEWVVDAEAAYEVVEGLTLAVGANNLFDQYPGTVIPGANTSGFAQYSNFSPFGFNGGFYYARVAYSW

SEQ ID NO: 21638 - protein, 186 aa, Legionella pneumophila
MKRLISCLTIICALNASAAAETTSSPCSRWISFLKPVCQRIHQTWTEGHDDMYFSGYAWHNRYTYRPEKIKSYNEAAWGGGLGKSLFDEKGNWHGLYAIAFLDSHRHIEPAVGYAYLKTASVNKDIKAGLGYSVLITSRVDYDNVPFPGALPWVALFYKRTTVAATYIPGSAGAGNVLYILGKISL

SEQ ID NO: 21639 - protein, 363 aa, Klebsiella pneumoniae
MKVKVLSLLVPALLVAGAANAAEIYNKDGNKLDLYGKIDGLHYFSDDKDVDGDQTYMRLGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEGATNNGRGALKQNGDGFGTSVTYDIFDGISAGFAYANSKRTDDQNQLLLGEGDHAETYTGGLKYDANNIYLATQYTQTYNATRAGSLGFANKAQNFEVAAQYQFDFGLRPSVAYLQSKGKDLNGYGDQDILKYVDVGATYYFNKNMSTYVDYKINLLDDNSFTRSAGISTDDVVALGLVYQF

SEQ ID NO: 21640 - protein, 371 aa, Enterobacter cloacae
MMKRNILAVVIPALMFAGAANAAEMYNKDGNKVDIYGKVDVRHYFADADTKGDHESGDASRARIGFKGETQINKDLTGFGRFEYEVKTNTTEGENKAKTRLAYAGLKFADFGSLDYGRNYGVIYDTNAWTDVLPLWGGDSMAQTDVYMTSRTTGVLTYRNTDMFGYVDGLSFALQYQGKNNENTNNKRKDNAEANGDGFGFSTAYNLGWGVTLGGGYSSSARTNWQEHKSDATGKRAEAWNVGGKFEANNVYLAAMYGETRNMNYYGDGAIANKTQNIELTAQYDFADLGIKPSLGYVQSKGKDLNNGVGGLKDNNHDLVKYISVGSFYKFNKNMTAVVDYKINLLDEDDFTKANGVATDNVVGLGLTYQF

SEQ ID NO: 21641 - protein, 375 aa, Enterobacter cloacae
MKVKVLSLLVPALLVAGAANAAEIYNKDGNKLDLYGKIDGLHYFSSDDSVYGDQTYMRIGVKGETQINDQLTGYGQWEYNVQANNTESSSDQAWTRLAFAGLKFGDAGSFDYGRNYGVVYDVTSWTDVLPEFDGDTYGSDNFLQSRANGVATYRNSDFFGLVDGLNFALQYQGKNGSVSGEDQTNNGRGFQKQNGEGFGTSVTYEIWDGISAGFAYSSSKRTDEQNNSTYFSKSYRRTYGVLGEGDHAETYTGGLKYDANNIYLATQYTQTYNATRTGDIGFANKAQNFEVVAQYQFDFGLRPSVAYLQSKGKDMGRYGDQDILKYVDLGATYYFNKNMSTYVDYKINLLDDNKFTKDASISTDNVVALGLVYQF

SEQ ID NO: 21642 - protein, 630 aa, Bordetella pertussis
MPAQPPENESPLAETEIVPLLDPQQDLVLPEVEVVGRLDSFPANPLPDTAAITPTGTTVAVGKTGSSVTVITGEEIQRTQQTTVAEVLRQVEGVDVVRTGGPGGITSVFIRGANSQHTKVILDGIPINDPSNAGRSFDFSTLSTQNIERIEVLRGPQSMLYGSDAIGGVINIITKRGEGPLTATALVEGGSFNSSNTSLTMSGGNDLFYHSTSLGYQGTDGVSSAQFANGNPERDGYYNGTISGRYGWTPSELLNVDYVFRYADVHAAVDDQPFGSLPVDNLIRSNLSDVFYEKIQLQSFQFDGLVEHRVALDHTNYERVDTDPGFLDPQYNGSTKQFEYQLNLMLLEDNIFTVGTNHLNEEASNTSTPAVSQYLSGVFLQDQYQLGDRFYGTAGVRWDDHSVAGTAQTYRFTFLIDAWEIGSEFHGSIGTGFRAPSLAENLFPFGNPNLRPERSKGWDVGVTKYIFDRQGSIDVTYFRNDFQDLIAFDFNTFLLENIGTARSTGVEVVGVWGWDERTDIRSTYTFTSPRDLDNDRPLQRRPRNKATLGVERQVASDATVNLYMLYVDNRFDLSGPLDSYITVNVAGTYELAQGMTLVGRIDNLFDEDYEEVPGFGTLGIGAYSGLRFVW

SEQ ID NO: 21643 - protein, 910 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 21644 - protein, 283 aa, Anaplasma marginale
MNYRELFTGGLSAATVCACSLLVSGAVVASPMSHEVASEGSGVMGGSFYVSAAYSPAFPSVTSFDMRESSRETSYVRGYDKSVATIDVSAPANFSRSGYTFAFSKNLLTSFDGAVGYSLGGARVELEASYRRFATLADGQYAKSGAESLAAITRDAAITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLFS

SEQ ID NO: 21645 - protein, 403 aa, Azotobacter vinelandii
MHSCQTNQHAGARVAGTVIAACLSSFVPDVAHAQSSVTLYGLIDTSITYSTNQRTRGAGSPGGGSVAMTSGALNASRWGLRGREDLGGGMAAVFALENGFSGTTGKLSQKGVDLFGRQAWVGVSSQTAGTLSFGRQYDLILDYVTPLGASGPGWGGNLAVHPYDNDDSNRNLRINNAVKYASPTVRGLRFGAMVGFSNAAGQFSNNAVWSTGVSYENGPVKLGAGYLKISRDRNAPNPDGALSTVDGSATITGGNQQIWAMAGRYAFGPHSVGAAWSHSATDGVTGVLQGGNIAPLKGESLVFDNFSIDGRYFVTRALSVAAAYTYTMGRFDTRTGQTRPKWNQVVAQAGYVLSKRTDAYLEGTYQSVSGGNGNPAFNATVWTLTPSANSNQVVVALGLRHKF

SEQ ID NO: 21646 - protein, 180 aa, Wolbachia endosymbiont
YVRLQYNGEVLPFKTRIDGIEYKKGNEVHDPLKASFVAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGARFNKDTVSATKEINVLYSAV

SEQ ID NO: 21647 - protein, 187 aa, Wolbachia endosymbiont
LVQISDEETSYYVRLQYNGEILPFYTKVDGIKNSTSKEEDSPLKRSFIAGGVAFGYKMDDIRVDVEGLYSRLAKNKAVIDASESHVADSLTAFSGLVNVYYDIVIEDMPITPYVGVGVGAAYISNPSNAAEVKDQRRFGFAYQAKAGVSYDVAPEIKLFAGARYFGSYGASFDKAAKGDDGIKNVLQ

SEQ ID NO: 21648 - protein, 163 aa, Wolbachia endosymbiont
YVRLQYNGEILPLFTKVDGATGAKKKTADTDTTTDLYKASFMAGGGAFGYKMDDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGA

SEQ ID NO: 21649 - protein, 1533 aa, Wolbachia endosymbiont
ATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGILNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVN

SEQ ID NO: 21650 - protein, 277 aa, Wolbachia endosymbiont
WQFGQHWATAEAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKAKIPATIKSSRVFFFFFL

SEQ ID NO: 21651 - protein, 138 aa, Haemophilus influenzae biotype aegyptius
KHEYFHQYEMFTEYGLPWDWRGDSGWGLGVKLDASAGALYGGKAIGFIGTLGPGFSFSKGNRGFAADIGSSLVILNKRNFGTQNFAGKLQFLIYLGLNYRFDNGLGLGYRIQHMSNAGLYNSVNPGLDLHMAAISWNF

SEQ ID NO: 21652 - protein, 232 aa, Haemophilus influenzae
YDVSAPYVALTFDSGKFSVDGSLRYDMGDARGSYNGTAIAQNLDVNGDGVIQPVEQRVATVDTANSRPVNYDWNYLSYSLGGNYLLTDDLGAFARISRGARANADRLLFGVVRDDGSVSTNEGVNVVRQAEAGLKWRRDGLSLFATAFSARTQEQNFEITSQRFFNRSYEAHGLELEASYRYQGFTVNGGLTWTDAEISRDQITPENTGNVPRRQADVVWQLTPSYRGDHYQ

SEQ ID NO: 21653 - protein, 932 aa, Microscilla sp. PRE1
MILWRSSASRLAIVVGAGFWSMPILVQAQEAPKENRTLLAPIVVTADKSDAFAIGGSVQRLDLTDMERFSYSDPNRVLRQIPGVYLQEEEGFGLRPNIGIRGSGTDRNARITVMEDGILIAPAPYAAPAAYYFPKMARMSGVEVAKGPAAIKYGPMTVGGAINLFSTPIPDSDIGTLTGKADILGGSYGGRRVHAWTGGWAPLGDAFEIGGLIEGLYDKSDGFKDIDRGGDTGFDLTDWGGKLGFRTADGTQNFEFKYQNYDETSNETYLGLTLDDFKDTPFRRYNASQKDVIDAAHNIYQFSHSYEITPDINLTTTVYRTDTTRAWYKLNDVRNDSDTGWVSLSNILADPDTYSTQMADIVGADGYTGRAGALRVRNNARAYQATGIQSVLTTNFDTGELSHELELSARYHQDEEDRFQQDDRYQMVNGRMILTSAGAPGSQSNRLNEAKAWAFFARDTIEAGPFTFVPGLRYESINLDQTNWGSADPGRNGPTTAKQSYVDVFIPGLSATWSATDEVLLVAGVHRGFASPAPGSDVDPETSWNYESGVKYDSDGWRAGAIGFINSYSNLLGTCTASTGGNCTIGDQFEGGEVSVKGIELTVGRTFGSIDSNGFEVPVTLAYTYTNARFRRSEPAQVDHARAAVCIRIDHEVRQACVAMTDYEIGRLVDQVPRQFGPQSVEQFARRSVLILRGQEIRIDGIAPDDIRGPVEHRREPPPERAGFRRQFMQQLQLPQDRRPGFLEVDGGELACRHTRQRADDEACFICRDPLADGGRAQAERRQPSDTIALPLEQCCGLAARNLRIGAAVAATIDAVTGFAVTNRRPFPTRGQFRKQNFVTGVAPAHEARHCKCADAIIPVRDRSARPDPAARRPPAGFPSARKRRSGCRRGDTSRPRSGATSEKAAKPGAWRSRSCNPRGKRRGCGTNAGTA

SEQ ID NO: 21654 - protein, 771 aa, Shigella boydii
MMRKKAGQVALFVSGLGVMPLADGALAQTSSRSTNLPPIEILEPQARQRTASRPTSTAANPRRVASRPRARQAEAAPAVFPTPGVPQTGTVGQPPVPYAGGQVGSGARLGLLGNTSIFSAPFNITSFTSKLMEDQQARSIADVVLNDPSVRNDAPPFSERDSFFIRGFSVTNLDTAYDGLFYLANPRRSFLEGIERVEILKGPSALLSGGTARVGGTINLIPKRAGDEPLTRLTTGWMSDSQIWNHIDVGRRFGDFKEWGVRFNGSYRNGDTPLDLNSVEVGVASLGLDYRSEDFRASLDLNSSVQHINAPTSLFNSAAPNIVIPPAPNGRINTASRDEYIDSRYKMIAGRAEYDILPDTTLYLAGGGSIYNEDFLTSSYRITNFNGTATNTLAIQPQELQGYTGEIGLRSKFRTGVIGHQLNISAVEANNELYRGGTLGFTPYSYVTNIYNPVRPRPGAFQTSGFAQSDDRPLLSRLTARSVAVSDTLSLFNDRLLLTLGGRWQDIALSGFVTAAGPTQGTRSSYYNEARFSPAVGAVIRATDELSIYGNYIESLDSGPTAPATARNPNTVFPPMVSKQQEVGAKYDFGFVALTASLFQIEQPSAYTDPTTRIFSVDGLQRNRGAEFNIFGEPFKGVRLLGGIALIDAKQVSTIGGRYNGNDVPGVPTTSLTLYGEYDLPPWMAPGVTLTGRVIHTADVFYDQANTQTVSEWTRVDLGARYTFVGPTGKPAVLRATVENVADTAYYLSAARGYLAVGAPRTYMVSATFNF

SEQ ID NO: 21655 - protein, 625 aa, Erwinia carotovora
LGGGNGTSQYLYIRGMGQNSIDVKVDNTYSDSQILYHQGRHMLDPALVKIVSVQKGAGSASAGIGQTNGAVIAKTVDALDLLKNSDKNFGAKLGTGFSTNHAHNFNATLYGKGEIFDALVSGNLVRDRDYKGGKDYVNQFGTNRVPYSALDKTSFLAKLGATLGDHRFVLSHSSERNEGQRLVREEFDVAPNGTKVSPYNRLTVERQAPANRRITVQRTNLEWTGKNLGFAQEATANVYQLVQGRWSENETGNGYAGGVDYATKTKIVTHGANVNFDSALHENVLLKYGVNYRHQEAKPHTKFNPLVKNQEKTDTGVYVEAITAPVDKVTLTTGVRYDHFKFKAMDGKERSNGAFSPSVGLIYEPIEHLSLSASHNYATRSPRLYDALTAHGNRKIVSIGSNTKAEKARNTEIGFNYNNGTFSFDGSYFWQDIKDALGGGRDSHNPNNELIMNLGKIKNRGYELNAGYHNGGFTARIGVAHSKPRFYSPTIWEVNRQTGKREEKPLLSTNPEYASAIGRTWTASLSYRFEQPNLEVGVHHRIVEKVKPEDNFFVTGGTLQTNTGTGKDGYNVTDITLNWKPLKDDSVNVNFAVDNVANKKYNAHGQRGQLSARGREFRAGVNYTF

SEQ ID NO: 21656 - protein, 147 aa, Brenneria rubrifaciens
LDIYTRLGGIVWRADSHAAQSGVDRNNDDTGVSPLAALGIEYAFDKNWAVRVDYQWISNIGDAGTVGARPDNMFMSAGVSYRFGQDDYVAPAVTRATAPVVETKRFTLKSDVLFNFNKATLKPEGPQSLDQLYSQLSSMEPKDGSVI

SEQ ID NO: 21657 - protein, 149 aa, Erwinia tracheiphila
LDDYTRLGGMVWRADSTQNIITILDIGDHDTGVSPLAAIGAEYALTKNWATLVDYQWVNNIGDANTVGTSPDNGMLSLGVSYRSGEADDVAAPVPAPAPAPVVETKRFTLRSDVLFAFNKATLKPEGQQALDQLYSQLSSLDPKDGSVV

SEQ ID NO: 21658 - protein, 358 aa, Erwinia tracheiphila
LDDNEAQKMKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDVYTRLGGMVWRADTKANVPGGASFKDHDTGVSPVFAGGVEYAITPEIATRLEYQWTNNIGDANTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 21659 - protein, 662 aa, Erwinia tracheiphila
LDEVSVVSSGSMYKMGEVPVHQAKSAVAISREDLDKQDVKKADEIGRYQAGFANQVFGNDTNTNWFRVRGAEVSQAVDGLPTFSYGFFTPYVETFGLEAVEVTKGADSMTFGAANSGGLINYVTKRAHRDQIGRGEFKTNFGSNNLYGFGADYTGKITDDENVRYRVVASLNHADGEWKDTDNKTVYIAPSLEWDISERTRLSILTSYQKDSGTPSSNFYPQEGTLRALPDGSYYSRNLNFGDPLNDHEKNNNTVSGYELSPDFGNGLRANSSYRYNHVENNHRGGYIYPSAYAADWSAVAPSANGYNVPGQTVFNQGKAISHSTDNRISWDFKNDWLKNTVVVGTDYRHNKVDAQYSLYALGYTANLRDYRATWNQTGTPVGTDTHIKSRQLGFYLQNQARIADKYLLGFGIRHDRARQNEYTSDQTIKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESEAATGEKTRQSLIPTNTLAARTAYNFTDGVLNGLTVGAGVRYLGHSVTSKGSLYSHARVPSATVVDLMARYNINQNWSAQLNVDNVGNRKYVAACDYYCYYGAERKVNAT

SEQ ID NO: 21660 - protein, 149 aa, Erwinia tracheiphila
LDVFTRLGGMFWRAVKTQTNPTNGRISNHDTGVYPLAAVGVEYAVTKNWATRLDYQGVNNIGDAGPVGARPDNFMLSVGVSYRFGQDEAAPVVVLEPVLAPVEETKRFTLKIDVLLTLSKFTLKPEGQQALDQLVSQLSNLVPKDGFVV

SEQ ID NO: 21661 - protein, 145 aa, Brenneria nigrifluens
LDVYTRLGGFIWRVDSSDDLGHSNNDTGVSPLAAAGLEYAIDKNWATRLEYQWVNNIGDAATVGGRPDNGLLSVGVSYRFGQDDNYVAPAPAPAPAPVAETKRFTLKSDVLFNFNKSTLKGKGQQSLDQLYSQLSSLDPKDGSVG

SEQ ID NO: 21662 - protein, 146 aa, Brenneria nigrifluens
LDVYTRLGGFFWRADSHDDVTGRSGNDTGISPLAAVGLEYAVTKNWATRLDYQWVNNIGDAGTVGGRPDNGMLSVGVSYRFGQETPAPVVAPTPAPAPVIQTKRFTLKSDVLFTFNKAECVLKARALWNQLYTHLEFLQPGVHQFL

SEQ ID NO: 21663 - protein, 147 aa, Brenneria nigrifluens
LDIYTRLGGIVWRADSHATQSGVDRNNDDTGLSPLAALGIEYAFDKNWAVRVNYQWITNIGDAGTVGARPDNMFMSAGDSYRFGQDDYVAPAVTPAPAPVVETKRFTLKSDVLFNFNKATKKPDGQQSLDQLYSELSSMDPKDGTVI

SEQ ID NO: 21664 - protein, 147 aa, Brenneria salicis
LDVYTRLGGMVWRTDSHAAQGGFDRNNDDTGVFSLAAIGVEYAFDRDWAARVDYQWVSNIGDAGTVGARPDNLMMSVGISYHFGQGDASVVKPRAPSSKLVENQTFRLKSDVLFNFNKQPLKPEGQQPLDQLYSQLSSMDPKDGSVV

SEQ ID NO: 21665 - protein, 149 aa, Brenneria salicis
LDVYTRLGGMVWRAVATQTNPTYGRISNHDTGVSPLAAVGVEYAVTKNWATRLDYQWVNNIGDAGTVGARPDNSMLSVGVSYRFGQDEAAPVVAPAPAPAPVEETKRFTQKSDVLFTFNKSTLKPEGSQALDQLYTQLSNRDPKDGSGV

SEQ ID NO: 21666 - protein, 147 aa, Brenneria salicis
LDVYTRLGGMVWRTDSHAAQGGFDRNNDDTGVFSLAAIGVEYAFDRDWAARVDYQWVSNIGDAGTVGARPDNLMMSVGISYRFGQGDASVVKPRAPSSKLVENQTFRLKSDVLFNFNKSTLKPEGQQPLDQLYSQLSSMDPKDGSVV

SEQ ID NO: 21667 - protein, 147 aa, Brenneria alni
LDVYTRLGGMVWRTDSHAAQGGFDRNNDDTGVSPLAAIGVEYAFDRDWAARVDYQWVSNIGDAGTVGVRPDNLVMSVGIFYRFGQGDASVAKPRAPSSKLVENQTFRLKSDVLFNFNKQSLKPEGQQALDQLYSQLSSMDPKDGSVV

SEQ ID NO: 21668 - protein, 327 aa, Erwinia chrysanthemi
VDAIGMLGLKLDSGKGRAGTGLFPTGSDGRSQADYSKGGAAVKFRVSDTVLKVGDQFTALPVFATDDSRLLPEMAQGTLITSNEIKDLTLHAGHFTSLTAQEETNRDSLHLKEANVVGGTYAFTENLSTSLYYSKVEDYWRKYYANVNWALPISDKQGLVFDFNIYDTKSEGHLARAFDGDKLDNRAFSLSGAYNIGAHTFTLAYQKVTGDGDYAYGVDGGGTIFLANSVARSDFNAEDEKSWQARYDLNFAEYGIPGLTFMTRYVRGSDANVAGTSNGNEWERDVDIKYVLKEGPAKDLSFRVRQATYRSSDGVYYDSPSIDELGL

SEQ ID NO: 21669 - protein, 149 aa, Pectobacterium cacticida
LDVYTRLGGIVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFKKSTLKPKGQQALDQLYTQLSNLEPKDGSVV

SEQ ID NO: 21670 - protein, 149 aa, Pectobacterium cypripedii
WNVYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSVV

SEQ ID NO: 21671 - protein, 304 aa, Erwinia persicina
WTGATRAVDALSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKVPPAPKPAPQPGPQPPQPPQPPQPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVH

SEQ ID NO: 21672 - protein, 148 aa, Erwinia rhapontici
WNVYTRLGGMVWRADSTQNANGTRISDHDTGVSPLAALGVEYAVTKNWATRLDYQWVNNIGDAGTVGARPDNSMLSVGVSYRFGQDDAVAPVVAPAPAPAPVVETKRFTLTDVLFNFNKATLKPEGQQALDQLYTQLSNLDPKDSSVV

SEQ ID NO: 21673 - protein, 241 aa, Erwinia carotovora
WMQFNYMYAVDELPGGSNHDYMEMEFGGRAGVVDLYGYVDVFNPSERTDSDKSGSPKMFMKFAPRFSIDAITGMDLSVGPIQEVYLTTLFNWGGGDINLYAPGAGDVNNASIGIGADVMVPWFGKVSMNLYKYYEIQAKDWNGYQFSMNWFKPFINFDNGSFISYQGYLDYQFASDDDYAAEQNKTQASSGGVMFNGIYWHSDNYAVGYGIKAFSDVYLIKDTDGFQSTGFAHYFSATYKF

SEQ ID NO: 21674 - protein, 148 aa, Erwinia mallotivora
LDVYTRLGGMVWRADSTQNNNGIRISDHDTGVSPLAAVGVEYALTKNWATRLDYQWVNNIGDANTVGTRPDNGMLSLGVSSVSGQDYWLVARAPAPAPAQVGETKPFTLRSDVLFNFNKATLKPEGQQALDQLYTQLSSLDPKDGSVI

SEQ ID NO: 21675 - protein, 145 aa, Erwinia mallotivora
LDVYTRLGGMVWRVDSNDHAGHSNNDTGVSPLAAAGFEYAIDKNWATRLEYQWVNNIGDAATVGGRPDNGMLSVGVSYRFGQDDYVAPAAPAPAPAPVVETKRFTLKSDVLFNFNKSTLKPEGQQSLDQLYTQLSSLDPKDGSVV

SEQ ID NO: 21676 - protein, 149 aa, Erwinia mallotivora
LDVYTRLGGMVWRADSTQYNNGTRISDHDTGVSPLAAVGVEYALTKNWATRLDYQWVNNIGDANTVGTRPDNGMVSLGVSYRFGQDDVVAPAPAPAPAPAPVVETKRFTLRSDVLFTFNKATLKPEGQQALDQLYTQLSSLDPKDGSVV

SEQ ID NO: 21677 - protein, 146 aa, Brenneria quercina
LDVYTRLGGFFWRADSHDDVTGRGGNDTGISPLGCIGLEYAVTKNWATRLDYQWVEQHWWQCTVGGRPDNGMLSVGVSYRFGQETPAPFVAPTPAPAPVVQTKLSRLKSDVLFTFNKAELRPEGQSSLDQLYTQLSTMDPKDGSVV

SEQ ID NO: 21678 - protein, 146 aa, Brenneria quercina
LDVYTRLGGFFWRADSHDDVTGRGGNDTGISPLAAVGLEYAATKNWATRLDYQWVNNIGDAGTVGGRPDNGMLSVGVSYRFGQETPAPVVAPTPAPAPVVQTKRFTLKSDVLFNFKKAECVLKARALLAQLYTQLGTMDSKNGSVL

SEQ ID NO: 21679 - protein, 80 aa, Brenneria quercina
LTFREKTSGSRYYGTVINAGYYVTPNAKVFAEFTYSKYDEGKGGTQTIDKNSGDSVSIGGDAAGISNKNYTVTAGLQYRF

SEQ ID NO: 21680 - protein, 129 aa, Brenneria quercina
LAGAEDGAVFSVEYLHSPFHEHSRFSARFGGVLELVSTGDAFVGVGLSGNLDLNNDWFVETSVMPGAYFENAPLNDLGSTFEIRSQIALGKRLRNGTALSLALSHKSNASTASLNPGVNVLSLRWHKPL

SEQ ID NO: 21681 - protein, 146 aa, Brenneria quercina
LDVYTRLGGFFWRADSHDDVTGRGGNDTGISPMGAVGLEYAVTKNWATRLDYQWVKQHWCPGTFGGRPDNGMLSVGVSYRFGQETPAPVVAPTPAPAPVVQTKLSRLKSDVLFTFNKAELRPEGQSSLDQLYTQLSTMDPKNGSVV

SEQ ID NO: 21682 - protein, 146 aa, Brenneria lupinicola
LAVYIRLGGFFWRADSHADVTGRGGNDTGISPMGAVGLEYAVTKNWATRLDYQWVSNIGCAGTVGGRPDNGMLSVGVSYRFGQETPAPVVAPTPAPAPVVQTKLSRLKCDVLFTFNKAEVRPEGQSSLDQLYSQLSTMDPKDGSVV

SEQ ID NO: 21683 - protein, 146 aa, Brenneria lupinicola
LDVYTLLGGMVWTPNSTQNIGTRIGDHDTVVSPLAAIGAEYALTKNWATRLDYQWVNNIGDANTVGTRPDNGMLILGVSYRFGQDDVAAPVPAPAPAPVVETKRFTLRSDVLFAFNKATLKPEGQQALDQLYSQLSSLDPKDGSVV

SEQ ID NO: 21684 - protein, 146 aa, Brenneria lupinicola
LDVYTRLGGFFWRADSHDDVTGRGGNDTGISPMGAVGLEYAVTKNWATRLDYQWVSNIGDAGTVGGRPDNGMLSVGVSYRFGQETPAPVVAPTPAPAPVVQTKLSRLKSDVLFTFNKAELRPEGQSSLDQLYTQLSTMDPKDGSVV

SEQ ID NO: 21685 - protein, 147 aa, Brenneria rubrifaciens
LDIYTRLGGIVWRADSHAAQSGVDRNNDDTGVSQLAALGIEYAFDKNWAVRVDYQWISNIGDAGTVGARPDNMFMSAGVSYRFGQDDYVAPAVTPAPAPVVETKRFTLKSDVLFNFNKATLKPDGQQSLDQLYSQLSSMEPKDGSVI

SEQ ID NO: 21686 - protein, 147 aa, Brenneria rubrifaciens
LDIYTRLGGIVWRADSHAAQSGVDRNNDDTGVSPLAALGIEYAFDKNWAVRVGYQWVSNIGDAGTVGARPDNMFMSAGVSYRFGQDDYVAAAVTSAPAPVVETKRFTLKSDVLFNFNKATLEPEGPQSLDQLYSQLSSMEPKDGSVI

SEQ ID NO: 21687 - protein, 1004 aa, Brenneria rubrifaciens
LDGDFSLSNVKKGDIIQISFVGYITQEVLWNGTPLNVILKDDTQTLDEVVVVAFGTQKKVNVTGAVSTVGAKEIAARPVSSTVEALQGVVPGMNISTSSDGGSLKGNKEFNIRGTGTIGKGSSVSPLVLIDGMEGDINAINPQDIENISVLKDAAASSIYGSRAPGGVILITTKKGKSGKPSINYNNNFRFNSPLNMPHMADSYSFALAINDQLTNGGQSPMYSEKKLQQILDYQHGKSTQYMWATDAGRWNAFDDPNRQDVMPTANTDWLHELFGDSFTQEHSISVNGGTDVMQYYMSANYLDEGGLLKYGDDGRQRYSFTGKINADLAKWLKVGYSVRFNRIDYSSPSFASAGENKENVFYFDVCRYWPVIPVVDPNGFYTAESKIYQLTEGGRYNTQNDVVAQQLQFLIEPIKNWKTTIELNYRSNYNFSHTDYQTVYAYDVNKNPYAIANTTSGVTEYAYKSNFFNPNIFTEYSLELENGHNMKAMVGFQSELFKQRDITAKQNNIMSGIPTLNTTTDNARASGGYQEWATAGFFGRINYDYKGRYLVEANLRYDGSSRFLRDQRWNWFPSFSLGWNVAREAFFEKYTNIVNTLKVRGSWGELGNQNTDNWYPFYRIIDYKQNNGGWLVNGLKPNTAAESSLVSALLGWEKTQTLNIGFDLGMLDNRFNLNFDYFQRKSIDMVGPGQELPTILGIAVPNVNNLNMTSKGWELQVSWRDQIRDFRYGVTLALSDNQVVIDKYPNPSKDLGQTYYDGAHLGDLWGYQTIGIAKTQAEMDAHLAKVDQSSMGSNWGAGDIMYADLDGDGVISAKDNTADNHGDKVLLGNKTPRYNFGLNLDAAYKGFDLKVFFQGTLKRDYMPGSGAESMMFWGAVGYWQTNFFEPHLDYFRPADTTSPLGANVDGYYPRPLESDKNRKAQSRYMQNAAYCRLKNVTLGYTLPADLTKKFYVNNLRFFVSAENLFTITNLCDTFDPETIGVGNWEGCTYPLSKTISFGLSATF

SEQ ID NO: 21688 - protein, 147 aa, Brenneria rubrifaciens
LDIYTRLGGIVWRADSHAAQSGVDRNNDDTGVSPLAALGIEYAFDKNWAVRVNYQWISNIGDAGTVGARPDNMFMSAGVSYRFGQDDYVAPAVTPAPAPVVETKRFTLKSDVLFNFNKATLKPEGQQSLDQLYSQLSSMDPKDGSVI

SEQ ID NO: 21689 - protein, 148 aa, Brenneria rubrifaciens
LDIYTRLGGIVWRADSHAAQSGVDRNNDDTGVSPLAALGIEYGFDKNWAVRVNYQWVSNIGDAGTVGARPDNMFMSAGVSYRFGPGDYVAPAVTPAPAPVVETKRFTLKSDDLFINFNKATLKPDGPQSLDQLYSQLSSMEPKDGSVI

SEQ ID NO: 21690 - protein, 149 aa, Erwinia psidii
WDVYTRLGGMVWRADATQTNPTYGRISNHDTGVSPLAAVGVEYAVTKNWATRLDYQWVNNIGDAGTVGARPDNSMLSVGVSYRFGQGEAAPVVVPAPAPAPVVETKRFTLKSDVLFTFNKSTLKPEGQQALDQLYTQLSNLDPKDGSVV

SEQ ID NO: 21691 - protein, 149 aa, Erwinia psidii
LDVYTRLGGMVWRADSTQNNNGIRISDHDTGVSPLAAVGVEYALTKNWATRLDYQWVNNIGDANTVGTRPDNGMLSLGVFYRFSGQDYWLVARAPAPAPAQVGETKPFTLRSDVLFNFNKATLKPEGQQALDQLYTQLSSLDPKDGSVI

SEQ ID NO: 21692 - protein, 149 aa, Erwinia psidii
LDVYTRLGGMVWRADATQTNPTYGRISNHDTGVSPLAAVGVEYAVTKNWETRLDYQWVNNIGDAGTVGARPDNSMLSVGVSYRFGQDEAAPVVAPAPAPAPVVETKRFTLKSDVLFTFNKSTLKPGGQQALDQLYTQLSNLDPKDGSVV

SEQ ID NO: 21693 - protein, 149 aa, Erwinia psidii
LDVYTRLGGMVWRADSTQNNNGIRISDHDTGVSPLAAVGVEYALTKNWATRLDYQWVNNIGDANTVGTRPDNGMLSLGVFYRFSGQDEWLVARAPAPAPAQVGETKPFTLRSDVLFNFNKATLKPEGQQALDQLYTQLSSLDPKDGSVI

SEQ ID NO: 21694 - protein, 145 aa, Erwinia amylovora
LDVYTRLGGFIWRVDSSDDLGHSNNDTGVSPLAAAGLEYAIDKNWATRLEYQWVNNIGDAATVGGRPDNGLLSVGVSYRFGQDDNYVAPAPAPAPAPVVETKRFTLKSDVLFNFNKSTLKGKGQQPLDQLYSQLSSLDPKDGSVV

SEQ ID NO: 21695 - protein, 186 aa, Erwinia amylovora
VYYVRLQYNGEVLPFKTRIDGIGYKKGTEVHDPLKASFMAGSAAFGYKMDDIKVDVEGLYSRLNKNDVSGATFNPTTVANSVAAFSGLVNVYYDIAIEDMPITPYVGVGVGAAYISNPSEASAVKDQKGFAFAYQAKAGVSYDVTPEIKFFAGARYFGSYGASFNKEAVSATKEINVLYSAVGAEA

SEQ ID NO: 21696 - protein, 149 aa, Erwinia amylovora
LDVYTRLGGMVWRADATQTNPTYGCISNHDTGVSPLAAVGVEYPVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSVV

SEQ ID NO: 21697 - protein, 148 aa, Erwinia amylovora
WTVYTRLGGMVWRADSTQNANGTRIRDHDTGVSPLAAVGVEYAVTKNWATRLAYQWVNNIGDAGTVGARPDNSMLSVGVSYRFGQGDAAPVVAPAWAPAPVVETKRFTLKSDVLFNFNKATLKPEGQQALDQLYTQLSNLDPKEGSVV

SEQ ID NO: 21698 - protein, 149 aa, Erwinia amylovora
LDVYTRLGGMVWRADATQTNPTYGRINNHDTGVSPLAAVGIEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSVV

SEQ ID NO: 21699 - protein, 149 aa, Erwinia amylovora
LDVYTRLGGMVWRADSTQYNNGTRISDHDTGVSPLAAVGVEYALTKNWATRLDYQWVNNIGDANTVGTRPDNGMVSLGVSYRFGQNDVVAPAPAPAPAPAPVFETKRFTLRSDVLFTFNKATLKPEGQQALDQLYTQLTTLDPKDGSVV

SEQ ID NO: 21700 - protein, 150 aa, Erwinia amylovora
LDVYTRLGGLVWRAAHSQNADDTGLNDHNTGISPLAAVGVEYAITKNWATRLDYQWVNNIGDAGTIGDRPDNNLLSVSVSYRLGQETDASAPVVAAALAPAPVVQTKRFTLKSDALFNFNKATLKAEGQCSLGQLYSQLSSMDPKDGSVV

SEQ ID NO: 21701 - protein, 149 aa, Erwinia amylovora
LDVYTRLGGMVWRADATQTNPTYGRISNHDTGVSPLAAAGVEYAVTKNWATRLDYQWVNNIGDAGTVGARPDNSMLSVGVSYRFGQDEASPVVAPAPAPAPVVETKRFTLKSDVLFTFNKSTLKPEGQQALDQLYTQLSNLDPKDGSVV

SEQ ID NO: 21702 - protein, 149 aa, Erwinia amylovora
LDVYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFKKSTLKPEGQQALDQLYTQLSNLEPKDGSVV

SEQ ID NO: 21703 - protein, 149 aa, Erwinia amylovora
LDVYTRLGGIVWRADATQTNPTYGRISNHDTGVSPLAAVGVEYAVTKNWATRLDYQWVNNIGDAGTVGARPDNSMLSVGVSYRFGQDEAAPVVAPAATPAPVVETKRFTLKSDVLFTFNKSTLKPDGQQALDQLYTQLSNLDPKDGSVV

SEQ ID NO: 21704 - protein, 149 aa, Erwinia amylovora
LDVYTRLVGMVWRADATQTNPTYGHISNHDTGVSPLAAVGVEYAVTKNWATRLDYQWVNNIGDAGTVGSRPDNSMLSVGVSYRFGQDEAAPVVAPAPAPAPVVETKRFTLKSDVLFTFKKSTLKPEGQQALDQLYTQLSNLEPKDGSVV

SEQ ID NO: 21705 - protein, 149 aa, Erwinia amylovora
LDVYTRLGGMVWRADATQTNPTYGRISNHDTGVSPLAAVGVEYAVTKNWATRLDYQWVNNIGDAGTVGARSDNSMLSVGVSYRFGQDKAAPVVAPAPAPAPVVETKRFTLKSDVLFTFNKSTLKPEGQQALDQLYTQLSNLDPKDGSVV

SEQ ID NO: 21706 - protein, 149 aa, Erwinia amylovora
LDVYTRLGGMVWSADSTQNNNGTRISDHDTGVSPLAAVGVEYALTKNWATRLDYQWVNNIGDANTEGTRPDNGMVSLGVSYRFGQDDVVVPPAAPAPAPAPVVETKRFTLRSDVLFTFNKATLKPEGQQALDQLYTQLSSLDPKDGSVV

SEQ ID NO: 21707 - protein, 1654 aa, Rickettsia felis
MAQKPNFLKKLISAGLVTASTATIVAGFAGSAMGAATQQNRTTVGAATTVDGAGFDQTAAPANLAVAPNAVITANANNGINFNTPAGSFNGLFLDTANNLAATVSEDTTLGFITNAANNGNFFNFTLGAGKTLTITGQGITAGQAAATKNAQNAVAQVNGGNAIANNDLSGVGTIDFGAAPSTLVFNLTNPTTQRAPLILGDNAVIANGANGTLNVTNGFIQVSDETFATIKTINIGDGQGFIFNTDATAGNALNLQVGGATINFNGTDGTGRLVLLSNAAGGGATDFNVTGSLGGNLKGIIEFNTTAVAGQLIANAGPANAVIGTNNGAGRAAGFVVSVANGNAATVAGQVYAKDMVIQSTNAGGQVNFGHIVDVGTDGTTAFKTAATTVAITQNSNFGAVDFGNTASQITVPDTKVLTGNFTGDASNNGNTAGVITFAANGTLASGNADANVAVTNKITAIEAAGVGVVQLSGTHTAELRLGNAGSQFKLADGTIINGNVNQTVLVGNAALANGAIQLDGSATITGDIGNGAGNAAPIQGITLANDASKTLTLGGANIIGANAGGTIDFQANGGTVKLTSTQNNILVDFDLAITTDKTGVVDASSLINAQTLTISGNIGTIAANNKTLGQFNIGSSKTALNSGDVAINELVIGNNGSVQLAHNTYLITKTTNAANQGKIIFNPVVNDNTTLAAGTNLGSEANPLAEINFGSKGVNGDTILNVGQGVNLYATNITTTDANVGSFSFTVGGTNIVSGTVGGQQGNKFNTVELDNGTTAKFLGNAIFNGETTIEANSILQIGGNYTADKVESADGTGIVEFVNTTPITVTLNKQAGPVDDLKQITVSGRGNVVINEIGNAGNDHGAATDTISFENVSLGAALFLPNGIPLDGLTIKSTVGNETATGNFDVPRLIVSGVDSVIADGQAIGDQDNIVGLGLGSDNSITVNATKLYAGIGSVNNNQGTVTLSGGIPNTPGTIYGLGIENGSPKLKQVTFTTDYNNLGSIIATNATINDGVTVTTGGVAGTDFDGKITLGSVNGNANVRFVDGTFSDSTSMIVTTKANNGTVTYLGSALVGNIGSSDTPVASVKFIGSDDGAGLQGNIYSQVTDFGTYDLSVLNSNVILGGGTTAINGEIDLLTNTLTFASGTSTWGSNTSIETTLTVANGNIGHIVIAENAQVNATTTGTTTINVQDNANANFSDTQTYTLIQGGARFNGTLGGPNFAVTGSNRFVNYGLIRAANQDYVITRTNNAANVVTNDIANSPFASAPGVGQNVTTFVNSTNTAAYNNLLLAKNSADSANFVGAITTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFTFSLYGAQQLVENFFAQGSAIFSLNQVKNKSQRYFFDANGKMNKQIAAGNYDNMTFGGNLMVGYDYNAMQGVLVTPMAGLSYLKSSDENYKETGTTVANKQVNSKFSDRTDLIVGVKVAGGTMNITDLAVYPEAHAFVVHKVNGRLSKTQSQLDGQVTPFISQPDRTAKTSYNIGLSASIRPDAKMEYGIGYDFNAASKYTAHQGTLKVRVNF

SEQ ID NO: 21708 - protein, 652 aa, Vibrio parahaemolyticus
MSTLRLPVITATGILAFVSVPHVFANDAVSKMETVVVTASSYEQSQADAPASISVISREELDSRYYRDVTDALKSVPGVVVTGGGDTTDISIRGMGSKYTLILVDGKRQSTRETRPNSDGPGIEQGWLPPLQAIERIEVIRGPMSTLYGSDAIGGVINVITRKDAMEWTGNVQLGTVLQENSRSGGEQSANFFVNGPLAENLSLQVYGQYTAREEDDIEYGYEDKDMQSISSKLTYQISDRHSVQLEGGTSAQSRRGNVGLSVPTTGCRRGCEDSLNEYRRNYVTLSHNGDWDSVGISDTYLQREESENKSREMTITNTTFKSSLVTGIGNHTLTTGVDATHAELEDFTSNKASSKSETSNTQWAVFIEDEWRIADPFSVTLGGRLDHDENYGAHFSPRVYGVWRVDPSWTVKGGVATGFRSPQLREITPGWAQVSGGGNIYGNPDLDPETSLNKEISVLYQGDSGLDVSLTAFHNEFKDKITRVVCPDTICTDGPNQWGADPTYRINVDEAVTQGIEATLASPLTETIYLSSSYTFTDSEQKTGEYKGMPLQQLPKHLFNVDVTWQTTTDLESWAKVTYRGKEMDPVTGPSRNSIVEPAYTFVDAGVTYQLTDNTRIKGAIYNLLDEEISYEEYGYVEDGRRYWLGLDVAF

SEQ ID NO: 21709 - protein, 696 aa, Escherichia coli
MRITTLASVVIPCLGFSASSIATAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 21710 - protein, 1377 aa, Escherichia coli
MNKIYALKYCYITTTVKVVSELARRVCKGSTRRGKRLSVLTSLALSALLPTVAGASTVGGNNPYQTYRDFAENKGQFQAGATNIPIFNNKGELVGHLDKAPMVDFSSVNVSSNPGVATLINPQYIASVKHNKGYQSVSFGDGQNSYHIVDRNEHSSSDLHTPRLDKLVTEVAPSVTSSSTVDILNPSKYSPFYRAGSGSQYIQDSQGKRHWVPGGYGYLTGGILPTSFFYHGSRRHSSCIWGATYMIIASCPLLERPATSGSPLFGWNTPKGQWELVGVYSGVGGGTNLIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGGSGMLTGIDLTFHKLNAADYGATLGNSSDKTANITLDYQTRPANVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINEIFNGGIQANNSTVNISSDSAVLENSTLTSTALNLNKGANVLASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDGRMLYGVGLNARFGDNTRLGLEVERSAFGKYNTDDAINANIRYSF

SEQ ID NO: 21711 - protein, 403 aa, Clostridium bifermentans
MNRKVLALLVPALLVAGAANAAEVYNKNGNKLDLYGKVDGLRYFSDNAGDDGDQSYARIGFKGETQINDMLTGYGQWEYNMQASGTEGNKDTSWTRLGFAGLKFGEYGSFDYGRNYGVIYDVEAWTDVLPEFGGDSYTQTDVYMLQRANGLATYRNTDFFGLVEGWNFALQYQGNNESGNNEFGQEGSGNGTNRGTDKENGDGFGISTSYDFDFGLSLGAAYSSSDRTDAQVGNGYGDGHHYYGNNDAGGETAEAWTVGVKYDAYNVYLAAMYSETRNMTSYGDGDSHSADYRLGGGGIANKTQNFEVVAQYQFDFGLRPSIAYLQSKGKDLGGQDIDSRGNYRYTDKDLVKYVDVGMTYYFNKNMSTYVDYKINLLDEDDDFYTNNGIATDDIVGVGLVYQF

SEQ ID NO: 21712 - protein, 1262 aa, Bradyrhizobium japonicum
MADFSSATITTGSLPPGDHTLYSPQYVVTAKHVSGSDTMSFGYAKNTYTAVGTNNNSGLDIKTRRLSKLVTEVAPAEVSDIGAVSGAYQAGGRFTEFYRLGGGMQYVKDKNGNRTQVYTNGGFLVGGTVSALNSYNNGQMITAQTGDIFNPANGPLANYLNMGDSGSPLFAYDSLQKKWVLIGVLSSGTNYGNNWVVTTQDFLGQQPQNDFDKTIAYTSGEGVLQWKYDAANGTGTLTQGNTTWDMHGKKGNDLNAGKNLLFTGNNGEVVLQNSVNQGAGYLQFAGDYRVSALNGQTWMGGGIITDKGTHVLWQVNGVAGDNLHKTGEGTLTVNGTGVNAGGLKVGDGTVILNQQADADGKVQAFSSVGIASGRPTVVLSDSQQVNPDNISWGYRGGRLELNGNNLTFTRLQAADYGAIITNNSEKKSTVTLDLQTLKASDINVPVNTVSIFGGRGAPGDLYYDSSTKQYFILKASSYSPFFSDLNNSSVWQNVGKDHNKAIDTVKQQKIEASSQPYMYHGQLNGNMDVNIPQLSGKDVLALDGSVNLPEGSITKKSGTLIFQGHPVIHAGTTTSSSQSDWETRQFTLEKLKLDAATFHLSRNGKMQGDINATNGSTVILGSSRVFTDRSDGTGNAVSSVEGSATATTVGDQSDYSGNVTLENKSSLQIMERFTGGIEAYDSTVSVTSQNAVFDRVGSFVNSSLTLGKGAKLTAQSGIFSTGAVDVKENASLTLTGMPSAQKQGYYSPVISTTEGINLEDNASFSVKNMGYLSSDIHAGTTAATINLGDSDADAGKTDSPLFSSLMKGYNAVLRGSITGAQSTVNMINALWYSDGKSEAGALKAKGSRIELGDGKHFATLQVKELSADNTTFLMHTNNSRADQLNVTDKLSGSNNSVLVDFLNKPASEMSVTLITAPKGSDEKTFTAGTQQIGFSNVTPVISTEKTDDATKWVLTGYQTTADAGASKAAKDFMASGYKSFLTEVNNLNKRMGDLRDTQGDAGVWARIMNGTGSADGDYSDNYTHVQIGVDRKHELDGVDLFTGALLTYTDSNASSHAFSGKNKSVGGGLYASALFNSGAYFDLIGKYLHHDNQHTANFASLGTKDYSSHSWYAGAEVGYRYHLTKESWVEPQIELVYGSVSGKAFSWEDRGMALSMKDKDYNPLIGRTGVDVGRAFSGDDWKITARAGLGYQFDLLANGETVLQDASGEKRFEGEKDSRMLMTVGMNAEIKDNMRLGLELEKSAFGKYNVDNAINANFRYVF

SEQ ID NO: 21713 - protein, 713 aa, Plesiomonas shigelloides
MPVFSRRRMRHTLPLLSLLAWACSIACAQADALRARELDAVQVRSQYTPYRELSITGATKTDAPLRDLPISARVLDRTLLDDAGVTDLAGALELASGITKANNLGGLWDSYSMRGFTGDPNFSSDYMVNGFNASRGYNGLRDAANTQSIEVIKGPASALYGRGEPGGVVNIITKKPLFQPQNSVDVSAGRFDSYRAAIDSTGPLSESVAYRLNVMHKDQHSFRDTVDSDNTLLAPSLLWMPTPETTVSYELEAVRIHAPFDRGVTAIDGDANRLPASRFLGEPRDGDIDLHSTGHQLFVVHGLNQTWSLQGGATYRESGMRGFSTEPWTLQADQRTLRRERRYRDYQGRDIAARAELLGSLQAGRVTHNVLLGIDGNRFDDSRFQQRARSAATPYSIDVLAPRYGVAQPGQLAAITDTEERQQVWGAYAQDQIDLGARWKALLGLRYDHYEQDLDNHLRGTTQRASDGVVSPRAGLTFLVDDALSLYASASAGFRPNSGVGANGQSFAPEKSRSLETGLKYVQPGDGLEATVAAFRIDKKNVLSLDPADTSFSLPVGEMRSQGVELDLLGRLTPHLAASVGLAYTDPQVTRSSAAAAGTGLAEGRRFPNVSRFSGNAFLNYEQPLTGKRSAAIGMGVSHTGERLGSVDSNTDFVLPAYTVWRVVGHYDLSDRLRLYAKVENLTDRRYAAFSYSEQWVYPGAPRSWTVGVHLRF

SEQ ID NO: 21714 - protein, 138 aa, Chlorobium tepidum
  misc_feature (63)..(63): Xaa can be any naturally occurring amino acid
NSPLKASFLAGGGAFGYKMDDIRVDVEGLYSQLTKDADVVDTSPAVVESLTAFSGLVNVYYYXTIEDMPITPYVGVGVGAADVSNPLVTDVTGDKKSGFGFAYQAKAGVSYDVTPEIKLYAGARYFGSYGANFAKRAK

SEQ ID NO: 21715 - protein, 375 aa, Enterobacter aerogenes
MKVKVLSLLVPALLVAGAANAAEIYNKDGNKLDLYGKIDGLHYFSSDDSVDGDQTYMRIGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEDQTNNGRGFQKQNGEGFGTSVTYEIWDGISAGFAYSSSKRTDEQNNSTYFSKSYQRTYGVLGEGDHAETYTGGLKYDANNIYLATQYTQTYNATRTGDIGFANKAQNFEVVAQYQFDFGLRPSVAYLQSKGKDMGRYGDQDILKYVDLGATYYFNKNMSTYVDYKINLLDDNKFTKDASISTDNVVALGLVYQF

SEQ ID NO: 21716 - protein, 1541 aa, Haemophilus influenzae biotype aegyptius
MLNKKFKLNFIALTVAYALTPYTEAALVRDDVDYQIFRDFAENKGKFSVGATNVLVKDKNNKDLGTALPNGIPMIDFSVVDVDKRIATLINPQYVVGVKHVSNGVSELHFGNLNGNMNNGNAKAHRDVSSEENRYFSVEKNEYPTKLNGKTVTTEDQTQKRREDYYMPRLDKFVTEVAPIEASTASSDAGTYNDQNKYPAFVRLGSGSQFIYKKGDNYSLILNNHEVGGNNLKLVGDAYTYGIAGTPYKVNHENNGLIGFGNSKEEHSDPKGILSQDPLTNYAVLGDSGSPLFVYDREKGKWLFLGSYDFWAGYNKKSWQEWNIYKSQFTKDVLNKDSAGSLIGSKTDYSWSSNGKTSTITGGEKSLNVDLADGKDKPNHGKSVTFEGSGTLTLNNNIDQGAGGLFFEGDYEVKGTSDNTTWKGAGVSVAEGKTVTWKVHNPQYDRLAKIGKGTLIVEGTGDNKGSLKVGDGTVILKQQTNGSGQHAFASVGIVSGRSTLVLNDDKQVDPNSIYFGFRGGRLDLNGNSLTFDHIRNIDDGARLVNHNMTNASNITITGESLITDPNTITPYNIDAPDEDNPYAFRRIKDGGQLYLNLENYTYYALRKGASTRSELPKNSGESNENWLYMGKTSDEAKRNVMNHINNERMNGFNGYFGEEEGKNNGNLNVTFKGKSEQNRFLLTGGTNLNGDLTVEKGTLFLSGRPTPHARDIAGISSTKKDPHFAENNEVVVEDDWINRNFKATTMNVTGNASLYSGRNVANITSNITASNKAQVHIGYKTGDTVCVRSDYTGYVTCTTDKLSDKALNSFNPTNLRGNVNLTESANFVLGKANLFGTIQSRGNSQVRLTENSHWHLTGNSDVHQLDLANGHIHLNSADNSNNVTKYNTLTVNSLSGNGSFYYLTDLSNKQGDKVVVTKSATGNFTLQVADKTGEPNHNELTLFDASKAQRDHLNVSLVGNTVDLGAWKYKLRNVNGRYDLYNPEVEKRNQTVDTTNITTPNNIQADVPSVPSNNEEIARVDEAPVPPPAPATPSETTETVAENSKQESKTVEKNEQDATETTAQNREVAKEAKSNVKANTQTNEVAQSGSETKETQTTETKETATVEKEEKAKVETEKTQEVPKVTSQVSPKQEQSETVQPQAEPARENDPTVNIKEPQSQTNTTADTEQPAKETSSNVEQPVTESTTVNTGNSVVENPENTTPATTQPTVNSESSNKPKNRHRRSVRSVPHNVEPATTSSNDRSTVALCDLTSTNTNAVLSDARAKAQFVALNVGKAVSQHISQLEMNNEGQYNVWVSNTSMNKNYSSSQYRRFSSKSTQTQLGWDQTISNNVQLGGVFTYVRNSNNFDKATSKNTLAQVNFYSKYYADNHWYLGIDLGYGKFQSKLQTNHNAKFARHTAQFGLTAGKAFNLGNFGITPIVGVRYSYLSNADFALDQARIKVNPISVKTAFAQVDLSYTYHLGEFSVTPILSARYDANQGSGKINVNGYDFAYNVENQQQYNAGLKLKYHNVKLSLIGGLTKAKQAEKQKTAELKLSFSF

SEQ ID NO: 21717 - protein, 1023 aa, Aggregatibacter actinomycetemcomitans
MSKLKLGYLSSHIIFLALSVSTAYAENDTQEKLNEIVVSGSSEGNGNSDDRTPPKIGETVKSAKKLEKQQAQDVKDLVRYDTGVTVVEAGRFGNSGFAVRGVEENRVAIQIDGLAQAETISSQGFKELFEGYGNFNNTRNSAEIETLKQVTIRKGADSLKSGSGALGGSVSFETKDARDYLTDKNYYASYKRGYNTADNQNLNTLTLAGRYKYFDAIAVLTSRKGHELENFGYKNYNERVQGKTREKADPYRRTLDSKLLKFAFQPTDNHRFSVMADLYKQTSKGHDFSYTLKPNTQFRTYDEEELRHTNDKVERKNFAFTYENFTTTPLWDTLKITYSQQKITTRARTDDYCDGNDKCPTSQNKLGMKYNEDNKLVGNDNKLAKYTNTPAQTKTIKEQVPLDPSSTAKYRWQKAQWHVLEQKYPGVKYSKYCEEDETDPSNFCTVELKIPGAPAKKSFEINGKEYDLKSEEVIGDEQTLTTNTSHILSCDAINCNKKTIGGFQRDGTPVDIPFEVFERDGKKYAKTKVMSKDQLSGPVFFMPNKSGYQENLWTQRDLTTKTKQINIDLTKHIEISGTEHDLSYGGLWAESKKEMINISGISARNIKWWAQYPKDCSPSINNPDRYNALCNRKNVYSFLIPVKTKTGALYFIDDFKLNDYFSFGIGYRYDRVKYNPEYIPGVTPKIPDDLVTNLYITDPKFDPSDLISPENQARREANANANIKKIAQPKKFSASSYSLNTTVDPLDWLRLQAKYSKAFRAPTGDEIYFTFKHPDFSVLPNKDLEQETAKTKELSVTLHNDMGYISTSVFETRYNNFIDLVYKGNKQLQGHSKLRPFNVYQNINRPNAKVTGFEIVSQISLNDLAKILNGFNLSYKYTYQKGRMDGDIPMNAIQPRTAVYGIGYVHSDDKFGLDLYITHAGAKQAKDTYNMYHKEEGKKDSSIKWRSNSYTTIDLLGYIKPIKNLTLRAGVYNLTNRKYITWDSARSIRPFGTSNLIDQKSGLGINRFNAPGRNYRLSMQLEF

SEQ ID NO: 21718 - protein, 639 aa, Aggregatibacter actinomycetemcomitans
MSKLKISYAITLLLLSNYVIADDKIEKISVHGIEYQTEGTYNNVALGSDVTIISQEMIVQAGSVDINKILTQFVPGLFANGRAGRHTDTDYSLQGSRPKDILWLIDGNRLNNRLYGSTYTDTINPMMIERIEVIKGGQGAIYGSDAIAGVINIITKQYQGHDQGEVSLSADSLPSYDAGAFVNAEVGDFQYTLSASSSQSEGYQLWPDEEYSPTAALDKERGYQMNNFSGKLRWQPNKSHSVSIFTQLNKGKLERPLAYNAILSENDREQQLSYLDWQYQASEQLLLQTKVHYQEWDSHYSEITKDKQGNTEIAYWNSYWGFTDIGATISANYLTDTGSQLLTGVEFQQYDGADEVMEFVAVKDDNYAAFVQYQPTFNALPDTALSLSARFNRISDSDQHWVGSLGITHLLNQKWQLRGSIANGYRQPTAEESQSQVGTLGNPDLESETSQNINLGVTFQGEANITFDAFWRNIDNLIEATDLGNAVWQYNNVAGDVTSFGADFHLVTDLTEALEFELSAGYANAERQDTGEQISRVPEFTGFSMLNYHTSDELNFWLSGKYVGKFLDYGLTAGDYVIASLGAQYWLTSDLNQQVSFTIDNLFDSEVTQSIFKHGHRAEYPIASMGAPRTLQLQYRYLF

SEQ ID NO: 21719 - protein, 130 aa, Escherichia coli
MRDEARHGERRKGTRPPAAAAPAGAVFPEEKDEIEANAKRAGVSVARYLRDVGQGYQIKGVMDYQHVRELVRVNGDLGRLGGLLKLWLTDDVRTLQFGEATILALLGRIEATQDEMSRIMKAVVQPRAEP

SEQ ID NO: 21720 - protein, 1296 aa, Helicobacter pylori
MEIQQTHRKMNRPLVSLVLAGALISAIPQQSHAAFFTTVIIPAIVGGIATGTAVGTVSGLLGWELKQAEEANKTPDKPDKVWRIQAGKGFNEFPNKQYDLYKSLLSSKIDGGWDWGNAARHYWVKGGQWNKLEVDMKDAVGTYTLSGLRNFTGGDLDVNMQKATLRLGQFNGNSFTSYKDSADRTTRVDFNAKNISIDNFLEINNRVGSGAGRKASSTVLTLQASEKITSRENAEISLYDGATLNLASNSVKLMGNVWMGRLQYVGAYLAPSYSTINTSKVTGEVDFNHLTVGDKNAAQAGIIASNKTHIGTLDLWQSAGLNIIAPPEGGYKNQTNNTPSQSGAKNDKNESAKNDKQESSQNNSNTQVINPPNSTQKTEIQPTQVIDGPFAGGKDTVVNINRINTNADGTIKVGGFKASLTTNAAHLHIGKGGVNLSNQASGRTLLVENLTGNITVDGPLRVNNQVGGYALAGSSANFEFKAGTDTKNGTATFNNDISLGRFVNLKVDAHTANFKGIDTGNGGFNTLDFSGVTDKVNINKLITASTNVAIKNFNINELLVKTNGVSVGEYTYFSEDIGSQSRINTVRLETGTRSIFSGGVKFKGGEKLVINDFYYAPWNYFDARNIKNVEITNKLAFGPQGSPWGTAKLMFNNLTLGQNAVMDYSQFSNLTIQGDFINNQGTINYLVRGGQVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKTCGMAIGNQSMVNNPDNYKYLIGKAWKNIGISKTANGSKISVYYLGNSTPTENSGNTTNLPTNTTSNARSANNALAQNAPFAQPSATPNLVAINQHDFGTIESVFELANRSSDIDTLYTHSGAQGRDLLQTLLIDSHDAGYARKMIDNTSTGEITKQLNTATTTLNNVASLEHKTSGLQTLSLSNAMILNSRLVNLSRRHTNNIDSFAKRLQALKDQRFASLESAAEVLYQFAPKYEKPTNVWANAIGGTSLNNGGNASLYGTSAGVDAYLNGEVEAIVGGFGSYGYSSFSNQANSLNSGANNTNFGVYSRIFANQHEFDFEAQGALGSDQSSLNFKSALLQDLNQSYHYLAYSAATRASYGYDFAFFRNALVLKPSVGVSYNHLGSTNFKSNSNQKVALKNGSSSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 21721 - protein, 1287 aa, Helicobacter pylori
MEIQQTHRKINRPLVSLVLAGALISAIPQESHAAFFTTVIIPAIVGGIATGTAVGTVSGLLSWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDGADRTTRVDFNAKNISIDNFLEINNRVGSGAGRKASSTVLTLQASEGITSSKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPDNTTQNSAKNDKQKSSQDNSNTQVINPPDSGQKTEIQPTQVIDGPFAGAKDTAVTIDSLNTKSDGTIKVGGYKASLTTNAANLNIGKGGVNLSNQASGRSLLVENLTGNITVNGALKVNGQAGGYALSGSSANFEFKAGVDTKQGTITFNNNISLGRFVNLKASAHTVNFKDIDTGNGGFNTLDFSGVTNKVNINKLITASTNVAIKNFNINELLVKTNGISVGEYTHFSEDIGNQSRINTVRLETGTRSIYSGGVKFKGGEKLVINDFYYAPWNYFDARNIKNVEITNKLAFGPQGSPWGTAKLMFNNLTLGHNAVMDYSQFSNVTIQGDFVNNQGTINYLVRGGNIETLSVGNAAAMMFNNSVDSATGFYKPLMNINSAQDLIKNKEHVLLKAKIIGYDNVSLGTNSISNVNLIEQFKERLALYNNNNRMDICVVRDLNDVKACGTAIGNTDMVNNPSNYKYLVGKAWRNIGISKTANGSKISVRYLGNSTPTENSGNTTNLPTNTTKNARFASYALIKNAPFAQASATPNLVAINKHDFGTIESVFELANRSKDIDTLYANSGVQGRDLLQTLLIDSHDAGYARTMIDATSANEITKQLNEANSALNNIASLDHKTSGLQTLSLSNAMILNSRLVNLSRRHTNNIDSFAKRLQALEGQRFASLESAAEVLYQFAPKYEKPTNVWANAIGGASLNNGGNTSLYGTSAGVDAYLNGEVEAIVGGFGSYGYSSFNNQANSLNSGANNANFGVYSRIFANQHEFDFEAQGAVGSDQSSLNFKSALLRDLNQSYNYLAYSAAARASYGYDFAFFRNALVLKPSVGVSYNHLGSTNFESNSTHKAALKNGASSQHLFNASANVEARYYYGDTSYFYMNAGVLQEFASVGSKTAASLNTFKVNVARNPLNTHARVMMGGELQLAKEVFLNLGFIYLHNLISNASHFASNLGMRYSF

SEQ ID NO: 21722 - protein, 1287 aa, Helicobacter pylori
MEIQQTHRKMNRPLVSLVLAGALISAIPQESHAAFFTTVIIPAIVGGIATGAAVGTVSGLLSWGLKQAEEANKTPDKPDKVWRIQAGRGFFNDFPNKEYDLYQSLLSSKIDGGWDWGNAARHYWVKGGQWNKLEVDMHDAVGTYKLSGLINFTGGDLDVNMQKATLRLGQFNGNSFTSYKDSADRTTRVNFDAKNILIDNFVEINNRVGSGAGRKASSTVLTLQASEGITSSKNAEISLYDGATLNLASNSVKLNGNVWMGRLQYVGAYLAPSYSTINTSKVTGEVDFNHLTVGDQNAAQAGIIASNKTIGTLDLWQSAGLNIIAPPEGGYKDKPNSTTPQSGTKNDKQEISQNNNSNTEVINPPNNTQKTKTEPTQVIDGPFAGGKDTVVNIDRINTKADGTIRVGGFKASLTTNAAHLNIGKGGVNLSNQASGRSLIVENLTGNITVDGPLRVNNQVGGYALAGSSANFEFKAGVDTKNGTATFNNDISLGRFVNLKVDAHTANFKGIDTGNGGFNTLDFSGVTDKVNINKLITASTNVAVKNFNINELIVKTNGISVGEYTHFSEDIGSQSRINTVRLETGTRSIFSGGVKFKSGEKLVIDDFYYSPWNYFDARNVKNVEITRKFASSTPENPWGTSKLMFNNLTLGQNAVMDYSQFSNLTIQGDFINNQGTINYLVRGGKVATLNVGNAAAMMFNNDIDSATGFYKPLIKINSAQDLIKNTEHVLLKAKIIGYGNVSTGTNSISNVNLEEQFKERLALYNNNNRMDTCVVRNTDDIKACGMAIGNQSMVNNPDNYKYLIGKAWKNIGISKTANGSKISVYYLGNSTPTENGGNTTNLPTNTTNNARFASYALVKNALFAHSATPNLVAINQHDFGTIESVFELADRSKDIDTLYTHSGAQGRDLLQTLLIDSHDAGYARTMIDATNTGEITQSLNAATDALNNVASLEHKQSGLQTLSLSNAMILNSRLVNLSRKHTNHIDSFAQRLQALKGQRFASLESAAEVLYQFAPKYEKPTNVWANAIGGASLNSGGNASLYGTSAGVDAYLNGNVEAIVGGFGTYGYSSFSNQANSLNSGANNANFGVYSRVFANQHEFDFKAQGALGSDQSSLNFKSALLQDLNQSYNYLAYSAATRASYGYDFAFFRNALVLKPSVGVSYNHLGSTNFKSNSQLVALKNGASSQHLFNANANVEARYYYGDTSYFYMNAGVLQEFARFGSNDVASLNTFKINAARSPLSTYARAMMGGELRLAKEVFLNLGVVYLHNLISNASHFASNLGMRYSF

SEQ ID NO: 21723 - protein, 1289 aa, Helicobacter pylori
MEIQQTHRKMNRPLVSLVLAGALVSAIPQESHAAFFTTVIIPAIVGGIATGAAVGTVSGLLSWGLKQAEEANKTPDKPDKVWRIQAGRGFNEFPNKEYDLYQSLLSSKIDGGWDWGNAARHYWVKGGQWNKLEVDMKDAVGTYKLSGLRNFTGGDLDVNMQKATLRLGQFNGNSFTSYKDSADRTTRVNFNAKNISIENFVEINNRVGSGAGRKASSTVLTLQASEGITSSKNAEISLYDGATLNLASNSVKLNGNVWMGRLQYVGAYLAPSYSTINTSKVQGEVDFNHLTVGDQNAAQAGIIASNKTHIGTLDLWQSAGLNIIAPPEGGYKDKPNSTTSQSGTKNDKQEISQNNNSNTEVINPPNNTQKTETEPTQVIDGPFAGGKDTVVNIDRINTKSDGTIRVGGFKASLTTNAAHLNIGKGGVNLSNQASGRSLLVENLTGNITVDGPLRVNNQVGGYALAGSSANFEFKAGVDTKNGTATFNNDISLGRFVNLKVDAHTANFKGIDTGNGGFNTLDFSGVTDKVNINKLITASTNVAVKNFNINELVVKTNGVSVGEYTHFSEDIGSQSRINTVRLETGTRSIFSGGVKFKAGEKLVIDEFYYSPWNYFDARNIKNVEITRKFASSTPENPWGTSKLMAFNNLTLGQNAVMDYSQFSNLTIQGDFINNQGTINYLVRGGKVATLSVGNAAAMMFNNDIDSATGFYKPLIKINSAQDLIKNTEHVLLKAKIIGYGNVSTGTNSISNVNLEEQFKERLALYNNNNRMDTCVVRNTDDIKACGMAIGNQSMVNNPDNYKYLIGKAWKNIGISKTANGSKISVYYLGNSTPTENGGNTTNLPTNTTNNARSANYALVKNAPFAHSATPNLVAINQHDFGTIESVFELANRSKDIDTLYTHSGAQGRDLLQTLLIDSHDAGYARQMIDNTSTGEITKQLNAATDALNNVASLEHKQSGLQTLSLSNAMILNSRLVNLSRKHTNHINSFAQRLQALKGQRFASLESAAEVLYQFAPKYEKPTNVWANAIGGASLNSGGNASLYGTSAGVDAYLNGEVEAIVGGFGSYGYSSFSNQANSLNSGANNANFGVYSRFFANQHEFDFEAQGALGSDQSSLNFKSALLQDLNQSYNYLAYSATARASYGYDFAFFRNALVLKPSVGVGYNHLGSTNFKSNSQSQVALKNGASSQHLFNANANVEARYYYGDTSYFYLHAGVLQEFAHFGSNDVASLNTFKINAARSPLSTYARAMMGGELQLAKEVFLNLGVVYLHNLISNASHFASNLGMRYSF

SEQ ID NO: 21724 - protein, 1327 aa, Helicobacter pylori
MELQQTHRKINRPIISLALVGALIGTELGANTPNDPIHSESRAFFTTVIIPAIVGGIATGTAVGTVSGLLSWGLKQAEQANKTPDKPDKVWRIQAGRGFNNFPNKQYDLYKSLLSSKIDGGWDWGNAARHYWVKDGQWNKLEVDMQDAVGTYNLSGLINFTGGDLDVNMQKATLRLGQFNGNSFTSFKDSADRTTRVNFDAKNILIDNFLEINNRVGSGAGRKASSTVLTLKSSEKITSRENAEISLYDGATLNLVSSSNHSVDLYGKVWMGRLQYVGAYLAPSYSTINTSKVQGEMNFRHLAVGDQNAAQAGIIANKKTNIGVLDLWQSAGLSIITPPEGGYKDKPNNTNSQSGAKNDKQDSNTQVINPPNSGQKTEIQPTQVVDGPFAGGKDTVVNIFRLNTKSDGTLRAGGFKASLSTNAAHLNIGEGGVNLSNQASGRSLLVENLTGNITVEGALMVNNQVGGSAVAGSSANFEFKAGEDTNNATATFNNDIHLGKAVNLRVDAHTAYFNGNIYLGKSTNLKVNGHSAHFKNIDASKSDNGLNTSALDLSGVTDKVNINKLTTSATNVSIKNFDIKELVVTTRVQSFGQYTIFGENIGDQSRIGVVSLQTGYSPAYSGGVTFKSGKKLVIDELYHAPWNYFDARNITDVEINKKILFGAPGNIAGKTGLMFNNLTLNSNASMDYGKDLDLTIQRDFTNNQGVMNLFVQDGRVAALNIGNTATMKFNNVVDSATGFYQPIIKINNAQNLTKNKEHVLVKAQNIDYNLVGVQGASYDNISASNTNLQDQFKERLALYNNNNRMDICVVRKNNTDDIKACGMAIGNQSMVNNPENYKYLEGKAWKNTGINKTANNTTIAVNLGNNSAPTENGGNTTNLPTNTTNKARFASYALIKNAPFARYSATPNLVAINQHDFGTIESVFELANRSSDIDTLYANSGGTGRDLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGTSLNNGSNASLYGTSAGVDAYLNGEVQAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRDSF

SEQ ID NO: 21725 - protein, 161 aa, Bartonella henselae
IADGITSAEDKEYGVLNNSKYIPTNGNTVGYTFKGIDGLVLGANYLLAQERHKYTTTAAGTRAVTVAGEVYPQKISNGVQVGAKYDANNIIAGIAYGRTNYREDIVDPDLGKKQQVNGALSTLGYRFSDLGLLVSLDSGYAKTKNYKDKHEKSYFVSPGFQ

SEQ ID NO: 21726 - protein, 240 aa, Bartonella henselae
IALISASAAQAADVIVPHEVAPTVISAPAFSWTGFYIGGQVGNFSSKVEITDPNKKDKLFSKDDTPKPSGFMGGIYAGSNMSLGNNMILGVETDAVWADREDAKTSSAKVIREDELANFKDSLKNANAVFAKDKTSDDVKQDEKHTDSLALKEKWSGATRVRIGFTAADRIMPYVAGGVSYAQVQAVSSTKVTQAADDAEIASAQLFDKTKTLVGFTLGGGVDFAMTDNVLLRAEYRYSD

SEQ ID NO: 21727 - protein, 935 aa, Bartonella henselae
LMPNSVPDPTKESLSNKISLTGDTHNLTNCYLNNLRYILAILQKTPNEGAAVTITDYLSFFDTQKEGIYFAKNLTPESGGAIGYASPNSPTVEIRDTIGPVIFENNTCCRPFIWSNPYAAANKIREGGAIHAQNLYINHNHDVVGFMKNFSYVQGGAISTANTFVVSENQSCFLFMDNICIQTNTGGKGGAIYAGTSNSFESNNCDLFFINNACCAGGAIFSPICSLTGNRGNIVFYNNRCFKNVETASSEASDGGAIKVTTRLDVTGNRGRIFFSDNITKNCGGAIYAPVVTLVDNGPTYFINNIANNKGGAIYIDGTSNSKISADRHAIIFNENIVTNVTSNNGISTNPPRRNAITVTSSSGEIILGAGEGQNLIFYDPIEVNAGVSVFFNKEADQTGSVVFSGATVNSADFHQRNLQTKTPATLTLNHGFLCIEDRAQLAVNRFTQTKGVVALGNGAVLSCYKNNSTNASVTLKHIGLNLPSILKSGAEIPLLWVEPTATTSNRTTTYSADTAAGFSLRDVKLSLIDDYGDSPYESTDLTHAVSSQPILAISEASDSQLQSESMDFSGLNVPHYGWQGLWTWGWAKTQDPEPANSSAITDPQKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALR

SEQ ID NO: 21728 - protein, 239 aa, Bartonella henselae
IALISPSAAQAADVIVPHEVAPTVISAPAFSWTGFYIGGQVGNFSSKVEITDPNKKDKLFSKDDTPKPSGFMGGIYAGSNMDLGNNMILGVETDAVWADREDAKTSSAKVIREDELANFKDSLKNANAVFAKDKTMDDVKQDEKHTDSLALKEKWSGATRVRIGFTAADRIMPYVAGGVSYAQVQAVSSTKVTQAADDAEIASAQLFDKTKTLVGFTLGGGVDFAMTDNVLLRAEYRYS

SEQ ID NO: 21729 - protein, 384 aa, Bartonella henselae
TTRDGHEIENYDYKIYPNKQADLSAVGPTREKADPYQITRQSTLIKLGFQPNENHRLSVALDDSTLETKGMDLSYAFRAYSQAKSETYGERIIHDQSKRKNIQFSYENFSQTPFWDHIKLSYSSQKITNKARSDEYCHQSTCAGVLNPQGLHLEEEQGGVYKIVDKDNNGFHYKKDSNPWSYGQELHNSKDEKISDGVNTEGGKLDSVLINCEKLTCEGKRFRIYQEYDEKDNGSYKHEDRDITIRTLPNGKKYGEIPLKKGEARWKDGPLKEEIARFLFPKSHGYSTDFVNDRDLNTNTQQIKLDLDKEFHLWHTQHQLKYGGLYEKTLKSMMNHQYNTAANVQWWADYFFCAREEGGKLGGEKKPQPNISVAGCANGTQLHS

SEQ ID NO: 21730 - protein, 943 aa, Rhizobium loti
MQALNPIIINLPRLLTLKLTMKRSLIILLFGVFSSFTMAAQGTVIKGSVKDAASSEPIPDVTITIEETQQTTLTNGLGEFIFSSDVPLGEQVLKISKSGYVTKRYPIVVNEGQTVNITDMTLDIDVSDDLDLFTITLSDDELNDDTSGADNISGLLSSSLDVFQRTAAFEFSSSFFRVRGLDSENGSVLINGIEMNKLYNGRPQWSNWGGLNDMMRNQVLTTGLTPSDYNFGGILGTSNIVARASSYRKGGRLTYSSSNRSYTNRVMASYASGMVEGGWSYALMLGRRWGDEGYQDATLYDSNSFFASVEKKINDNHSLNFTSIYTPNRRGKSSPNTQEVYDLKGIKYNEYWGNLDGEQRNSRVKEVEEPILMLNHYWDISNKTSLNTNIGYQFGKLGNSRLDNSGGANPSPAYYQNLPSYFLADNDGPDYDGAYQAEQNFLNGGQINWERLLDANTTNNINDLSSAYALYEDRSDDTQLTVNSIITTEINENIIVNGAVNYKNFESENFGEIIDLLGSNVGVLNVDSFDNYQYDAQNPNRTVGEGDKYRYNYNLYADIISAYAQGQFKYNKVDFYVSASVTNTTYQREGLWEHSRFIGDRSFGKGEELTFTGLGAKAGFTYKISGKHLIDVNAGYITRAPSLRNTFSNSRENHNIVKNIDEEKVSSFDASYIFRSPIVKAKITGFYSKIEDANEVGFFFADGLSGGADIENNDTSAFVQEILQGVDKKHLGVELGIEAQVTPTIKLKGAASIGQYTYDNNPDLYLTSSSFNTSDGSIEYGQANLKDYKLAGGPQRAASIGFEYRDPDYWWFGATANFFSNAYLDINTLTRTRNFYLDADGLPFNDYNEELATELLKQEKFDDYMVVNLVGGKSWKIGGYYIGLFASVGNLLDKVYKTGGFEQGRNANYRELRDDNANPKRVFGPKYWYGRGTNYFVNLNVRF

SEQ ID NO: 21731 - protein, 322 aa, Rhizobium loti
MKLYAKVFGGAAALLAAWPAMASDAVASEPAPYNPNFSFVGGVGVIDIEANELVYQAPGSGSKLSHLIWESTSAVISAEMTARSEAGWTAKLSGQIAFSGNSYMEDYDWIPPFSTNDGWNDWSDRSRHSDTDLDYFYSATVALGHDFQVSDQLLINVNGGFKYTSVKWTAYGGSYVYSVAGFRDSVGDFPGDAKAISYQQKLPVAFAGIDATYVQDRWNFGFALKGGTTFSAGATDHHWMRDLRFEDDFEAAPVLMVGGSVGYQYNERTSFFVSGSYEKVFTARGDYNTYDIATGAETGGEDDWIGGDFAAATVMVGIKTSF

SEQ ID NO: 21732 - protein, 230 aa, Rhizobium loti
MARARIGVARAMTAAVVLIVAGQAGAADVGQAASVPQAEACVAEAPSPWQIRLRALGVITEDSGYVNAVPGSGLSYSNTVTPELDISYFFTDNIAAELILGTTYANIDGQGAIGGLGKVGKVWLLPPTLTLQYHFTDFGAFEPYIGAGVNYTIFYHQQAGSADDLKVKNTFGAALQVGFDYMVDEHWGVNFDVKKLFLKPDFDVTVAGAKLTGKAKLDPWLIGAGLTYRF

SEQ ID NO: 21733 - protein, 996 aa, Rhizobium loti
MSSRTSQRTRRHRLSTALFGVLAASAGNAAAQSENGVAPDTTDLDKVTVTGSRIARTGFVTPSPVTAISAEEIRATGATTISDLMARMPALAPSYTLGNSTRFIGTAGLGLLDLRGMGVDRTLVLVNGRRHVGSSPGSTAVDVNTIPVEWVERVEVITGGASAVYGADAVAGVVNFILKKSFTGFETRAQTGLADEGNYNRSFASFSVGTDFAGGRGNIAVSGEYSKQDRFGRGNRAIGREYLVSVPNPGFDPTRPPSESNPQNVLSGPGGNHSTSYGGTFNLGTFDFRNPASYGNRYVFNDDGSFRRNRYDGTVVSNTSCVDCDFVDLNAVADLQPGFDRKSVNTMVNFEISENHRVFFEGKYSETDSEFFGQPAFDSSLRVRRQNPYVSPELGALMDSRGATQILMNRFNVDAGRRGENIERKTYRAVLGAEGNLTDNWTYDVSANYGKTTVDRLNLNNRINERWQAGIDAARDASGNIVCRTTLDPTAVNPNTGRVYSALAREGCVPFSVFGNGAVTPEAAAWFNTTARSQAKIQQTVFSASVANSSLLSLPAGDIGFAGGVEYRKEQSEEVTDPLAASGATFLNAIPNSGGDYSVKEVFVESTIPLLAGLPGVDRLALDVAGRYSDYSSIGSTKTWNVGLDWTIIPSLRLRGTLAQAVRAPSIGELYDSQSENFATINDPCNYLPTNINRPGTAGDVALRQANCSALGIPVGWIDTFTSTRPGVSGGNPELKPERARSLSYGLVWQPEFFEGFGMSIDYWRIDLRDAIGAVTAETNATRCVDNPGGIGNSFCGFVQRAPLGGFTDPQGRIYPEHSIIGWQALNENLARSRRVGVDLEMDYRFQIGGGNTVLRFVGTRLIQSREWVFQDFPAEYDEYVTYVTDPRWRAQFQTKYNWNEWRASWDMNYVDGNLRVTPESYNSNPGSASPIKNGSYVYHNFQFGYQFPGSKIDVYLGIDNAFDKDPPRNYFGSDFTSALYDNVGRFFYLGTTVRF

SEQ ID NO: 21734 - protein, 417 aa, Rhizobium loti
MAPENHDGEKHFAEIVKDFGETSMNDNGLDTGEQAKAFALGKVRDALSQQVNQHVESWLSPWGNASVDVKVDNEGHFTGSRGSWFVPLQDNDRYLTWSQLGLTQQDNGLVSNVGVGQRWARGNWLVGYNTFYDNLLDENLQRAGFGAEAWGEYLRLSANFYQPFAAWHEQTATQEQRMARGYDLTARMRMPFYQHLNTSVSLEQYFGDRVDLFNSGTGYHNPVALSLGLNYTPVPLVTVTAQHKQGESGENQNNLGLNLNYRFGVPLKKQLSAGEVAESQSLRGSRYDNPQRNNLPTLEYRQRKTLTVFLATPPWDLKPGETVPLKLQIRSRYGIRQLIWQGDTQILSLTPGAQANSAEGWTLIMPDWQNGEGASNHWRLSVVVEDNQGQRVSSNEITLTLVEPFDALSNDELRWEP

SEQ ID NO: 21735 - protein, 1053 aa, Rhizobium loti
MFNSTFKRTAVAAAIAFGLSGAAIAQDTSSVVRGNVVTESGEVAANARVEIIHVPTGTRSVATTNESGAFSNSGLRVGGPYIIVIESSEGKKVYEDVYLSLGEPLRINAQLESSDMERLQVTGTAILGGANSGSSSYFGEEDIANTPTFNRDLKEVARLNPYVNLLSGSESPLSIGGANPRYNSIAIDGVGVNDDFGLNGNGYPTQRSPISLDAIEQVSVDVAPFDAAEGGFSGGRINAVTKSGTNEFHGSLTYERMSDAWAGDPENPAGDEVPLDFERDTYSLALGGPIVKDKVFFFVNYEKSKEPAQIEFGPAGAGAANDSDVTQEQYQEVRDIAQGVYGVDIGNWNTLKDTTNENLLVKLDWNINYDHRLAFTFNRTEGNNVRGQSNNPDSLALSTNWYDYQQNMDLYRLSWFSDWSADLSSEIYVSYKSVESISGLETKEFGDISVDMDSEGEISLSFGPDYNRHANSLETDNLKIGARFDYLVGDHEIEFGGEYDKTDVFNIFVRNSLGSWSFSSIEDFANREASSFYYENAYTNNASDAAADFSLGQLNLYVQDNWYLNDSMELGLGLRYERYNTSDKPTLNENFVERYGYSNQENLDGLDIFLPRVDFKWFAADDLVVRAGAGRFSGGRPNVWVSNSFSNDGYTLVQFDRGEVPANEYLNNVDITEVPEAVRNAMYAGDGDTNSIDPNYEIPSDWIARVGVDYQFDIPGLGNNFNATAEVMRKWMTDNSQWKDISRCVSGETAAGVSIYEPCDPDAPIGHYDLQLTNEDKNGKAWIYTASLSKQWDNGFNAYAAYTHQNIDEGNPGTSSTATSNYEYNIVVDRNQPLIGTADYETEHTLKIALGYSHEFFDGYASKFNLFFQRRSGTPFSHTMNLYCNRRNNDCDDDFGDQDTFVTGSYLPYIPAGANDANISPESTISYDDMMAIFESVDLAQYAGGFAPKGARRAPWVNTLDFQFQQELPGLMDGHKGVFYVSINNLLNLIDSSKGKSLRMNYTNNSIIDFNGLDDEGRYIYGAPYGGADTRNWDTFEAEESTWRIKMGVQYKF

SEQ ID NO: 21736 - protein, 377 aa, Rhizobium loti
MTLTPLLLALSLAQTPPAADPAAAAAQPAPAPVKAAPTLAGALANAPKPTFWGFINAQYSRTEGLNGADDTSTFEIRRARIGARGKVHDLVGYSVLFDGADSKLKDAYVSVFALPGVEVRMGQWKTPFGYEQYESDTKLLWVNTSYVVGSLARGPDSRDLGAGLLVQTPKLGPVSAEVLGSFVNGAGPNKKDDLETKNFWGRAGLTLKLPSITLKAGGSYGTGQQIQATGANGTFDGVGTPIDDTYFYFHTYGADATLDTPWFFAAAELIQSERDLSRYTTTAPITAATRSSRTARGWYAGAYGKTPWNLGPIFRAERFDADRTAAGGRLERYTIGAYVDVIPVNARLILNHELDQGQTGAAGRTGDRTTLFAQVIF

SEQ ID NO: 21737 - protein, 377 aa, Rhizobium loti
MKLAKWVVGGLGVLSVPAFAQSSVTLYGVIDTGIEYVTHANAAGDRLVRMPGITGEVPSRWGLRGSEELGGGLKTVFQLESGFNPRGGDLGQGGRLFGRQAWVGLQGPWGKLSFGRQYSMTFWALTDSDILGPDIYGSASLDAYIPNARSDNAIAYMGTFRGLTLGAMYSFGRDSAGTGNSPGQGTCAGSVAGHFTQCRQWSAMIKYDTQSFGVSAAYDEQRGGAGAAANFFNGVTPLALTSEGDKDIRMQVSGYGNIGPVKLGAGWVGRHVETVSPSVPDVRSDLFFVGAAYQVTPAAVLDGEAFRIVNREQSTRATMTTLRGTYFLSKATAAYLQGSYLWNSAHARYSLSSGGGGTTPAAGVGQLGVMAGIRHMF

SEQ ID NO: 21738 - protein, 285 aa, Rhizobium loti
MKCTSAIAIVAISLMAGSGAAFAADIIADPVIEPMPEPVNSSGWYIRGDLGYNFKSSTDGDWSFWNQFDPPYRGIDDTLRYDDFDLKAGATYGVGVGYRFTDMFRADATLDFFRAGINGRTACPSYVKSAKGFNPVEDNCNYEDSSTANIWTAMANAYVDLPRVGPVTPYLGAGLGAAYVQYDDWKTHEVCAGCTYSSEKDGLDSWRFAMALMAGVSYDLTEQLKLDVGYRYMRINGGKAYGFDAADRSTNPYGNAEGPGATGTQAKDNGFNMHTIRAGLRYEFR

SEQ ID NO: 21739 - protein, 870 aa, Rhizobium loti
MRQPFQLKPLVIALSVLGATLPLYVFAEETSHQAGDSESDVITLSDVVVTGATNKTTVVPKRKVTSIYGTDSSVLDTPRVVSQVSEQQFREDVIRSADDLVKYAPSITRGGGQNANFAPQIRGQNSEVFQDSQRIYSTRHPTNLNAYEGADIVAGPTGVIFAPTSGSGGYINYLTKKPNFNKAETNISGTVGSIYSGKGAEPNFSVSIDHTAPISKELAFRVSATAQKTDDYYDNVKNNFNAFYGALAWRPNDRLRVDWNISYDDYYDFNVTHGWNRASQQSVDNGLYYKGRATPIIQNGSTFWSPVFESGAANSKVIGWQTRQKNDKNQYVAVGGVQTTPLPNSTADQAGTIKGWVYDPSIPGNELVKLDDNVSGRSEDKNSAKRFSTQLKVIKDLNEHWSIANSTLYQNNKDLGDSVGSFFTDLDHELIDNRLEFLADYDFEIGSVKINNKSSTGGTYRHEKFTSLAANNSFNINPYDLTNDPSQKNPGDLLGLMNNSGSTGGWIGQAGVPQYSQYFGYLNLPRMYPIGNGLYAEKGGFPPNGGGAVYTGSGFWDTLSVFTQQNFTFNDVFGINLGINHSSVRAKLENPLVLTPTDVRSSSDKYSLLSYQLSTFIKPTAKSTLYFTYDKSTALNTGVFGPFLIWGAVNQLNPLAFDSQSELKEVGFKYEPITDKLFLTLSGFEQKRDLSPDTNGNMARFEIKGIESSLRWQLQKNIAIGSNFTYLDAQYSSIIPAGFSPFGFHADNATVWGDSNALNQRKAGRYDAAGIPKYSASAYVDYQHQSGFGVNLSGWWTSYWYTNLSQTVKIPNNYNLDLGLYYRQPQWTVGLNILNLTNQRNFVNGLAGANSEFLQPMRPLTVQGQFSYKF

SEQ ID NO: 21740 - protein, 679 aa, Rhizobium loti
MRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYADNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 21741 - protein, 813 aa, Rhizobium loti
MPASMASRSLPNPVFSPVARAARLALLGWTLAASAVQAAEPPVAGQVQTYRIEAGPLGRVLSEVAATAGMALSFDPALTQGRQSPVLAGSYTPREALQRLLAGSGLELVSRPGGSYTLQRQAVSPISGEEGSTLSEVRVTAQAERSGTTEGTGSYTQTGPSRTATGLSLTLRETPQSVSVMTRQRMDDFKLETLADVLEQTPGIGVYRQNNATDFQARGSEVNLQVDGMSQLSNGWYFVTSTMYALDDMAEMDRVEVLKGSSGLVVGKGGYGATVNLIRKRPTREFQASVRANAGSWDTYRAQADIGGSLNEAGTLRGRVVASMTDAGSFRNNEKSNSKMLFGTLEADLTPDTLLNLGITLRQREARGFGTTRPIQRYTAAGAEVGLMPRSFNNGAPWSGYEQDSTELFGSVEQRLAHDWTASLKFFHQSVKMDDMTLGYLWNSTSAAYLPWKDVENRNWSVNLDVKGPFSLLGRTHELLAGMGMSRYHSGLLYGSSKSVPLANLGLSYAQGGGALAQPDFGNWNYDRHVFNQRQRYAYAAGRFRLADPLQLIAGMRVTQYRQHDVTPTWWNYDMRETVTTPYAGLVYEVHPQVSLYGSYATIFKPQSAQDAQGRTLDPEQGKTFEVGAKGEFLDKRLNASIAHFWMKTDNSAEETGAFTPGGDMAYRAVNGAMRRGWELELSGELARGWQVQGSLVQQNSSLTSSSQYPKYQLKLGSTYRFEGGALHGLTLGAATRWQSKTSTSDSHNTLAQQSYAVLDLMARYQVDKHLSLSLNVNNLLDKKYFAGVSSLGGLYYTWGAPRSVNVGMRYDF

SEQ ID NO: 21742 - protein, 418 aa, Rhizobium loti
MHSNQTTSRTRTRSCTTSSTRRARRTNGIAGALVAACTASIAPTAAQAQSSVALYGLIDTSITYANNQRTHGAGSPGSGNVAMTSGALNAARWGLRGREDLGGGLAAVFTLENGFSGTTGALSQKGVDLFGRQAWIGVRSNTAGTLTFGRQYDLILDFVTPLGASGPGWGGNLAVHPYDNDDSNRNIRINHAVKYTSPSYRGLTFGAMYGFSNTAGAFSNNAAWSAGLSYANGPLKLGAGYLKISRDRHAPNPDGALSTVDGSATITGGNQQIWALAARYAFGPHSVGAAWSHSATDGVTGVLQGSGIAPLKGESLVFDNFSVDARYFATAAFSVSAAYTYTMGRFDTRAGQTRPKWNQVVAQADYAFSKRTDVYLEGVYQRVSGGNGNPAFNATVWTLTPSANGNQVVVALGLRHKF

SEQ ID NO: 21743 - protein, 629 aa, Rhizobium loti
MTLTLFTPARRCGVFAALSFALPVSAQAQEEAPAILVEANLADPASDAATSAKLLDEDRPGVRGVVSVTEDLSLLPGVVAFDKGGPGAGSYVSIRGGEPNFALVTINGVRVDDPLNSSGGGLDFSLIDPEIVQRIAVVSGPQSTAYGADALSGVIALDVGPLGSGASAHAGIGSEGRYRFGGSLGVEGDAGSFGIAGGFLDSDDFVPGTTSERYSIAATASPDLGATVSFDLFAVIAGSESEGFPEDSGGPQLAVIGELETRERQQIAVGGTLAAALAPDLTAQLRLGYSQSDLETDAPGIAPGALDGVPPIVSDSQLERYEAVASLTHRPADWLSLEVGTSFTREDGESTGSLDFGVLIPTAFTIERDMPGVFTTVTIAPGSGVELSGGLRVDWPEDASARWTPRIGASVPVAETGTRLFANYARGFKRPSLFALGFPLIANPDLEDERSETFDAGVELTPNGEGWSLTAAYFNATYRNLVDFEPELFTNVNRSRVEIDGFEAAGTLQMGEVSARAALTYQTTSSADGAQLRFRPDWTGRLAIRWQALSTLAITLNGEFSSSFNDASVPTGLLRNPGFETLALDAEWQANKNVAIFGALRNLTDSDFERTVGFPEPGRNVFVGVRTRF

SEQ ID NO: 21744 - protein, 685 aa, Rhizobium loti
MKGLLARHRMAMLVCATVVVSISAAAAAQEAGGQTAEAAATGQPGTTQLDRITVVSRTGETPIETMASVSHVGEERLERRMATTPSDLLYGVPGINIYADGQPSVTNINIRGLQNAGRVAVIVDGARQNFHKNGHDVSRMFWIDPELVKQVDVIRGPSANTFGSGAIGGVVYFETKTAEDFLREGETHALSTTARYESNGSGWTTSATGAYRLTDDFSVLGSVVWRDYGDYDDGAGNTVENSGFEILSGHAKATLKPTELSEFTLGWTGSRDEWSTSDEVDNELKGNTFTGEFKISGEEEKWLNLNVKGAINSMDLTETEVGGQTEYELQTSSFDIWNTSYFDTGVIRHELTVGGDWVYDDFTSSTGTGADFFNPAGERTVWGTYIQDKLTYDWLEVVGGLRYDAYTLEASQESSDDRISPRLSVGVSPFREGLLSGLQIYGSYAEGYRAPSTSEAFISGMHPFPPFPFLPNPDLKPETGKTWEAGVNYTAEGLFRPDDALRLKAAYFHNDVDNFITTETIFMGPGSACAFSPMGFCVQYQNILKAEIDGFELEGYYDAGRFFGGLSVSIIDGQEIQQDGTRTDLATIPPTTVTADLGMRFLQERLTVGGEVQFNEAPKGSSFAEDYTLVNIYANYQATENLRLDFRVDNLFDEKYVVPLVDTAGGFDYQPGVTLKVGATLRLGG

SEQ ID NO: 21745 - protein, 791 aa, Rhizobium loti
MFLRSYPKLRYALCLPLLTETCYSEERTLNKVTTQAKRIFTYNNEFKVTSKELDQRQSNEVKDLFRTNPDVNVGGGSVMGQKIYVRGIEDRLLRVTVDGAAQNGNIYHHQGNTVIDPGMLKSVEVTKGAANASAGPGAIAGVIKMETKGAADFIPRGKNYAASGAVSFYTNFGDRETFRSAYQSAHFDIIAYYTHQNIFYYRSGATVMKNLFKPTQADKEPGTPSEQNNALIKMNGYLSDRDTLTFSWNMTRDNATRLLRSNAIGLAYPCEAPFSPDGAQGCPNVLDSFTRYLYHSINSANNLSLQYKREAGNSFGDPRLDFTLYTSIRNAQFDPLFDPNGVYAKFPTSLASAWERENYPCVEGGYCTPSFSDVDKPSSQPRNLFLNNTGLNLKVAHVIDEATDSLFEYGFNYQNLSVFDARIPKSELYRPNQVYTDDKGQKQIACSLVDNNPNDPTLCQRGKANGNIYGGYVQANYSPHKIITFGAGVRWDAYTLYDKDWNHRYTQGFSPSAALVISPIEPLSLKITYSQVTRGVMPGDGVYMRQNDLRYAKNIKPEVGSNAEFNIDYSSQYFSGRAAAFYQALDNFISQYAQRLIVTNLSQAIRIYGYEVGGTFRYKGVSLNVGISRTWPTTRGYLMADSYELAASTGNVFIIKLDYTIPKTGINLAWLSRFVTGLDYCGFDIYLPDYGTAEKPKTPTDLAKCGSQLGLVHMHKPGYGVSNFYINWSPKTKSHWKGLLLSAVFNNVFNKFYVDQTSPYVMSPDMPGTDAIKRAIAEPGFNARFEVAYKW

SEQ ID NO: 21746 - protein, 505 aa, Rhizobium loti
MYRKSTLAMLIALLTSAASAHAQTDISTIEARLNALEKRLQEAENRAQTAENRAGAAEKKVQQLTAQQQKNQNSTQEVAQRTARLEKKADDKSGFEFHGYARSGVIMNDSGASTKSGAYITPAGETGGAIGRLGNQADTYVEMNLEHKQTLDNGATTRFKVMVADGQTSYNDWTASTSDLNVRQAFVELGNLPTFAGPFKGSTLWAGKRFDRDNFDIHWIDSDVVFLAGTGGGIYDVKWNDGLRSNFSLYGRNFGDIDDSSNSVQNYILTMNHFAGPLQMMVSGLRAKDNDERKDSNGNLAKGDAANTGVHALLGLHNDSFYGLRDGSSKTALLYGHGLGAEVKGIGSDGALRPGADTWRIASYGTTPLSENWSVAPAMLAQRSKDRYADGDSYQWATFNLRLIQAINQNFALAYEGSYQYMDLKPEGYNDRQAVNGSFYKLTFAPTFKVGSIGDFFSRPEIRFYTSWMDWSKKLNNYASDDALGSDGFNSGGEWSFGVQMETWF

SEQ ID NO: 21747 - protein, 238 aa, Escherichia vulneris
LTAKLGYPITDDLDIYTRLGGMVWRADAKNNEGFKDHDTGVSPVFAGGVEYAITPEIATRLEYQWTNNIGDANTVGGRPDNGLLSVGVSYRFGQQEEAAPVVVAPAPAPEVQTKHFTLKSDVLFNFNKATLKPEGQQALDQMYSQLSNLDPKDGSVVVLGFTDRIGSDAYNQGLSEKRAQSVVDYLISKGIPSDKISARGMGESNPVTGNTCDNVKARAALIDCLAPDRRVEIEVKGI

SEQ ID NO: 21748 - protein, 243 aa, Escherichia vulneris; identical to SEQ ID NO: 13522

SEQ ID NO: 21749 - protein, 355 aa, Neisseria meningitidis
EGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAAS

SEQ ID NO: 21750 - protein, 357 aa, Neisseria meningitidis
EGRNYQLQLTEAQAANGGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAAS

SEQ ID NO: 21751 - protein, 349 aa, Neisseria meningitidis
EGRNIQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAAS

SEQ ID NO: 21752 - protein, 324 aa, Neisseria meningitidis
EGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAAS

SEQ ID NO: 21753 - protein, 1735 aa, Neisseria meningitidis
EFTKSHSKNMFTFFCTCCDSSFSTSARAASFKDLVSKTPAWEKHNSTQQQKIWKNLTLNEKIKKWQEAALVPSFTQAQNDLGIKYKETDLSSFLDNTRHKARQARAEILLYIARVKQQDFDTKKQEYINQGVVPTDIEAETNLGISYDPSKIDNNVEHDQKVRRAEKDKKAVIELYVSSINRDIKYKHYVDNDIIPEMQEVRTALNMNKDDAQSFVASIRTEIMENAKGQYIAGSHIPTEKELEQKFGTDKGEATNYIASIATQMMLGKKSYYIDNNIIPNANELMNEFKIGPVKATSYINQIRAGIEANQFLNNNDTTKPSTGRSQKKSGSKNDHWYMSNQSINNTGTSSRIFTGREKKQRYFFGPISTFKTHFNTKASKGNLTQSQHNINRIIQQEENIEEFKNLIKTDPIAALTLQVDSSYKQKAVTTILSDFNDDTIQRVLFSNDKGPLDFNTNIDVKNRPILQELLENSSSEEKTKFAERIQDYATRNISNSQFKEKARLDLIKLAASKDKSSVENFLTLQLELKNRMQPYIVNSVYILTPEIVKEINIEPKKKGLIRDSLTKDYMIKLAKEVNNHTLNSVIKVILSDSNILSNETNKILGLAVGNNANNLEQTQSGIPNPPPLPLNGGIPNPPPLPLNGSIPPPLHSQGFSSNSKHFDLNQLQAEYPHIHSLYIQFTHNTTVQSKAPLQPTASSATSTGRSTPETAYAKLYAEYRTETGGTKANDLQDQLIKRQADLTNVIRQILTESYANQGADAKTLVNLFSISTPEIAEKAKEAFNTLAQDQYIKDITVNGKKTITSEEIIKNLFNEDTDDAVKRILLSSCKISEELKRPIKLEFNKSELIRELQGKQNPFEQLEFAYINAKNFDQDIFGNRVDELINNPNILTLVQQATFLITEDTNLRKTINSDQAQAKLDDLRTAILSTIKFEELITANLPQHDFIAIVKEKDPELLKEFLKATTLKLTGNNNLDQLRLALPSFTDMSNEQIRILSNKLKMPIILKALKECSQEKAKKHIHTGNMPPPPPPLPDSQDLELAYLTSLGITKFNANTSTFKTTPKTYHFSSDIALRYKEFTLSGQKSAGYKAKYSDADLLKKAIVESVAFEHSKNLSKAHQNNKYFEQSRAVDTMHSSYSLELNRTKIHNIILLNFWITKDKEFIKYVKDNIILSKKLTEAFTSADSDFIGPRTELGQKIHNIYIQQLTKYPEEAVKEAFNTANPDFIGPRTEIGQEVHNIYTSKLLELAKDKELFLFAQQVLVESTELERKYGSDIQSENSNNEKKVGRLDQKKLQLFKQENEATNDESSTKDDTQPEDSNKKSEQSDSKTALSPRLLSSNDSKNDKSSDDKKSLLALRSSDEDDKGYATDEEELEESNSTTDEELKKDIVLESEDEAIDVSFKTEAITEQDEVTQRQQVSDDTSGKVAILVQATSTLHKPVHYNINDRLTVAAIGAGDEETIINRGVWISGLYGINKQRIWKNIPKYQNRTTGITIGTDAEFINSHDVIGIAYSRLESQINYNKKLGKTAVNGHLLSIYSLKELIKGFSLQTITSYGHNYIKNRSKNINNIIGKYQNNNLSFQTLLNYKYRTKYDLHFIPNISFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGLY

SEQ ID NO: 21754 - protein, 354 aa, Neisseria meningitidis
EGRNYQLQLTEAQAANGGAGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAAS

SEQ ID NO: 21755 - protein, 243 aa, Enterobacter aerogenes
LTAKLGYPITDELDIYTRLGGMVWRADSKYNIPGGASFKDHDTGVSPVFAGGLEWAVTRDIATRLEYQWTNNIGDANTVGTRPDNGLLSVGVSYRFGQQEAAAPVVAPAPAPAPEVQTKHFTLKSDVLFNFNKATLKPEGQQALDQMYTQLSNLDPKDGSVVVLGFTDRIGSDAYNQGLSEKRAQSVVDYLISKGIPSDKISARGMGESNPVTGNTCDNVKPRAALIDCLAPDRRVEIEVKGI

SEQ ID NO: 21756 - protein, 1809 aa, Caulobacter crescentus
MNAQSFNSKKYALAFFMSTYLLAISFLSTSARAASFTQLANKTPALSHLSEAQRKNQWNQYSLVTKQAAWKAAKLVPDLNQAILDVQNGFDPKLLSDSNTNIRHKAREKNADITLYIAQIAQPDYDKKFNEYINRGVIPTPEEVGENLGIVYDPRKTNSTIETDQKVRRAEKDKKAIIDRYIDLVKIALVEKDYTTTGMVPELEELTKKLNIDKAKAKLRRTAIRDQVMKNKKAEIITIGKIPTQETLHKLFGKDRESNDTKYINDIRMHVMHNKKQHYVDTNHIPNTHEIMKEFNIDKGHAKLYLKQIKAETEVKHQADNKQNTTKPFTKHSRTTTDTEEKFSQFPFDTLKKEKQPYSFDPRSTLERLLKGKGNNNFTQSQQNIYKIIQQEANIEEFKHLIKTEPIAALNLEVDSSYKKEAVNAILSDFNNDTIQKILFSDDKGKLNFNTNIDVEHKPILKELFKNSSEEQRKKIIENISKYAKENIIPLVFKGEVRHDKLSDLLKLAAITDKSIVKKVLMLQLELKNNVHSYTAQGNGISPEGIKVINAILRKYHVTEKDLSSSEMIKLANSFHSQGFEDSIKIMSFSEQELNTQIYNLFGLSIQNKTHGNGNMPPLLPPPPPPLPPLFGNPYLDKLKSTPKLYDLYNQFIQNNKSKNKKTTENITKSNTPKRSEPKTEYAKLYKQYRAETGGKKADDLQDQLIKKQSDITNVIRQILTASYAEQGINTEDLITLFGNPNPEVTEKAKEVFVILVQDPYIQDITVNGKKTITSEAILQNLFNEDADDAVERILLSSCKISEALKKPIEHELNKSKLMRELESKQNPFEQLKFAYEKAAILGQTFDTKLAELIKNPAILTTQEQINFLTQENNKLKKVIHSDQAQAKLDNLRTAILSTIKFEELTTANLSQNDFIAIVKEKDPELLKEFLKATIIKHESNNNLDQLRLALPSFTGMSDQQVRILSSKLNMYVILKALQKYEQEESKNHTHTSNMPPPPPPPPGSKILQITYLKNLGITEDWINRITKLNENINTHTSKTVPQVYDFNSDIALRYNGFALSGQKSAGHKAKYSDADLLQKAIIESIVLEHSKNVSEVNQNTQYFEKMQEAVSTMKSSFIGPRTEIGQEIHNIYTSKLLELTKDKEFIRYVEDNVKPSKKRTDALIAAFTSVNSDFIGPITEDIHNIFTQQMTKYTEEEVREAFNTANSDFIGPRTEIGQEVHNIYNSKLLELTKDKELLLFVEELLTESTNLEQKYGSNVQPENKGKKESLVDKMKKRLQQENKVKNDKSSIESNTKYEDNDDNNKKLELSDSKTTVSQMLSNSNDSKNDKSLTESDTKYEDNDDNNKKLELSDSKTTVSQMLSDSNDSKNDKSLTESDTKYEDNDDNNKKLELSDSKTTVSQMLSDSNDSKNDKSSDDKKSLLALRSSDEEDEGYETDEKELEESNNTTEEEFKKDIPLESEDKTINMSLETEEIARQDEAVLKEQISKETNNKVAILVKATSTLNKYIHPSILANRLNIGIIAAGDEEASINRGLWISGLYGINKQSAWKNIPKYQGRTTGITIGTDAEFINSHDVIGIAYSRLNSQVKYNKKLGKTAINGHLLSIYGQKELIKGFTLQAITTYSHNYIKNKSISTNNIIGKYQNNNVSFESLLNYKYRTKYDLYLIPNISLKYDYSRASNYKEYNVDIENLMIQKKSNQSFESSLGGKIVFKPIATISNIVLTPSLYGNIEYHFNNKNTKVNAKATFKGQALQEIIILPKQPKLGYNIGSNILMSRKNINVLLEYNYYTHKKYQSHQGLVKLKVNL

SEQ ID NO: 21757 - protein, 690 aa, Caulobacter crescentus
MFSFLSVARRHRAGLLSSTVLVSIATFGAAPATAQQSASPDLLPPVEVDPPRKPAAPKSALPRGAQTPRARASQPAATQSAAAKANAQLVVSPTGIATPAAHVANAITVVTAKDIATQQARSVPDILAAIPGLNVVQTGGAGGQSSVFTRGTNANHTKILIDGIDVGDATNANGAFDFAHLLTSDIQQFEVLRGPQSGLYGSDAIGGVISVITRKGDGPARATASIETGTYQTFNQSAGVSGSQDNVNYAINVAHLHAGDIPVTPQQLLPAGQKAIGNAYDNVTASTKFGVDLNEAWSLNSVLRYTDATLLFTGDGGFPSVPNAAQSSHAVQQFATREEAVWSLLDGRIKNYFVINYVNNRTSDLTAGNPLAAISTGERIKYDWHAVTELAPHNNFIVGLEQQTDRLQTTGLTAENGNRAGFVEVQTNFAQRMFLVASLRNDINDQFGSHGTYRIAPAVILPVTETKLKASYGTGFKAPTLSQLYQDFPAFNFFANPNLKPEQSTGYDAGFEQPLFDDRIRFGATYFHNSISNLINSNATFTSYANVGLATTEGTESFVTAQLTDRLSLRADYTFTRAVDATTGQQLLRRPKEKWSATAIWTPLDPLTVSATLLRVSNWRDVSRDGMTSGLVAPGYTVVNLRADYAVSDKVKLFGRIDNLFNRHYQNPTGFLAPGLGMFGGIRVASFGME

SEQ ID NO: 21758 - protein, 693 aa, Caulobacter crescentus
MITTTRRFCALSLALAASAGYATDDNLFEDSLWALSPEELGQIRVTSIASGTITPLDKAAAVTTVITAEDIAAMGATDIDEVLETVPGLHVGRSFQAYFPLYTFRGISGSDYNPQALLLINGSPLTTLAFGNRYTIWGGMPVKSISRIEVIRGPGSALYGADAFAGVINVITKTASEMEGTLTGTRVGSFDTYSAWMLHGDRIGDLELGVTFEYMDTRGQKEEVKEDFMALLAPDDSLAPGEVNLGRRQAELHMDMAYKEVTVRVGYQGRYGVETGAGVAQALDPEGEYASDRLTLEFLHTNQDWFENWEISTQLTYFFGRQKPTETSVIFPSTFGGAFPDRVLAEPGYKEEHARIQLSSIFRGWKDHRIRMGIGYFWGDLYETTEKKNFLFGSRGIEPNPGGFEDFSDSNNVWLPEKDRTSYFIFLQDEWQFTQNWQLTSGVRYDHYSDFGDTVNPRIALVWASTDTLTTKLLYGRAFRAPSFVELYAISNPVTLGNPDLDPETIDSYEFAVSYQPTAKLQYSGNLFYYKIEDFINFEGGKLANSNSRKGRGWEFEVSYAVSDELKMTANYAYQRATDEETGKDVGDAPNYQAYGRIDYKIVPNTSVSTQINWIGEQKRADGDGRDPVSDYATVDFTVRRKTLEDRLEMALSIRNVFDREAYAPSTSRPMVAIPGDLPLEGRSLYGEVSYRF

SEQ ID NO: 21759 - protein, 731 aa, Caulobacter crescentus
MGIVKKQRGGPLVRAKVVMSALMMLSPIAQALTTVDGDLTIDANTPLDNYQLNPGARLDANGASTQHIDIFGGAHLEMSGSTVDAQLDDGIALRGGSSANVTANSRVVSARYGLRLQHDNSLGGSTATVSDSYVEGARGGALISDESTLVLHNSTLVGTGTAAAADMFDNATLSAEGSRLQGARNGLRILSAQAQPGTATVSLVGSHVEGQDGSAIVVGNPALGPAEADILVAGGSTLQGSNGTLLEVMGSSTARMTVDNSQLVGDVRVEEGSSASLTLDNHASLTGRLENVAGLTLSNQARWNMVEDSKVGSLALEGGSVRFGEPGQYQRLSVGTLAGSGNFIMDADFSTGDSDYLEITGTATGSHTLLVGSSGADPVAENQLHLVHAAAGDAQFSLLNGPVDVGTFSYELVQRGNDWFLDGASKVISPGTASVLALFNTAPTVWYGELTTLRSRMGELRLDQGKAGGWVRAYGNKYNVSDAAGSAYQQVQQGFSLGADMPLPLGDGQWLLGVMAGHSNSDLNLTRGASADVKSYYLGLYATWLDAQSGYYLDGVVKLNRFDNSSDITMSDGKRSKGDYDNFGVGASLEFGRHLELGNDYFIEPYTQWSMVTIQGKHYDLDNGMQARGDVTRSLLGKAGATVGRTFDLGAGRKVQPYLRAAYAHEFVDDNQVNVNDNRFDNDLSGSRGELGLGVAVSMTDRLQLHADFDYANGEKIEQPWGANVGLHYSW

SEQ ID NO: 21760 - protein, 786 aa, Caulobacter crescentus
MIDGKTKQPLEFATVVLKNTETEALSGGLTDLRGNFKIATPNATYEISIKYISFKSIVFPAESVNSSKDFGTISLYEDSNSLNEIVIVAEKTTVNIRLDKKIFNIGKDLSIRGGNASDVLGNVPSVQVDVEGTVSLRGNENVTILIDGRPSALVGMNGAEALRQIPAEAIEKVEVITSPSARYDAEGTAGILNIILRKNKLVGFNGSLQLDLGNPLKTGTAFNANWRTEKLNLFTNTGFRYNTNPGNAYSDSKYLSTNAQNARVLEERRFGRQGRSLFTSFGATYFLTANTSIVGNIVLNGGKDNDLNTNKIQRFDALGNTNERTKRTEAKSEDEQRVQYTLDYLNNFDGTGRKLSINTQYSAEIERALNTITEIDTPSKILNDLEQVKNDQDETQALLQIDYVHPVGESIQYEAGFRGNYRDIFNSFYLAERKDFENEGPLIPDTGLNNSFNYNEFVNAAYFQYGQKFNKISLLAGIRYEFTSIEIAQQTATTEDKRKYGNFFPTANLGYEFKDGENITLGYNRRIRRPRGRSLNPFPSRSSESNLYSGNVSLNPVITDALDIGYLKRWNKFTLSTSLYYNISNNNWEWIQENTGMLTDNGDPITKKFPINLSTEERFGFEFTLNYKPFRSWNINSDFNIFNITSTGDYTSNATNVNQNFDFNNTAFFIRLNQKITLPGKTDLQINMNYRGPSQNAQTKSRSVFRMSIAASKDLFNERASLSLNMSDLFNSSISRRSTLLPGFLDQSFEFQWREPQINLSLVYRFNQKKKTNISSASANGDGEGL

SEQ ID NO: 21761 - protein, 194 aa, Caulobacter crescentus
MIPSLSHAASPGEGINQGDIIARVRGISIMPDERTSNTLSALNVGVNNAIVPELDFTYMIRDYLGVELILGTSRHQITSSLGDLGGVGVLPPTLLLQYHFNHAGKVRPYVGAGINYTLFYNNGLHAGGEGIGINNHSFGPALQFGVDVQVTKKVFVNVDVKKIWMHTDATLGGQPLGRLNIDPLVVGVGVGMKF

SEQ ID NO: 21762 - protein, 141 aa, Caulobacter crescentus
MSQTFYRCNKGEIMSKTIATENAPAAIGPYVQGVDLGNMIITSGQIPVNPKTGEVPADVAAQARQSLDNVKAIVEAAGLKVGDIVKTTVFVKDLNDFATVNATYEAFFTEHNATFPARSCVEVARLPKDVKIEIEAIAVRR

SEQ ID NO: 21763 - protein, 499 aa, Caulobacter crescentus
MKYLKLMLAAVAVMGAGTSSGAFAIDLYVDTKTKHIFAEPGPDREPLGTYERVQGTPSTNALPAPEVERAGQPASGDRNARIKEKAERAQLVGKVESLEERFKESEKQLKLDKNGLQFETADKNFKFKIGGRIHTDYTHSSNDHFFRGGVPVQANDGAELRRGRLEFAGTFFKDWDFKSQVDFADNQVGVKDMFISYRGLDFAKINVGHQKQAFSRELQESSNDLMFMERSLMNVLNAPLVDRAIGVNLSSRGKNWTGQVGLFGESIDANNDSLDESWGTNSRITFAPLDEKTRIVHLGVAGNYRRPSGSGQLFGPSNGVRFRHETSHITNLFPIDSGALGNVEDVKMLGLEASGVYGPLSAGGEYTHSWIGRRNGLDSLSFHGWYGEAAWTLTGESRQYKEGKFHRVEPTRNFSFSKGGWGAWELAARIAGVDLNDGAFRAGEMKNFTAALNWYVNSNLRFMFNYDRILEIKDSPLVTASGGKPDDLNTFMFRSQIAF

SEQ ID NO: 21764 - protein, 840 aa, Caulobacter crescentus
MKYLLATAAIAPLLMFSFANAEALSADAAAEAKPAAEKAVQSAGGKNHGEAVFSTGVAKGRDRLDSATSTSALRASEFETYGARSLGEVLRNIPGIRAEYAIGEGNANYSIRGLPLSGTGSKYVQLQEDGLPVLEFGDMYQLGTDMFMRSDLNLSQIETIRGGSASTFASNSPGGVINLISKTGDTEGGAVQGTYGLNYGEKRLDADYGGKISDTLRFHVGGFYRQGEGPRDVGYTAYKGGQIKANLTKTFSNGYVRVYGKYLNDRTPAYTFIPVRVTGTNADPTFTSPANFDIKTDSLLSPYVSNVIRLDQNNNLAQDDLRDGQHAVVKSVGLDAQFEVNGWTITEKFRFSDVGGGNLTIRPIAVAPAPLLAVGNGGVGATLSFATGPQAGQAITSPATLNGNGLLTTSLQLDTKIKSLNNVTNDIRASRVWDINGGSLTTTAGLYSASQDYATDLKFLTVLASVAGDGQSTLINTRTAAGVPFTQDGYSSYGLGNAFRRSYDMNYGVNAPYASVNYHIGKIAVGGSLRYDFGKVRGTLYGAELGGGRVGMASFDMNRDGVISTAETKVSVLPLGQPGHVDYDYNYLSYSTGVNYRVAEQLAVFARYSRGGRASADKILFTPAVNYNTGKLVDDESAYDTVKQAELGLKYRISGVTFNVTGFSAKTGERNTQIVSGADGSAQVLNIVRGYEAKGVELEAAVRRGPFSVTAGATYTDAKITSDAQRPVLVGNKPRHQADFIYSVTPQVELKNATVGFNVIGTTSSYAQDTNQLKLPGYKLVNAFVQVRPMENVQLMLNVNNVFNQLALSDSEQAAIPATGVVLGRTYLGRTASATLRYSF

SEQ ID NO: 21765 - protein, 917 aa, Caulobacter crescentus
MSSGKQLTALLLLSTALTFPVAATAQSTGAEGPPPTEEEVPDEELTQDVEDANDTVPGDIAEEEQAEPDISVPGGTIVVTGRRNRDVTRASPQVVTVLDTATIARTGEGDIAGALGRTTGLSQQGGLVYVRGLGDRYSLALLNGLPLPSPQPLSRVVPLDIFPTSVVASSLVQKTYSPNFPGEFGGGVVNLTTRAIPTESFVTVSGSLSGDSETTFGPGYSYFGGDWDWTGFDQGRRNVENYGAFQGFFDSGARINDEGVDTRAILKDINDPNLYLVQKIGDLPANFSAGITAGTSFDVGADGMLGIIATGSISNKWRNRLITKQTASNAELELDSDFREFATDNRVLVNGLLGFGFEIAEHKFRFTNFYIHDTLKRASIEEGIDFQNDDQDLIQDTSWFERQLFNSQFVGELEFGDLSVDLRGGYAQTQREAPFEWTFAYSRPVNSPNDPFGELYLNLLDNQRGRATVAFSDLTEDLWYGGIDVGYVFTDWLSATIGYAYTDTDRTSTRREFDIRASSGFPEGLGVFRPDNLLGDALIDLAFDRDAQAAGGIGPYELNIFETTQADPAFAAALEIHAGYGKVNLRPIDRLSLDVGVRYETAVQSVDAIEVFAEPLGSSSATLLENDYWLPGGTLTWEVTDSFQLRASASRTIARPQFRELIFQTYFDPETNRQFNGNPRLVDSQLTNYEARAEYYFGGGSRASVAGFYKDIENPIEVFTSFSDNEIISGFANAPQAELYGAEAEFQYNFDLFDLGGWFESQQLVAIANYTYTQSEIKVGADDTARVFPFADQPAANFFDDGVSLTGQSDHLVNLQLGLEDLDRLSQFTLLFKYASERVTSRGAGPLPDIIEEPGISLDFVVRQGFELAGSEVEMKFEARNLTGQDHEEFQTNGTDRIEINSYEVGRSFSLGASIKF

SEQ ID NO: 21766 - protein, 158 aa, Caulobacter crescentus
AAGREDGVDVHLGYRTNKIQSLRWLGKPQVHAMVSINSENTSNFVAAGFDWKINLGQPGGFYLRPGMGLAYTDGKAGLPPANAPNLTPEERARRTYLYYHRIDFGSKVLFEPELALGYDLNDSWSTELSYTHLSNGQIFHQGKNQGLDDVGVRLVYKF

SEQ ID NO: 21767 - protein, 989 aa, Caulobacter crescentus
MTGANPASEEVMSLQRPIPSLARPLSRLSPLTLALRCALLGLSAVGAGLLGGGLAHAQSVGQHSAATRLDDATPRSYDIPAGSLGASLGAFASQSGLLLSFDPALTRGRTAPALKGRYSVLEGLQRVLSNTGLQVAAGTSGAYLLVEPRMSGEAPADLSPVVVSAAELADPQKETYTAPRSSVYLSSEDIDRFGRVSVGDLLQGIPGVQVGDSRNGGALDVNIRGIQGQSRVAVRVDGAEQALDVYRGYAGTQQRSYIDPDLVSSVTVDKGPSTRSGAIGGSVEMRTIGVKDILVDGKDLGVRFTGNVWNNGVAPQHRSASSKTENLSSVPHDDRGSLFGSQAKSGSAAFAYRNEHLDLVAAYAQRNQGNYFSGKKGQDRYRVYNRYGREESSVAKVYNAGEEVLNSSSETESYLLKATWRIADEHTLDLGYRRYDGRTGEIMPSDIFRFGTAGIYQYPLSEVKIDTYTARYRYLPENNPLVDLSTGLWMTEAKSDMLTSVLAPRSQAYRSDRNWTRQDNRRIGGDLNNVARFETDFGDFKLDLGGSFQVEDIQPQKSVVTTLHDINANRTLRDATRQEYGLNGKLEFKPVERLTLWGGGRYSHFNSKDNGISASPRREDRDMRFITVSRPGYYGSMMWFPDQNGQYTDATDPRLNNGIVTNNTNNPFEGIPFDEFGPANVTVHPSRVTNVVTGYNYSKKGSSRGGGFSPAFGINFELAPDTFVYASYIEGLRLPSLFETSQGTLQVEPGKELKPERSRSWEIGASALRDSLLADGDSAAIKLAYFNNTIKNYITRYYDPGQMGLMTFSNTDSYRTSGLELQSHYDAGRVFADLSATYYLKTETCDAAFAARLRAGANRYQRTENTPNCTPGSFMGSYTNTQNPPRLATNLTAGLRFFDQALTLGGRMTYTSGPTATADKPWQVGATTPQIEYRSVQLFDLFLKYKLFEHTELNASLQNLTDRYYLDPLAQSFMPAPGRTLRVGMQAKF

SEQ ID NO: 21768 - protein, 649 aa, Caulobacter crescentus
MKMLQHQGDSRFALTQLNKAFMAIGLLSSSMVMADTATTDDVMVITASQTKHPELTAPASVSYITREELDKLVVNDVAEAVKRLPGININSGTPYGRNEIKIRGLDSDYTLLLINGKRTSSRDALTSSYGNDFDLSSIPMSAVERIEVIRGPMSSLYGADALGGVVNVILRQPTEQTEGAVGYQYEGPTEGSGGDVHKWNVYAGGSLIPDTLLGNIIIEQSSRDAWRTDQSLNPDSDVLEERDELNIFSSLKWLATDQQDIDLDVIYSKDDRDADWNNWGTAVNNVQKLERINATLTHNGYWSKFDSRVRYNYENSDLKDDSGLNKGVGDITQTNNTLDGQLSGYVGSHLLTGGAEYRVTDLKNNLTLSKGSEDYSQSAIYLQDEFEIGDLAVTLGGRFDDHEVYGGEFSPRAYAVYSITENWVVKGGVGKAFKAPSLNQYSDSYAVLACRGACSVVGNPDLKAETAVSYELSTGYKADSWGATVTAFNNEIDDMIQAESWDRVKTELTYFNVQEAQVRGAELSGWFDVTDTVSLSANYMYTDAKDKTTDKELTLTPKNTANVQVDWQMLENVYTYVSYQYTGEQYVRTDEKSDGYGTFDLGAQYEAVKNLNLKLGVTNLTDEKRDDAAVKYDYIMKSRTIYAGASYAF

SEQ ID NO: 21769 - protein, 764 aa, Caulobacter crescentus
MSSRKSNVVKSRGGAFQLAVIAFGALANVQASAAASSDNNGLSLDTEAVTGLWPDEELPDETVRRAEIITVGPDTPFDSYHIGDQSVLNIVGGRADQVVVRDATVNIQSGVVESGISLSDALGNLSNATVKNATGSGIVLHGVMGSINPGSTVSAHSSDVSGSGYGISVGLWGALSIFNTDVRGFASQSKSGQGIFVSGANVLIADNSHVTGDMNGIHLVDGSQAGILVGNKSVAVIDRSIVQGLAGAAIKVNQRATFDIEADIAVQNHSELWAGNGNLLEVEDHSTVNFNVDNSTLNGNLVADDTSTLNITLQNGAQLNGDIVNGNRLAITSGSHWQMQGDNAVRSLSLHGGRVSFVGEGFHTLSLTELSGGGTFGLRVDLDNGVGDLIDVNGQASGQFGLRVRNTGVEVVSADMAPLKVVHTEGGDAQFSLLGGRVDLGAYSYLLEQQGNDWFIVGKDKVISPSTQSALALYSAAPAIWMSELSTLRSRMGEVRASGRAGGWMRAYGNRLNATTSDGVDYRQKQNGLSLGADAPVEVSSGQLVLGVLGGYSTSGIDLSRGTTGKVDSYYAGAYATWLSDDGYYVDGVLKLNRFRNKADVAMSDASKAKGDYTNNGVGGWVEFGRHIKLADDYFLEPFAQLSSVVVQGQELRLDNGMKAKNDHTQSVLGKVGTSLGRSVALKDGGVLQPYVRVAIAQEFSRHNEVKANDVKFDNSLFGSRGELGAGVSVSLSERLKLHADFDYMKGRHIEQPWGANVGLRLAF

SEQ ID NO: 21770 - protein, 714 aa, Caulobacter crescentus
MSSIKRVLKNRIFNYSSISIAIFSALSATSVVAEELESIEIPTANIERITVTGRSFNDYKAGTASGAMRGDIDLMDTPQSVNVIPDFVTDEQLATNLSEVLVNDSSVTGGSEKWNRQVFSIRGFELSSGSGYLINGQQQWSHYVQPIETLQQVEVLKGPSSMLYGQSGPGGLINMVTKKPTYETMLDIGFDTDEHGSTRFQLDAGGSLNEAETIRYRTVLVKQDTNYWREYQDGTNQERDRWLGYLNLEFDITDDLLLSLKYDHTQDKTGIDTGGWLNSSGDLIGGRDIIWDQPWAFTDNTITNMGADIVYHISDDWKVKAGYNDQQFNRQRLDSSPQYSEDPFSNGYTVKPFDRYDDWQHKTSYMDFVGEFSTGGLDHQFLIGANMLDYYYGQLRVKGAPETVIPGQPIANPGLDYNDDDSKYESDYKHYGFYIQDLITINDSWQVLAGVRYDEQKKDGEGNNSYAVSPKFGVIYSPADNGSIYVNYSKSFTPQGIVNDSEDVNDKMNLEPEYGEQYEIGTKWELFNDSLLLTAAVFDITVSNVTVTEDLTNPISGGHQTITTQSGEQRHKGFEMGAQGQVSDNWFLTGSMMYLNAEYQRPEGDKLNGKTPIDAPEWSANVWTRYEMTDDLALNFGAVYVGERFANTENTISKDGYVRFDMGAAYSMDVMGSDVSVRLNVKNLFDTDYIAGGNYKDVTVGEGRHFGLALEAKF

SEQ ID NO: 21771 - protein, 709 aa, Caulobacter crescentus
MTNFSSRAPNASRHPDARRVPRVLTLTVPALAVSAMTAAVAAEPVRVAGAPPDDAAWLLPPVEVVASPLTTPLVVVTDPKTPRQPLPASDGADYLKTIPGFTSIRSGGTNGDPVLRGMFGSRLNILANGLPTLGACPNRMDAPTSYIAPESYDKVTVVKGPQTVLYGPGASAGTVLFERVTPRFERPGMRFDGSVVGGSFGRNDQNVDVTAGTPDVYGRVIANHAHAQDYQDGNGNTVPSQWDKWNADAALGWTPDDHTRVELTAGTGDGYARYAGRGMDGAHFRRETFGLSFDKRHLGDVLERIEARVYYNEADHVMDNYTLRQPDPTSSMPMRMASEVRRRTFGARAAATLRFGDDFKLVTGVDAQSNRLDSRSAMGRQNYGDQPWDPQATMWNAGAFGELTWFASDAARVIGGARIDYASARDKRAATSGMMTSKPNPTFDDDRARVLPSVFVRYERDLASLPLTWYAGIGHAQRFPDYWELFSATRGPAGSINAFSAVRPEKTTQLDIGAQYKSDRFDAWVSAYAGYVQDYILFDYSTGMMGATTRATNVNAQIMGGEAGVSWRPVAPLRVETSLAYAWGRNATSGDPLPQMPPLDARFGLEYTRGAWSAGGLWRVVAAQHRYALNQGNVVGKDFGPSSGFGVLSLHAQYNVSKKVQISVGVDNVLNKAYTEHLNLAGNAGFGYSANTPVMEPGRTAWVRVSAKL

SEQ ID NO: 21772 - protein, 248 aa, Caulobacter crescentus
MWNGKRTTRALGMATAVGIGIASFAGDARAQAAGSVSLGAGWLHIMPQSGSGDLFVQSVAGAPVNRALPDTGGHVATSNAFSLMAEYQFTDHVGIAFLAGTPFTSDLVGDRSFAGYGVLGQAKPLAPVLALRYHFLAADARFRPFVGLGVNYTWYVDTHITNKQFLDGSCGPGCTTRSSLSASWNPTFEAGFNVALGKHLGLNVSAMYIPMSTTLTTDATNAAGTHDVTTLHVHTNPLITHVDLVYSF

SEQ ID NO: 21773 - protein, 714 aa, Caulobacter crescentus
MFNKNKIMPLWLLSLATVSVAAQAQTKEETIVVTQSVSEEPTAPVKGIVATKTLSATKTSADIVKTPQSVSVITRDQMAQLDVTSVSQALRYSAGVFTEYRGSSNRNDEVFVRGFSYVPKFLDGLSFGATASSQTGSVDPWLLERVELVRGPASVLFGQVNPGGLISMTSKRPTSEPIHNVQFRTGNHDLAEGAFDFGGPLSDDGRVLYRVNGIARTQHNQVEDYKETRMAIAPAITWYPNDQTRFTLLTSYQKDPDAGYRNFLPAYGTVTSANGRYIPRDFNVSDPDYNQSWREQTMIGYELEHQFADNLTFRQNARYASIKQKYRYLVYANSAAASTVLTRRAQHEERTTNEFGIDNQLESLFATGDVNHTLLGGLDYKTSKDKQLLERGMGAQYNLDWTNPVYGINVDESTFSTATDEQQNLDQMGLYLQDQMSWNNWEWLVSGRYDWTEVRTIDFDGGTQTQQNDNKFTWRTGLLYAFDFGLSPYISYSTSFEPSLQTNRAPGVAPFKPTTGKQTEIGLKYQPVDSTLMTLALYDLTQSNVATYNSAEGWFENAGEVRSKGVEAEIHSTLMDSINLIGSYTYTDAETQSTTVAGTEGKTPARIPTHMASAFASYTVPGGALKSLTAGVGMRYIGTSYGDAKNTFKVGSVDLYDAMVSYQLGELNSSLKGASVQFNVNNVADTKYVASCASDTACFYGIGRTMTATVNYSW

SEQ ID NO: 21774 - protein, 688 aa, Caulobacter crescentus
MGTALTAHAQSAGATAPSTTTASASTLPSVRVLGDSDSDSRQVGDRSEITLNPQALPTTVQHIGQEDIANTNVGRDVSNIFRRVPGVLANNIDQGDTGNGFRMRGFATQGTHGADTAVYVDGVPQNIPSIQSIASHGAVFLEWLPPELIGGIDVIKGPVSALYGDQNRAGAVDIRTRDGGDATPSSVSVSAERYGLRRTALVLSNKLSQVDSLLVADLSRNDGYRYASNTDRESLSWKLSTQQDSGKYSLRLTRYVSDFQAAGYLALSDLQKGLDPRSTQFNNPGFGAARRTSVVVNRAPTAGEEGWYATAYGESLYRQRAVATSATRHLLGEDDRDMYGARVYHNTVFGDASLAVGTELRKDSGSAFRRIYVNRLPSANYANDVDLDLVTYGFFAQGQWRATRDLKLSAGARYDRFDYDIANLKLPAASTGYRKGVLTPKLGASWTVLPRLELFANVAEGMRSPATEQISSSGATGPLGASGGVISQVKPSKVRSYDMGFTANPTTDVMVSGSAYDILNSDEIVSQADGSFRSVGDTTRKGVELETRWQLGTASSVYASVGRILEAKVNNPAANTGAKLSVPGVQFKAGAQHKFGLGAGQMTLNADAYLIDDIPYYVGTPTTQERTMPLYTRYDVRSTYDYGPAQFSLYATFQPQRYGSEIAYGTAAGLLVSPVPKTTVGATLRYFF

SEQ ID NO: 21775 - protein, 948 aa, Caulobacter crescentus
MRAYLSILAMLVCAGLSAQTNVSGKVVDGNNVPIPGVNLIVVGSSMGTTTDFDGKFKLTVSQNPPFKIQASSIGYDTATVEITRNNQDVTIVIKEGTELDEIVLSASRTPERIRESPVTVERMDARAIKNASAPTYYDALENLKGVDVNTNSLTFKSVNTRGFATFANTRFMQLVDGMDNSSPALNFALGNLLGMSELDVATVELLPGASSALYGANAFNGIMFMRSKDPYKHQGLSFYAKTGMTSSDNAGSNSFVDFGLRGAHAFSDKLAVKASFSVLNGTEWFATDYTNYDASTGDAIAGNRQTDPNYNGLNIYGDEVSTTLNFDALAGAPAGTFGSSAVSRTGYEERDLMDYDAQSVKADLAMHYKPWANDFTVIWNSKIGRGNTIYQGANRYSIKDFFMQQHKLEIRNDNFFIRGYVTAEKAGNSYDTRFAAINVNRRWKSDQQWFTEYATGYLGAITGAIPGVTPGDPAVAHAFARGLADTGRLEPGTPTFRSALNSVTADGDLLTGARFIDNTKLYHSDVNYNFSHLIDFADIQVGGSYREYVLNSEGTIFTDYDGPIRYDEYGAYVQVQKKFMEDKMKFTGSIRYDKAQNFDGNVSPRISLVFSPDEDKKHNFRASFQTGFRNPTTQDQYIGLDVGNAILVGSAPDNLDRYTTRPITNNFPAGLEAFGLDRTVTLSGNDAYNNSYTLSSFQAFGASAAAGAPNPALLEKANVEFVKPEQVSAFEVGYRGIVFDNISVDVSAYYNQYKDFIANRTVIVPNYGNVDLSDITDLTPVGGAPTPNALIAASNGDFTPFQLYSNSNADISSYGAAIGVNTKVFGDFDFGINYTYAKLDFDQASDPDFETNFNTPEHKVKASFGNQNLFNNFGFNINYRWNDAFLWESTFADGMVTARSLVDMQVNYRYKKSTFKLGAANILGHEYVSAPGVGTIGSQYYISWIINQ

SEQ ID NO: 21776 - protein, 695 aa, Caulobacter crescentus
MKARSHLAMLSALLALPITSVQAQQSTTLAPLTVEDTLLEEDGAVILYMDNRNKGPVADGGELLKTIPGVSAARKGGHGLDPSIRGQNQTRLNIVLDGAFVHGGCPNRMDPPSAYGASESYNSVTVLKGAQSVEYGAGGSGGVVLFNRQTETFDADERYRGKAGVGYRGNINALESYLDMASGTPSAFIRFIGNYSDGNDYKDGDNNVVRSSYTESTGNLLLGWTPDAENRVELSHEASYSSDMLYAGAGMDAPYTRNNVTRFKFARGLHDGVMQKLEGQISYSQVAHLMDNYSLRTAPAAAMYMQAPSTSDTLTGKLSLQFNHAGMDWKVGVDHQGNQRDAVRYRGTVGAVTNLQSYLWPDVTTLTTGLFAQLDRPLGETNRLKAGLRYDYVRADAGKTHATPNDAMGALAKLSGHDLYTTYYGGSTDASTEHNMGGFLRYEQGYWGNQGNFYVALSRTVRTADATERYMAANHNTSADSRWVGNPFIKPEKHHQLDVGTRIQWQALKSDVTLFYNRVDDYILQDHQHSAGADGNATVYHNVEATLLGGEAAFTYNFDPHWVGGMSLAYVYGHNETSNQVLAQIAPFEAGFTLDYRADRWDFGGKLRVVTKQTRADTDSTTATGLDTDQTPGFSTLDLYSAYRPMPNLTLKMGVNNLFDKRYAEHLNASNSFDATQLQVNEPGRTLWFTLGTEF

SEQ ID NO: 21777 - protein, 747 aa, Caulobacter crescentus
MGRKAQLLFGTAALWVAAAAPASAQDRAPEALPADTAAEAGDDGAIVVTARRREERLSDVPTAASVIDATALNDRGGATGSGELLADQPSVRFNNLSSSITSEISIRASSTARATNGDPSVGLYRNGAYIAGGPVGGRNFTRLDMLDIGRVEVLRGTQGALYGRNAVGGAINIISAEPEFDLSGWASVRYGFENNSLQLQGAVNMPLGDGIAARISGDLVEQDKGFFYNPDNDVYFDRQKGHGLRGQIRLKRGPVDAVIMAETQRLTTPSIHYQIFIPAGTPGFPGGYIQDRFRYPWSTAPRASQDVDGLQAIVRVDLGGADLTSTTSFRKRHSEYDLDNDAVSPAELARARAAGEVGPLTPLDPGSASYVVDTTDNFSQDIHVSGSNDRLTWLVGAEMLLLDSDFSVTTTRTPTLANPSPGNIAPARLHFESYAAYGSLGFDLTDSLNITGELRYTHDSRSISARLYDLGTGLPTGGPSRIIDDSITADNLSYNATLSYKLAPDILAYAKVGSSYRAGGFNTRLSDPRAPSPVQVLFGNENSTSYEVGFKGSPMRRGYFAVAGYYTQLDDLIAQVDDGCALTNPTCPVAAVSYLTNAGDAKSWGVEAEYSQGFDLGQGSGRLALSGSRQGGKVKSGRYDGLDLAQVPDWLASANLNLRAPVAKNVSLTGNILVSGQWGGKQELTATSVDLDDYVLVNLRVGVEFGKVSISAFANNLFDKVYYVAQAPTINRYSQPRVIGVEGRISF

SEQ ID NO: 21778 - protein, 795 aa, Caulobacter crescentus
MNTPVSALATAVVAALLASPALAQTAAPATAPANTLDTVIVTGTRVSDRTVAESQSPIDIISAESLQATGTPELATALARALPSLNFPRPALSDGTSAIRPAQLRGLSPDQVLVLVNGKRRHTSSLLNLNGTIGRGAAAVDLNTIPVAAIARVEVLRDGASAQYGSDAIAGVVNIVLKGAEKGGSLQAGFGQYSAGDGNNYELSGDTGVAYGGDRGWLHVAAQLNQQDPTDRARAYAGAPSVSQPAVGRKAFKIGDPEVNAQAVSANTEFAFTDSITGYAFATASNRDITSFAFFRAPGSTTQNILSIYPQGFLPEIQTYAKDRSLVAGVRGSTASGWDWDASYNYGYNRIDFHTRNTLNVSLGPTSPTSFYDGALETTQNIVNLDVKRGFDWGLAYPVTVAFGAEYRNEKWNQSPGEAGSYFQAGTLAGGAQGFGGFAPSVSGQYARDSYALYADLEADFTDTFSAGLAGRYEDYSDFGSQASGKFSARYAFTDKIALRGTVSSGFRAPSLAQQYFQSTSTTFLAGNPNPFEIRTFPADSNVARALGAEPLDAETSLSYSLGLVLQPTDALYLTVDAYQIDVDDRIVLSSNLTGTGVRSLLESQGIFGINGGRYFTNAVDTRTRGVDVVGSYRWQLAASSVDLTAGYNYSETEVRSVAANPAALSANGLSLERIDRTERGRIEEGFPRDKFLINGSWNLEHWTLALGATRYGKYSTRPADASNDQTFGAKWVVDASASYKVDRWTLTLGADNVLDEYPDENNFANSTSGQFPYSNLSPFGFNGAYVYGRINYRW

SEQ ID NO: 21779 - protein, 818 aa, Caulobacter crescentus
MSRLKFLLALCAFTTAATVCAQTATIKGIVFNEAQQPLDAVAISWDAEGTQTDENGYYLITIPANREIKISFSHIGYKQSSTRFKLQPGEIIEFNPVLKTMVEQMADVVVTSATLDQQEGIISLAPETVRKIPGANPGVENLLQALPGVSSNNELSTQYAVRGGNYDENLIYINDVEVYRPFLIRSGQQEGLSIVNPDLVRNIDFSAGGFQAKYGDKLSSVLDITYRRPVNFTASADLSLLGASLSTEGISNNKKFTALVGARYWDNSLLVDAKQTQTNYQPRFTDLQTYLTYTFNPKFSMDFLGTIAINNYNYEPQTRQTNFGTLADPVALLVVYDGQEQDRYETYFGAVTGTYKPNTHLNLKFTASAYHTQEQEHYDIHARYALGTPSTNIGSTDAGEVDFTRAIGSQLTHARNDLDALIVNLQHKGQYIKNEHQLDWGLKYAHESIRDRLQEYEIIDSAGFSVRPPLETFTNQQPYEAFDAPLTPFTSRRAQNTVNIDRLMGYLQYSRRLNWSTAKAWYNIGVRSQAWTVSGLGIASNTQQVFSPRGQFSIKPNWKSDMLFRLAAGVYHQPPFYRELRNAQGQVLPEVEAQRSLHLVLGNDWSFDMWGRPFTLTSEAYFKSLDHVNTYTLENVRIRYRAANDAEAYAYGLDVRLAGEFVPGTESWISLGLLKTEENIQDRGYIARPTDQRFKMAFLFQDYVPRIPDMKLYLKMVYQTGLPGGSPNYADPYFYQTRLPFYFRSDVGFLYDIINAERGASTNSFIKELSTGIEIFNIFDRRNSITNTFVRDAASRQQYAVPNYLTPRVFNVRLRARF

SEQ ID NO: 21780 - protein, 1173 aa, Caulobacter crescentus
MYCALTRVPELCLRAVHRSRFAILCALVLFFSAHVFGQEATVVGTVTDPTGANVPNVTITITHIETGQVRNVTTNSEGQFAAAALPIGHYNITAQSEGFGVAQKTNVALNVGDRTRIDFALAVGSTKQTVTVEANAVQVQTQTGEVSTVIDGKQVAQLSTNGRSVYTLYALTPGASSVQGDFITPTPVSGDSNVSINGQRPGHNLQILDGGENLDRGGSSASVMPSLEAIAEFTNMTSNYSAEYGLSSAATITTAVKSGTNRFHASAWEFLRNDALDARNYFNPAPAKVAELRYNNFGFNVGGQVPLWKDHPTFFFYNQEWRRLVQGGQLNQTVPLASAYPDANGTGTGAVIPTTLPNGDPNIITVPTGIANFGANCSGAVRASLIPGQPFPANTIPDCLIDPNSQSLLKAGIFPLPTNGVQFQGGNNSPTNVTEEIVRIDHQFSSKFSIFGHWIAEQVSQTYGTTQWSGDNVPTISDVFGNPSFSGVIHTTYTISPTLLNEASFNYNGNRIHIIPQGLVSAPGDFTFNRLFTGPNDQTRIPSIALSGSTGTNYTSNWTPWNNAANDYQVRDDVTWSKGAHQLKMGGSWALYTKVQDAFANTQGNFSFNGGFSGNDFADFLLGYAQQYTEDAVKISGNWNNVSWAAYVQDNWRVTHRLTLNLGLRWDGVPHTYEANNQSSNFYRNLYDPANAATFDANGNICSANSVPACPGGPSPGLGTSSNPILSGVGFYVNGIGIGGLNGVPNGLVNNHWAAFGPRLGFAYDLTGQGKSVVRGGFGIMYERIQGNDMYNGAVNPPNDLQPLLNSVSLSNPGYNIKTGNSITAAALPVLPLVVSGIDSENYKLPVNYQYSFGFQQSLGEASVLGISYVGSQSRHQNDYRQINLPAITSLPALLASNGAGINQQMPYLGFGDIRLAENEANASYNSLQVDLRGNLKRDFQYQFGYTWSKAIDAATSNGSGGDLNNVTNPYVGWQYDKGPSPFDRTHIAFANFVYSIPLFNNNDSRAVRTILGGWQVSGIVTMESGAPLAIGLSGSNVSSLFNGGFVTNSGNRPNVNGAVTYPQSVNEWFDTSAFSAPTCTTGPDCWGDLGHNTVRGPGRDNWNLSLFKSFTLNDRGSRIEFRADSFNTWNHTQFKGDYNNGGISTNFGSGNFGAVTAAFDPREFQFGLKLVF

SEQ ID NO: 21781 - protein, 806 aa, Caulobacter crescentus
MSLTQHNFMLKVAMNPFVSLTVASVTALFVASPAFGQEATQSTTLDTMIVTGTHVTERTVVESQSPIDIISAAHLAATGSSELATALSRMLPSLNFPRPALADGTSGIRPAQMRGLAPDQTLVLINGKRRHLSAQINVNGTIGRGSSAVDLNTIPITAIERIEVLRDGASAQYGSDAIAGVINIVLKGATQDGSLAVEHGQYSAGDGATSKLSGDSGISFANGRGTLHLAMDISQQEQTNRAGPYQGSAPNTGNYPDIGRTAFIYGDPRVNAVAFSANGMFDVGEHVKGYANAMLSNRDITSFAFYRSRNHNGQSMLLAQRYPEGYVPEIEQNSKDRSLVTGLKGSTEHGLNWDMSYNYGSNHIGFHTNNSINYSLGVESPRDFYDGALEYTQHLLNTDFTKVLDWGLTYPVTLSFGTEYRYEQWNQSPGIPASYNGMTGGAQGFAGFSPLNTVHANRNNYALYAGLDGDLSEHLSAGVAGRFEHYSDFGNQTSGKLSARYALTDQAALRATIGNGFRAPSLAQQRYQVVTSTYSNGTFYESGTFPTTSPVAQALGAAPLRAESSLSYSLGLVLQPFERLYLTLDTYQIDIAHRILLSSNLNDAAVLAALQQQGNSNVTSVRYFANAANTRTRGVDLVGTYTIPFAVGQLDLTTSYSGIATRIRSAVTQPAALSAIGSTQTIVGRDEIGRLEESFPKDKLILSGTWKLTQWDLMLAATRYGTVTVRNPTSVSRDQTYGARWVVDASASYKPDMHWMLTLGANNLLNAYPDKTVNAINSIYGQMPYSNYAPFGFNGAYVYARIGYSW

SEQ ID NO: 21782 - protein, 667 aa, Caulobacter crescentus
MSQVLRLSVLASALLPLMATAQTEKTPASNHHDVMTVYATGNERDSFNTPMMVTVIKNDSPETKTATNANDILRKVPGIALTGTSRTNGQDISMRGFDRRGILTLVDGIRQGTDTGHINGTFLDPALIKQVEIIRGPSALLYGSGAMGGVIAWETVDAKDLLREGQNQGFRVFTQGATGDHSFGFGGSTFGRTEDFDGLFSFVTKEVGDTRLGGGEKMDNKETIANMLGKGTWQLDDSQTLSGQIRYYNNDAYEPKDPQQLSASNDNKKVNRTTRQRDLQATYQINPNDNPWLNLKVTPYYSDVNITSKGKESNYEGRSQKTYGLKLDNRSNVYDLPLAAHNFTYGTEAYRQKQTPYATTTQFPDAEITFASGFIQDEITLKDLPVSFILGTRYDNYKSTAKGNKDVNADQWSSKAAVSITPTEWSMLFASYSEAFRAPTMMEMYNDSLHFKGGPISNYWRPNPNLKPESTRTAEYGFGLRFDDLLMARDNLRFKASYFDTKATDYINTYVHPDRVNWDNNYTTSINTKRAKIWGTDVSLDYTTDYFAWGLAYNHTVGINEHTGNAIESIKPDSLTSNLSIPVADSGFSVGWLGEFTTHTDFDKTSKLKQQAGYAVHDFYLNYQGNGSLKGLDTSVVLGNAFDKEYYSSQGIPQDGRNAKLLVSFQW

SEQ ID NO: 21783 - protein, 417 aa, Caulobacter crescentus
MLYYAQNLMLGKIVPYNPNLAEELLIKAANEGHYDSQYFLGKEDFEKQNPIKCKDSLNWLLKAHYNIANPEMEFMQSILNKYNINDIFIHDHESFKKAYKQISLHLHPDKVSNLKSIVTIDEVNDDLNLVKEIYKESYNLSDLPETKNKIHDDVELMIAQMHFNGCKYIKDDVDKLITQDKTSFKISNDNYGFGIGYNFNEYIESELTYNKIKYITLTSNYKLDQSSFDPTKNVASMLLMRAYVQKNKNNIPDSINTDDTYLYHPTKSGEITIRGKKYPIENIFKTSKLNYDKLKDLNLSILNMKLEALIFSLKLKAPTKKRFVPFLILGAGASKMKIAGINEIYNNITNKMEQKPSLLNKTSFAYRVGVGMKFKMSGNSALEVSARYFDYGKYKLSNGDQKKIKGHDFSAGIVLGF

SEQ ID NO: 21784 - protein, 474 aa, Caulobacter crescentus
MAAVQVRRRGRALALALWAGFALSVGGGVRARDGLATPPAFEGQAAPAVSWPCPPPADRLDDLALLEAIDLALCHSPALRQGWARIKARSAEVGLARAPYYPSVALSAGRSAQRRSTGLGEDGVRNNVMAVTLAWRLFDSGARSAALRAAQAQLDEAAQAYGAVLQDKLAEVVGAYYEAATARQALHTAVEDTEIARRSASIAARRARAGLDSHGDVLHAQAALERARLAQAQAEGAQARALAGLAQVLGVDPATPIVLAPGPLAPQRIEDRELAQWLRDARQRHPAIKAAQAGLAAATAQVDVARATDMPTVDLSLGHYRNSSENVSVFAGSSRSVSASLNLRIPLFDGFARRHRIQGARAEVQRQEALLDQARLATGAAVARAYADLRAARASHEASLRWLKAARAAYESDLRRYEAGVGGVAELLRAQSDWLSARQRHVLYAAQLRTRALALLAAAGELGRSTIDGDPPKE

SEQ ID NO: 21785 - protein, 785 aa, Caulobacter crescentus
MSLRFSARPSRGRLALACAAAFAWPAAHAAASDDAQLDPARERAGRSADAVAPASAVPSASSPADTLTAVSVTAQRQPVDPDTPAVVESITRERIDAHTNVTTEDALRYAPNLMVRKRYIGDRNSVFAGRDFNELQSARGLVYADGVLLSNLLGSSYAYPPRWSLIAPDDIARVDVLYGPFSALYPGNSIGSTVLLTTRRPEKLEASLSTQFFTQRYRDGYGLADSFGGNHQTARIANRVGRFWFALSLDRLENDGQPMQYASPNAGYNAALGPAVPATGAATDIGPNGKPRTIVGAQSIERTEQLNETIRMGYAFTDHVDATLTLGHWENHYRQHGETFLRDAAGNPVYGGNVSIGGRNVTVAPSAFAPQRGDQENWLYALGLNGRLDSGWRLSGVVSAYDVSRDVLRAASTVQGGAGTLFQGDGTGWRTLDLKADAPEAGGHKFTFGYHYDNYFLRNVTYNTADWLAGPTTSLASVYRGDTRTQALFAQDAWRFAPGWLATLGLRYERWDAYGGALGNAAGTLGYADRSANALSPKLALQWDATDVWRFRLSFATGTRFPTVGELFQGTISNNAIVNNNPNLRPEKAIDWDFTAERDVGVGVVRASVFQSDLRDSIYSQTTVSGASTVTNVSNVDRVRVRGVELAFSGENVGLSGLDIDANVSASNARILADAANPAYVGSRFPRIPRLRANLLASYRFDEHWLASVGVRYSGRQFNTLDNSDVNPDVYGGTSSFTVVDVKVRYRFDRHWSASVGIDNLTDRRYYVFHPYPGRTFYGELKWSL

SEQ ID NO: 21786 - protein, 933 aa, Caulobacter crescentus
MAGRCTFGSFMMRRCVLLRPSRLSQALCLSLCIVGGHAAAQDTQANAPAQGQMATLDKVTVAATRYNATDMQMAATNTVNVLSADDLKTTAVHNVAEALGLMPGVNVINTGQSYFGGIDGAARGEGMFSSVRGLNAEYNVNLINGVNVAQGMPYSRGVQLSLLPPSGLQTIVLNKTSTADMDGDAIGGTIDYRTPSAFDSPDRRGGSITLSGRMESRARDYGESGLGSGAAGDWHARFGADGQFGVAVSAYYDERHFVNSEVAGASAARSDGSWEFARTDASGALAAGTDSQDALQSTGVNIGYSQGDTRRYGGNAAFDWRVDPSLHLYARMTYAFAKTEQNTGYTQFVPANVSYTQIGTSGIYQPQINRVAVRYWYETNPEEADLATIQFGAEKQLGHWTFAPNVFYGTGNNDRPDHVEISARNDQYSSTNFAYGANRFISYDGDGFPIPLLTPAMQAQASDVGSLFARRTGQISKQYSGQDKGGGKLDVSYDFDDGVLSRIAFGVKYVDSSRSFTDRDWTNAKYTDGTLLRDTGLVAQRYDAVYPGQYALPTLRLSNDALNALIARTLTPESFDSCGRLAVNNLNCNTMRATEAVSAAYVMATLRTGNWEILPGLRFEHTSIDNTFWAQPAAVGGVEQVGAFANNQTRYNVVLPSVFVNYRPDGDGAVYRGSVWTSYTRPAFVQLGGGRSTDISADGQTTITEGNPDLKPIKSLNVDLSGEWQNDAGGHAMLAGYYKRLTDYIYESGSDAANAGESGTASTRFVRPQNGGDGRVLGMEAAVRQTFQGLPAPLDGFGIGGNVTRQTTRVDLGEEGFAHERIQNAPDLLANAEVFYEKGPWSVNLSYHYSGEYVSVYDYLNQGARWDNLWIKPITRVDLHVGYAPTDHLRVDLSVANLTRQHSYWAHVGHDNTAISDIVDSGMTSLVTAKYVF

SEQ ID NO: 21787 - protein, 767 aa, Caulobacter crescentus
MRNRQDHIGISGLALMAALVCPGAAHAAEGGAGDAAEIVVTAQKREQRVNEVPMSISALSGKELADKGIVKPGDLEKSVPGFSYTVSGYQTPVYILRGVGYFESSLAADPAVSVYVDEVSLPYSAMTIGAGLDLERVEVLKGPQGILFGRNSTGGAINYVAARPTAEFGAGMRASYRRFGEVELEGHVTGPISDTLRVRVAARTDQGGDWQRSYTRRDSLGAKDLLVGRAIVEWAPSAAFTAQLNVNGWRDRSDNQAPQLVALIPKTPANIPDVPGTFLYPLAPANDRAADWNAGRSLRNDNSLWQTSLRLGYDLSSDISLTSITSYADYSRYAPIDQDGSTLNIIDSLDVGGIKSFFQELRLSGKTDALTWVFGGNYERDRISERLTSFLGDSTGGKIAGVRYNGAQANNVQIARTYALFGNAEYEIMPGLSIQGGARYTKADRSFDGCSGDVGDGRFAAAFVALQTALKGGRSPVVPIAPGECTSLDANLDPARLVTNFNQDNISWRAGLSWKGEGGLLLYANVSQGYKAGGFPTTTAATLTQFTPVSQEKVVAYEAGFKVPLWDRKIQWNGAIFRMDYTDKQVRGIIPDPVLRTVQALVNVPKSKIEGAEGQVHIRPTRGLDLDFSGTYLHTRVDDFIGLDVFGLQRNFDGSRLPYTPKWQAVADARYAWPVGDRLSAFVGGHLTYHSGTNAQLGGVPVVAIRAYTLVDLNAGIESADGRWKAMLFGENVTNKYYWNSANSISDVVVRYAGMPARYGVSFSFQY

SEQ ID NO: 21788 - protein, 285 aa, Caulobacter crescentus
MIRALLLGGTAALVSTAALAADLPRREAPPIAFAPVPVFTWTGFYAGLHTGYAFTDNPNIQTRGNDPFTASNVTLARRPASLKSEVDGFSRIGGGFGYNHQFTPGGGFVAGLAFDATWLDLDKRTGFYGAPNPTIGNASVYTQSLDFLGTVNGKLGYAFDRFFVYGTGGLAFGHVSYGADFFNPGATVLQYTGGGRKIFETGYNYGGGIEYAIPVDSFLNYFSVGRWLGIKSDVTIKAEYIRYDLGSRNVLINQTAPVPPGSYTARFATEGSLIRAGFNYKFSGL

SEQ ID NO: 21789 - protein, 577 aa, Caulobacter crescentus
MRYIRQLCCVSLLCLSGSAVAANVRLQVEGLSGQLEKNVRAQLSTIESDEVTPDRRFRARVDDAIREGLKALGYYQPTIEFDLRPPPKKGRQVLIAKVTPGVPVLIGGTDVVLRGGARTDKDYLKLLDTRPAIGTVLNQGDYENFKKSLTSIALRKGYFDSEFTKAQLGIALGLHKAFWDIDYNSGERYRFGHVTFEGSQIRDEYLQNLVPFKEGDEYESKDLAELNRRLSATGWFNSVVVAPQFDKARETKVLPLTGVVSPRTENTIETGVGYSTDVGPRVKATWKKPWMNSYGHSLTTSTSISAPEQTLDFSYKMPLLKNPLEQYYLVQGGFKRTDLNDTESDSTTLVASRYWDLSSGWQRAINLRWSLDHFTQGEITNTTMLFYPGVMISRTRSRGGLMPTWGDSQRYSIDYSNTAWGSDVDFSVFQAQNVWIRTLYDRHRFVTRGTLGWIETGDFDKVPPDLRFFAGGDRSIRGYKYKSIAPKYANGDLKGASKLITGSLEYQYNVTGKWWGAVFVDSGEAVSDIRRSDFKTGTGVGVRWESPVGPIKLDFAVPVADKDEHGLQFYIGLGPEL

SEQ ID NO: 21790 - protein, 423 aa, Caulobacter crescentus
MTRGKARVASLAAGILMASAFAADAQEAEANLVDARGQSVMERERPGYDAAGIRAGGFMVYPEASISGAFNDNIYALPGNETDDFITTVAARVNANSTWSRHAISLRAGVAQDFYADNTDENRFNWNVGVGGRLDVTRDTSINANAGYAVLHEDRGDPNAPAAADEPIEYTLFNAAAGIQHRFNRISVGLDGEYLSYDFDNAVTTAGAPILQDDRDREEFIQRLRLGYNVSPDTLVYVEGQLDQRKYDLQPPAVATNRDSDGRQIVVGSEFRLTNLAQGGVYVGYQEREYDDAAFGDTDGIAYGANVDWFVTPLTTIQFTADASVQETTVAGSSGYDRQQFGVGVDHELLRNLILRGALSYANNDYNDAAREDDIIGARAGLVYLLNRNLDLEFGYNYSDRDSSVPAFSYTRNIIGLTVTGKL

SEQ ID NO: 21791 - protein, 944 aa, Caulobacter crescentus
MTSISSLSKAVKVALLATTSAALMTSAGAYAEEQEGDSIERIEVTGSKIKRIGELSPTPITVITGADMMDMGITNVADILNKLPSSTVGISPETSNNTIFANGLNQTDLRGLGSDRTLVLVNGRRFVAGSNGSSAVDLNTIPTAMVSRIEVITGGASAVYGSDAIAGVINIITRTDVQGVELDVSYIQPEQSGGEEGQFSLTAGGNFLDDKLSTVFNFTYAEQKELRPTDRDFLDNPVNSIYNPDTSEGAPARIEYIGRKPLSWINEAGTFFAGDGGQYTFGPDGAMREFDYGEGLIPGPGNNANYCGPSCEGYDPVDYGLIRTPLDRKVFTLNTDYEINDEHKIFTEITYVDYTSNGESTPVFHTWNPVMADNAFLPEETKQLMADTDMEYFNLYRIDGEFGNRTYNQDRETMRFLVGLEGVISDDWDYSIHAQRGQLKETTLWKGQIWDERYEQAKDAILVDGEIVCRDVDARAAGCVPMNLLGVNQASQESIDWVGTSAGQTAKTTQTSAGLIVSGALFDLPAGYVSAAFSADYRKEESETNPDQALIDGTIFGNSANPMKGEYDVTEFAAEFNIPLLSDMFLAHDLALDLAYRWMDYSTAGQDDAWKVGLNWAPIEDLRLRATRSKSVRAPNIGELFSPAGQTFESFTDVCDKINVELGPNDNRKANCQAAGLPQGWNPSDSWYLSNHAGSNAGNPDLKAETSHDYTIGAVYTPNYLDGFSITVDYWAFEISDAIEYIDVSTAVRYCYDSESLDNVYCSRFTRDAATGDIVDFVQSPVNSASFDVKGVDIESQYDIPTDSFGDFKVHVIATYLEQWQTNPTGFADDLQVDVGEYTDPRWKAMFSLGWKYDALSLEARSNYRHSAVASNDWKPENNNYNDIPSSTIWDFTGSYAFNDDLTLRFGVLNAFDLAPPRNPYVYDGAGYYDTTGRAFFLGANYKL

SEQ ID NO: 21792 - protein, 386 aa, Caulobacter crescentus
MKKLALSALSLALLGAAGAAQAQSSVTLYGVIDTSIAYVHGNDGQANNMWQMLSGNLQGSRWGLKGAEDLGGGLKAIFQIENGFNPGTGKLSAANTIFNRQAFVGLQSNQYGTLTLGRQYDPVVDLVQAVTADNYFGSFFATPGDVDNNDNSLRVSNAIKYTSPVYAGFQFEGMYGLSGIAGKPGQGQTWSAAAAYNNGPIGIAAGYFYANNPSPTTTAVRGGWGSTTSDNIVDGPINAGYVTAKSIGIAQVAAQYAIGPVTFGLGYSNAQYKPDAYSTFSSTEKYNTGRGFVTYQVTAPLLLGLGYSYTKASGNTDAKYHQVSLGADYSLSKRTDVYLVGAYQHASGTQLNTDGTTSAAQASIGSYGYAGTKSQEMVALGLRHKF

SEQ ID NO: 21793 - protein, 722 aa, Caulobacter crescentus
MNKPTQLATLLPLLISLAPHSAHAANTSEDEIIVTSQPSADTTHAASGAGFKTNDIDVGPLGNKAWVDTPYSTTTVTKEMIENQQAQSVSELLKYSPSTQMQARGGMDVGRPQSRGMQGSVVANSRLDGLNIVSTTAFPVEMLERLDVLNSLTGALYGPASPAGQFNFVAKRPTEETLRKVTLGYQSRSAFTGHVDLGGHIDDDNRFGYRVNVLDQEGEGNLDDSTLRRKLLSVALDWNIQPGTQLQLDASHYEFIQKGYPGSFSYGPNIKLPSAPDPKDKNLALSTAGNDLTTDTVSTRLIHYLNDDWSVTAGVGWQQADRAMRNVSSKIINNQGDISRSLKDSTAAGRFRVLSNTATLNGHVDTGSVGHDIALSTTGYVWSLYSAKGTGPSYSWDTTNMYHPSEMYEKGDGKIITGGDRYKSSVNTQQSITLGDTVTFTPKWSAMFYLSQSWIQSQNYNKSGHKTGQIDENGLSPNAALMYKITPNVMAYVSYAESLEQGGTAPTNSDVKNAGQTLDPYRSKQYEMGLKADVSGMNLGAALFRLERPFAYVDPGDNVYKEQGNQVNNGLELTASGNVWQGLNIYSGVTLLDPKLKDTVSDTTSDKRVVGVPKVQANMLAEYSLPSMPEWVYSANVHYTGKRAANDTNTAWASSYTTWDLGTRYTTKISSVPTTFRVVVNNVFDKHYWASIFPSGTDGDNGSPSAFIGSGREVRASVTFDF

SEQ ID NO: 21794 - protein, 440 aa, Caulobacter crescentus
MIRRHSCKGVGSSVAWSLLGLAISAQSLAGTVTTDGADIVIKTKGGLEVATTDKEFSFKLGGRLQADYGRFDGYYTNNGNTADAAYFRRAYLEFGGTVYRDWKYQINYDLSRNVGNDSAGYFDEASVTYTGFNPVNLKFGRFYTDFGLEKATSSKWVTALERNLTYDIADWVNDNVGTGIQASSVVGGMAFLSGSVFSENNNDTDGDSVKRYNLRGVFAPLHEPGNVVHLGLQYAYRDLEDSAVDTRIRPRMGMRGVSTNGGNDAGSNGNRGLFGGSSAVEGLWKDDSVWGLEGAWALGAFSAQAEYLRRTVKAERDREDLKASGYYAQLAYTLTGEPRLYKLDGAKFDTIKPENKEIGAWELFYRYDSIKVEDDNIVVDSATREVGDAKGKTHTLGVNWYANEAVKVSANYVKAKTDKISNANGDDSGDGLVMRLQYVF

SEQ ID NO: 21795 - protein, 369 aa, Caulobacter crescentus
MQFPKTLLHSSFFLPLLLSFCIAEENGAYASVGFEYSISHAIQHNDPFLNQERIQIISNAQNKIYKLNQVKNEITSMPNTFNYINNALKNNSKLTPTEMQAEQYYLQSTLQNIEKIVMLSGGVASNPKLVQALEKMQEPTTNPLEFEENLRNLEVQFAQSQNRMLSSLSSQIAAISNSLNALDPNSYSKNVSSMYGVSLSVGYKHFFTKKKNQGLRYYLFYDYGYTNFGFVGNGFDGLGKMNNHLYGLGIDYLYNFIDNSQKHSSVGFYAGFALAGSSWVGSGLGMWVSQMDFINNYLTGYQAKMHTSFFQIPLNFGVRVNVNRHNGFEMGLKIPLAVNSFYETHGKGLNTSLFFKRLVVFNVSYVYSF

SEQ ID NO: 21796 - protein, 199 aa, Caulobacter crescentus
MVLIFVDKDSNMNMTKGALILSLSFLLAACSSIPQNIKGNNQPDIQKSFVAVHNQPGLYVGQQARFGGKVINVINGKTDTLLEISVLPLDSYAKPDIEANYQGRLLARQSGFLDPVNYRNHFVTILGTIQGEQPGFINKVPYNFLEVNMQGIQVWHLREVVNTTYNLWDYGYGAFWPEPGWGAPYYTNAVSQVTPELVK

SEQ ID NO: 21797 - protein, 459 aa, Caulobacter crescentus
MNRQILTLAVAATLAAPMAVYADVKVSGTIQAEAASWEAAPDIKDANIAGFDDNDRQTLTNDVGGVIFNEGPNYIGFHIDEKLGSGVSAFALYTVPFDTSGNRGLSGQSDAWLGLKTRNFYFKYGTITGAYKSSRDLLDPWAFTSLQATGTGGGMSGVAHHHVFTEAERDISRWLPPEVLADSQRFDQVLNDPAFIRAKRTPIAVINPAAIDPYAALGLSNEGFVDGALELGVKFGGFTARIQGVVDDRSDMNGAGLLELRYTAPNFAMWLAGSFTDLEEGIKEIKDEATADLDDALGDINETIGREDAAKEARDAAAEARSSSVEADAGNYSNWKIGGKFNLGPMVELGLQYEQAEMGTFDWDVNPDGGKYILGSLAVNMNNITLAGWVSGYLSDIDDEYKLIDANDELIGEDALSWAVGAKYHFSKRAQVYLGYRQTDSDNDYRDENVVILGLRHSF

SEQ ID NO: 21798 - protein, 675 aa, Caulobacter crescentus
MTPRATRLGKPFGSGLLLTLLLGLVAPCSAAIDAIDLSLEDLLKVNIVSAPKFAENPDQIPSVVSILTNEDIRLYGWRTLGDALRTLQGFNVTDDHTYAYAGVRGISQPGDYRPRMQILIDGMSVNENIYASAPVDSAFPLDIGLVERIEVIRGPSASVYGGDAMFGVINVVTRSGQSVGTEASLGLGSGANRRLRASWGGQVGGNEVLISATGFNVNGNTLAFSDVNGDGSSRDLHRLGGEDGGQLFVKVRGDDWHFSFIHAKRDRIVPTASYDTIVDDRGHVESDRYTLLDLSKRWKLNATNELHQRLYFGDYGYDGAFPYDYSADLGDPHAMNVDKARGSWWGIENRLVNTGWSGHRLTVGLEYKGNWRQNQSNFDRGYGCINADMSISPTPCLDDRQHSRQLTLMTQDEIQLGTANLLTLGLSYNNLGSLGSFWSPRLGVVHDAGQAGLFKVLYGTAFRVPTVYERAYATPALAYGNPSLRPEKMRSLELSWEKRFSQFSRFTATAYHLHIDKMVTTDEAGVAENSAHTNASGLEIEYEQRWSNGSRLRTGYTVQHAAETNHGFDNSPHHMAKLNVAVPTGITHLMAGLEAQWISARLACLGTERIPSYTLANLNLSYAPSGKRWEVALGIYNLFDHRYNDPVALDSVMGVRRWQMPQLGRTALLSTTLHF

SEQ ID NO: 21799 - protein, 538 aa, Caulobacter crescentus
MALARRRLAWPGVCGALSLAAWLALAQAQDAMAAPGPKGVPAVSAPMLDGRPVDDENGWTTIALDGTAIDDTWTEIDLSDDALHGGTDGENSIGLPPPGLDGTPIGEEWIEIPPPDLDGESLDDDHTHVDTPQPELDGAPADGEDGGLPSPPAEAPQAGPDASKPQPEGPPEPDGNPQPDVEPGPEVEPGPEVEPGPQEQPRPQPDARPQDEPHAQPLPPAGSPGDGIYMPRSGILTAPVLAVLGTASAPQGIWQAEMNALSKRMGELRLTPAAGGVWARSFAQRQRLDNQVVDRFTQTVGGIEIGADTALPAAEGRWHVGAVAGYSRARRKLAYSARGNSDSLHVGAYATYIGDGGFYLDGIVRVNRYEHDFKADGQRGARVTGKYRANGIGLSLETGRRFTWAGDWFVEPQVEVALFRSGKADYTASNGVRVDVASTKSLLGRLGLQVGRKLDLGNGKLVQPYAKLSWLQEFDGVGKVRTNDIGHDVKLRGGRAELDLGVAAALGKHSSLFASYEYSKGSRLTIPWSFHVGYRYAW

SEQ ID NO: 21800 - protein, 284 aa, Caulobacter crescentus
MGRPGRLRAKKTANKNNKSGNHNMKRITTSLLLGSSLLATLPSHAGEWLQWHGESLTYLYGKDFKVNPDIQQTITFEHANKWKYGDTFMFVDKIFYNGKADPSKGVTTYYGEFSPRLSFGKILDRKLAFGPIKDVLLAMTYERGEGDNEAYLIGPGFDLDIPGFNYFTLNFYVRNTEGSRPGDNVWQITPGWSYTIPVGRSDILIDGYMDWVTDNDQTRRGTYHANLHFNPQVKYDLGKALNLGAKQLYVGFEYSYWKDKYGIDSRGNLDSNQSVASALIKVHF

SEQ ID NO: 21801 - protein, 717 aa, Caulobacter crescentus
MRGLKAGFFTITTGLMAGVSGVALAQSATPGSTTVLERITVEGSRWADGVEQARKRLNAIPGGVSALQPQDRTLTAVPTLADALASAPGVVVQRFFGGNDQPRIQIRGSGLQQNPVERGVLVLKDGLPINRADGSYIVGLANPGQASLIEIYRGYTANRLGASVLGGAINFASPVEKGTSISAGGGSFGQADASLRTGFDADRFAAGFYADASRRDGYRVYNESRRLSVGGVIEADVSDTVKTRVFASYTDLGFDVAGPLTKSAMDADPRQVSPGPPISLGPNVTRDKPRREASQFVIGSRSSIELGDHLFDIGLGYTYTRDMFRFPVSSGVRRTDGGDVTGLLRYAYQPDADALLPLFEASALYTVGSAERTYHINRAGGDGPAFSSNDLDASTLSLNVGLNVPLSETLTLSPSLSYTHATRDNEDLWRAAGRPRLSFGPGGAVASSVAAVDTSYERSYSGWSPALGISWRPGDSDMLFAAVSRSFEPPTHDDLLGTTGGTPNASPTGFSTPDLKAQTATTVEIGWRGERGSWNIDATAYYSWVENELLSLRDSSGSLLSAFNADETVHAGLEFGVSGEVLDGLTARLAYVLQDFLFRDDPVRGDNRLAGAPRQVVNLAVQYALFEQWDIGAVLQWVPSKTPVDNMNTLYADPYAVVDLRTEYRVNDRFSVYGAVTNVFDKTYASSTLILDEASAGQAVYLPGDGRGFYAGIKARF

SEQ ID NO: 21802 - protein, 803 aa, Caulobacter crescentus
MAMKQILLATLLATSVSANGAEKFVVQDIQIDGLQRVALGAALLKMPVRVGDSVDSQDVANIIKALYSSGNFEDVKVLRDGNTLMVQVKERPTIASVSFSGNKAIKEEQLKQNLEASSIRVGEALDRTTLSNIEKGLEDFYYSVGKYNATVKAVVTPLPRNRADLKFVFTEGVSAKIQQINFIGNQVFSDEELLSRFNLNVDVAWWNFLADDKYKKQVLAGDIEALRTYYLDRGYLKFQVDSTQVAISPDKKGVYITLNLNEGEPYTVSKVQFRGELMGKEAEFTSLIPFEIGETYNGSAVTRLEESVKKVLGESGYAYPQVRTIPEFDDEKQQVSLVVHVEAGKRVYVRDIRFVGNNSTRDEVLRREMRQMEGSWLNSKDIETGKTRLNRLGFFETVEVQTVRVPGSEDQVDLVYSVKEANSGNVNFGVGYGTESGVSFQVGLQQDNFLGSGNRVGVNAMINDYQKNLTLEYRDPYWNLDGVSLGGKVFYNQFEASEAGIVDYTNESYGTSLTWGFPFDELNRFEFGIGYTHNKIGNLTPYLQVENFLAAQASNIDSGGNLLTDDFDINLSWTRNNLNNSYFPTAGNHQRAFYKMTVPGSDAQYFKLQYDVRQYFPLTKKHEFTLLLRGRLGYGNGYGQTDGKDNLFPFYENFYAGGFTSLRGFGSNSAGPKAVYRDYSGSNNGSDTATDDSVGGNAIALASVELIVPTPFASEEARNQIRTSIFYDMASVWDTEFDYRGKADYGNQYYYDYSDPTNYRSSYGVALQWVSPMGPLVFSLAKPIKKYEGDDEEFFTFTIGRTF

SEQ ID NO: 21803 - protein, 711 aa, Caulobacter crescentus
MFNQKYLALSIAAFFSAFSNVAFAEQNNEIETIEVTGRAQQFYLETESKIGTKTDLDLIKLPQSAQVLTEQLIIDQAARDITDLYRSIAGVSEYSYSGVTFRGFRDDANVFYDGVRGDPYSGFGVPQLFNVARVEVLKGPASALYGGGEPGGMINYVTKKPSYTQSKELKLTLGNYNTHGASLDMTGGLTDIMAYRVGGYYEEQDSFRNNADSKNTEFTAGLLFDLTDSTTLTTTVDYIKQDLGGNRLRGVPVDDNGNFLVDPRYNANEAFDYQDMEALVLQAELKHYFNDDLSVSSTLRYMDNERDQAYHESQSWVDVNGDGEANIDDETIKREYRRQYRANEETSLTTDFVYSFEQGQLAHQVLFGGDYHIVDTEYDYLRARYEADGVTNLNIFNLNYGETDPSTYNLTDMNRDGVETDRFGVYVQDVVSINEQWTVIAGLRYDHFKELNKETGYSYSDNDVTPRVAVTYQPVENTSVYINYSESFNPASSGDQEDVEGEGNLTPETGKQTEIGMKNKWLNGKIMSTFAIYQINKENVVMSNPDDTGAGDGIAALLNIGEVESRGFETTLVGDLTEHWTLTANYAYNDTLVVEGVTGDTISSTYGEGSRFANAPRHQAGLWSRFALDNIDSSIAFGANYVSEQISQDGQKVKPFTVFDMGWTTRFDDVLLSVNINNIFDKEYGVSGFSERNGHFPGSPREIVGQVTYKF

SEQ ID NO: 21804 - protein, 206 aa, Caulobacter crescentus [sequence omitted]

SEQ ID NO: 21805 - protein, 794 aa, Caulobacter crescentus
MRAALLSLAMAAGAAPLCASAAEVVAERARPYAIPAGELGEVLNRFAREAGITLSATPAQTGGYSSQGLRGSFTVQQGLARLLADTPLEAEDQGDGSFVLREAPAKDGDVLNLQAVEVFALGNNLGSTDGYLATHSQIATKTSKPLLETSQTVSVITREQIDDTASRTVQQAMRYTPGIFTGQVGASNRYDYVVMRGFADNSVDNIYLDGLKAMGDSGTYSSMQVDPYFLERIDVLKGPSSVLYGRSLPGGLVALTSKKPLYEDYHQVTASVGNMGQKSMGFDFSGPLDEEKRIAYRVVGLGKGSDTQFDHVKEERYAIAPTLAIDFSDDTTLTLQGYLQHDPNGGYHGGVPADGTLSHHNGRHISREFFDGEPGKDDFDRTQRMFGYQLEHRIDDVWSARQNFRYLDSDVDLSQVYAYGWSASEPNKLNRYFTGAREHLQAYIVDNMLQAEFATGAARHTLLTGLDYQRRRTVVDWRSGAASALDAFNPVYGDDAISYYPDDNHTRRLEQTGVYLQDLIDIDQWRFSVGLRQDWVSVTDKNRSSGTKADDDWKKFTGRIGALYLFDNGLAPYVSYSESFNPNAYSDASGTPLEPTEGKQWELGLKFQAPGSNSFYTASLFHITQENVASKEPQDNFYTSVGEVRSQGFELEAHTQLSDNLKLLGSYTYTDITYTKSLDGNQGHTPNQAPKHMASLWADYAFDAGPLSGLSIGGGARYVGETWADKENTLRVPDYTLVDARIGYDLGKLGLKGLDVSLNANNLLDKDYVASCYSLDFCYFGEKRNVTATVNYQF

SEQ ID NO: 21806 - protein, 709 aa, Caulobacter crescentus
MLKRFSLSSCFIVLAVPLHAAEVSEPEGKQVPGGKDRPASGAEPAPVQLEPVVISSPLEEKVSEMARPVTVLTGSELRRKIGGTIGETLKQEAGVTSESFGPGVGIPVIRGQTGPRVQVMTNSIGTGDVSQITPDHANAVEPVLADRVEVLRGPATLLYGSGAIGGIVNVLDNRIPSLVPDKPMTVTGEQRFNSVSGQTTTNLKAEGGQDLVSYHLDGFYRDGNNLHIGGPAIAETQARQTDLALQGSPIQNSYGVIPNTENRAKGGSAGFSLVGEPGFAGVSINYLGNNYGIPPDGSPGGGNTRINLKESRYDFKSELNAPVDFVEAVRMRFGHVNYTHTELDDSVAAARFNKTTNEGRLEVVHQPIGILKGVVGVQMSSADFEAIEIGSPDALVPKSQLGSYGVFAVESFELGAGFYELGLRGESDSVDPQGGPNRSYAPISASGSAQWKFDDENSVSFAVTRSQRAPQVQELFTHGIHDATHSYELGNPNLTEETSYNFDWGYRYKGRGVSAELNVFQNFVNDYIYQQITDEVFNEDTEQFEKVCTNPGACFPVVQTTQAGAYFLGYEGNVRFPLMENHYGVIDLTLFSDFTRGQFVNGGNVPRMPPLRYGFQLDYACDEHWSGNLRLTRGEKQIYAGQNDAMTNGYVLLNLGVQYEVKAFKDAEVLVFAQGNNLLNDNLRNSTSYLRYFAPEAGRGVELGLRITY

SEQ ID NO: 21807 - protein, 1077 aa, Caulobacter crescentus
MNSTIKKTTLFLGACMAFQLGGIPQMLAAPSTSMEVMQQTKRITGTVKDATGMEVIGANVIVKGTTNGVITDLDGKFSLEAAPGSIIEISYIGYMTQEIPVTAQTSDLQITLKEDSQSLDEVVVVGYGVQKKKLVTGATLQVKGENIQKLNTTNPLGALQSQSPGVNIVANSGQPGKSFDINIRGAGTNGSTTPLYIIDGVEGDINSLSPADIESLDVLKDAASAAIYGSRAANGVVLITTKQGKQGKLQVSYDGYVGFQNVYKMPDLLNAKEYMAVMDQLNFNTGNQPYTWTNYMSQEQYNRYMSGEDEGTNWLDAIRNKNAITTSHSLNLAGGTERSKFSTGVSYTKQEGTLGKPVASDYQRFTVRMNSEHILWKEGDLDIITFGENLYYNHNESSGISEGNQYGNDISWMLRANPLVPIYNENGDYYMYDDLNKAGWFNYNSYTSNPIAAMVNSSRGNNKSKNYGLTMVGYLKVQPIKGLVYKGQVSYKQNSSSYRGYSPAYKLTSTDQKLTNEVTQNMTTGWDWQIENTLSYTFNIEKHNFDVLVGQSFKKSGFGMGEYLEATANDLLFSDWDRAYISNSMASQPTSAKGYPTGDNALASFFGRINYNFNEKYMASVILRTDGSSNFARGKRWGTFPSVSAGWVVSNEDFMESTHDWMDFLKIRASWGQNGNCNIDNFQYFSTVAFDHLGQYSFGNNKGTATQGGYASIMPNEDVTWETSEQLDLGLDARFLSGRLSLNFDWYNKKTKDLLIVAPILDSYGTNAPYINGGTVENKGVEIGLGWNDQKGDWTYGVNLNLAHNKNEVTQINNKDGYILGPDKVLAENTRPVSRMEVGHPIGYFWAYKTEGVMQNADDVQAYLDKNCKGNAANSLQGSSIQPGDLKFVDVNGDGVINEDDKTEVGNPHPDITMGLSFNVGYKGFDLAVTTYGAFGQQNMRSYRKFTDGNVENYTSEVFEYWHGEGTSNRYPRLVPGNTGVNFQQISDIFVEDASYFRIQNVTLGYDFKNLWKNCPLPQLRLYVSAQNLFTFTGYKGMDPEIGTNDSYREDNPWARGIDLGSYPSPRTYMVGVNIKF

SEQ ID NO: 21808 - protein, 661 aa, Caulobacter crescentus
MRLKCLAVVAGTLLSSTPHLRAQTVGTADPLPTVVVTGTRSEKTLDETPIRTEVVDRQEIERTHARTLKDALENVPGLQLREIHGKSGYEVTLQGMTSDQVLILVDGLPITASTGSTVDVSQYLLAEVDHVEVVKGASSAQYGSSAMGGVINVITRPISRGFSAAATADAGTYGSQNADGSPGSLHGNIRLEGGNEQFRARVTADALDNKGYAVEPDGWTRHGDKIRREQYAGRLEWLPSAAGSFWFDASAYRETDEQRYQYYAPPNYVPQRKTEDIDRNRYTYGGQWRFGNGVRARLAGVHETYDSTSREYSNGFQTATRNAAQQTDHVSAQFDMPAWYRQLWQFGGDFHRETLDQNVNGTSELAGKGSAERQAGELYLQNDILFNETWEMVVGLRGQHDSDFGAHFAPKVGVRANLLSNDTWKGVLRANYGQGYRVPNLKERHYLFDHSSLGYIVLGNPNLKPESSNSFQLGGQLTWRDRVTLDANLFYNHVADLIQTDMTNFTMVNGIAVYTYRNVARARTQGAETALRWRATNQLNLTAAYTYTSTEDLNTGSELTRRPRHMGRVGADWRVLPATELSARARFQSSELTDSATGARSPGWGTLDLVLNQKLDRNVTAFVGVNNLFNRQRDFANASDFGPVAGRFIYLGARFNVDVAR

SEQ ID NO: 21809 - protein, 554 aa, Caulobacter crescentus
MNMRKIQYILSGITLITLPLGIHAQQQAKDSTVNRTVVVEQEYTPDIPDASKINVLPQVEAPTANKKAVEYDVTLVPANTIPATVMQAYTGKETQAKTHPGYIRLGYGNYGNLDARAGYLFTLSDRDRLNLNFRMNGMDGKLDLPDNDGKWNSYYYRTHANMDYVHRFRKADLNVAGNFGLSNFNFLPDAAVRKQKFISGDIHFGVKSTDTELPLRFSAETNLMLYERQYDSGFLNSREYIVRTKALVTGGISDEQTVGIGFAMDNVLYKNNHFENYTSLSLNPHYRLENDDWKIRIGALVDMGFGFGKKFRAAPDVAVEYNFSDSYILYAQAKGGRLQNDFRRLEAFCPYGQVSSQPDATYEQINAAIGFKASPAIGLWLNLYGGYQNLKDDLLFQPADFESTANKYSPMLSIGQWNTSNIYAGAEIRYGYKNIFSFSATGIYRNWDAKDDSQSNAGAYALVYKPAFEADLHMDVHPVSALLLNLGYRHISREKVEGNKVDAVNNLYAGGSYEFFKGISVYARIDNLLNQDYQYYWGYPTEGINFTGGVSFKF

SEQ ID NO: 21810 - protein, 757 aa, Caulobacter crescentus
MRTKTIFFAIISFIALLSSSLSAQSKAVLTGSVSDAETGEPLAGARIEVKHTNIVAGADAGGHFEIKNLPAGQHTIICSLGGYGQKEEVVAIEAGQTKTISFALRLRTNNLEEVVVTGTGTRYRLVDAPVATEVLTAKDIASFSAPTSEALLQGLSPSFDFGPNLMGSFMQLNGLSSKYILILIDGKRVYGDVGGQADLSRISPDQIERIELVKGASSSLYGSDAIAGVINVITKKNTNRLSAYTSHRISKYNDRQTNTSLDINIGKFSSNTNYFFYHTDGWQNSPFEIKKKKGSGEPVLEETYKKTFRAQENQGVSQSLSYYATNNLSFSGNVQYNKRQIFTPTFSEKKAYDMDYRALTASLGTNYLFPNGLHTLSFDAVYDRFRFGYLYHDKDSSESLINNQGQTEQPTFFPGQLRNKNDQIRYTAEARGVFTLPYAQKLTGGLEYFREELISPYNLITDKADASTLSAYVQDEWKPLDWFNMTAGFRLVHHQEFGTRMTPKVSILAKYGPLNFRATYANGYKTPTLKELFARNELTTMGSHNLYLGNADLKPQMSDYYALGLEYNQGPISFSATVYDNELRNLISFMDIPTSPEHEAQGIKKTKQYANIGKARSRGLDVLCDASIGWGIKLGAGYSLVEAKNLQTDEWLEGAARHRANVHADWVHYWGQYRLGVSLFGRIQSERYYKDGNAPDYTLWRLATSHRFAHFRHIILDGTLGIDNLFDYVDDRPMGVNYATVTPGRTFFAQIAIRFNN

SEQ ID NO: 21811 - protein, 699 aa, Caulobacter crescentus
MRARPAGVLWMALGYGMAGPLSALAGGLQQPEVQLETTTVVGSAAAAAATGEAASQGYVPRAQLENRPLLRPGELLETVPGLIVTQHSGDGKANQYFLRGFNLDHGTDLATTVAGMPVNMRTHAHGQGYTDLNFLIPELVSGIAYKKGTYFAEEGDFSAAGAVRIDYADKLPHGLAQFELGEYGYRRGLLADSRAVGPGTLLYGFEWLGENGPWVVPEGVHKLNGVLRYTLPLGGGERVTVTGMAYRNTWQSTDQVPQRAIDQGLIARFGAIDPTDGGMASRYSLSADWLRPLADGQLKANAYVIKSRLTLFSNFTYALANPVLGDQFEQFENRVTTGINASRTWFGELAGHDSETEIGSQTRYDRLDPILLADTVARQPYALVRSDTVDETSTALYLRNSIQWRPWLRTLAGLRADQFWYRVGSSNPRNSGSGAEHIVAPKLGVVLSPTARTDVFVNWGRGYHSNDVRGATTTVDPASGNPVRKVSVLVPATGYEVGVRTKALARDLQLSASLWRLDIGSELVFAGDTGTTQPSRPSRRTGVELAAYYKPSPELILDADAAFSRARFRDADPAGDHIPEAIQTTASAGMSWTHGRWTLGARLRYFGPRPLIEDNSVRSASSFLVNLKAGYRVRKNVRVFVEVLNALNRKANDIDYDYASLLKGETSPVDASGAATGINDRHIHPAEPRTVRAGIAWTF

SEQ ID NO: 21812 - protein, 903 aa, Caulobacter crescentus
MVGRSCHRAGWLYRATFLLYAANCAYPANAQSVSGSGQVSNGPITSPHWVVGGELIVGDTGAGTLLIEAGGTVLNDWAYIGSDNGAVGTLTVSGRDGAGAASTWTTVDDVSIGVAAGSRGTLEVLGGARAQSGWGTIGVAAGSVGSVTVSGPGSVWNIATVNSFQIGSGGSGTLWIDQGGAVYSGQGVIGWNPGSDGHVTVLGPATVWNPLNNIYVGLGGTGELDIRDGAAVATAGSSPPGAAASIYIGTSAGSAGTVTVSSATAVTSTLTSTDRIEIGSAGAGVLTVAKGGMVGVASDAWIAITGTSSGTLNLTGDASGRGVLETGSVIKGAGNATFNLDGGVLRANRDEANFLNGFSTQAVGSGGAWFDTNAHDVGVVTAFSGTSSFNKLGAGTLTLSGNSAAFTGNTDIQAGTLQVDGVLGGPVDVLAGARLTGTGRVGATANKGTIAPGPRSGFGTLTIAGDYAAQGGNLEIRTQLGADDSPTDRLVITGASAGVTPVTVENIGGTGASTQRGIQVVQVNGASAGRFNLANGDYVIEGRPALVAGAYGYVLQQDAADGDWYLKSSLPDPGAPQGGGGLPGAGEPVLYQPGVPVYEAYANTLLHLSRLSTLRQRVGNRLYDPADVGRNGVWSRVEGSASQLDPSASTTGERQDVDSWKVQFGVDRILAGGQEGSRLVGGLALQYGKADTRVSSIYGNGTVDATAYGLTPTLTWYGRDGAYVDAQAQAIWFDSDLSSRLAGKLKDGRKAHGYGLGIEAGKAFGLREGLALIPQAQLSYASTRFDSFDDRFGARVEDDKGDSLQGRLGIALDYKSSWQAGGANRESSVFGIVNVKHEFLDGTRVRVAGVPVSSRMARTWGSVGVGADYGWGERYAIYGQVDADADFAGSYIVTATAGFRMMF

SEQ ID NO: 21813 - protein, 1051 aa, Caulobacter crescentus
MNSKFLLLLCSMLLCTSLAFAQSVKVTGTVTDKMGAVIGATIMVKNSSNGTVTDIDGRYSIEVPKNATLLFSFVGYSTVEKEVGNNTVINVELSDDIQAIDEVVVTAIGIKQQKKKIGYTTQQINSEVLNATPSLNVGSALSGQVAGLLVANPTGIFQAPSFKLRGNAPLVVLDGVPVETDFFDISSENIESVNVLKGTAASALYGSRGKNGAILITSKTAKKEGLEINFSTNNMITAGFAVLPETQHQYGSGSNGKYEFWDGADGGISDGDMTWGPKLNVGTKVAQWNSPIRDKVTGKEIPWWGDVKGTQYDDKSRYERVPIDWVSHDNLKDFLQTGLVTNNNISIAYKGEKARYFVTGQYAYQKGQVPSTEMHSGGINFNSTFDLAKNLQLDANLAYNKIVAPSYPRYGYGPKNHMYTIVVWMGDDVNGKELQKHKYVPGQEGYRQASYNYAWYNNPYFAAEELQQSESRDVVNGQLRLNYQILPNLNIQGRAALRQKTILQEMKVPKTYMNYGDSREGDYKVWNDRQTNVDADVLATYTQDLTPDILFTLNAGTSVFYRNYRQEYQSTDGLIVPFVYSIKNTQGPSITDANRNEKSIRSIYGSINLDLYKYAYLTLTGRNDWSSTLAKGSNSYFYPSVALSTMVSEYIKLPTFMDYLKMYGSWAVVSTDLSPYQIMSTYTKDSNYGSNPSISYPSSLVNYYIKPQKTTSWEAGLSTAFFRNRLSFDLTYYHTIDENQIIDLNISNASGFTSRKVNGNQYTTNGWEIMANVQAIKNKDFQWDFSLNWSKSVKKLTEIYGGQKKFGDLKVGDRADAFYGSQWQKSADGELILDENGMPTKDAYKQYLGHLDPNFRMGMQNTFRYKDFTLSVDLDGAYKGVIYSVLSEKLWWGGKHPESVEYRDAQYAVGHPIYVPNGVVVTGGELKRDIDGNVISDTRTYKRNTTAVDWQQWCQNYPYQAYVSSKENAKFANVFDRSYIKLRRVALTYNFTKLLSKQSPVKGLTATVFGNNLAVWKKVPFVDPDYTGDSNDGGANDPTARYIGMGVNIKF

SEQ ID NO: 21814 - protein, 786 aa, Caulobacter crescentus
MRPFARTLRRAILATSTLSVLAFAPAAIAQDAGVEPAGASEDSGDNEIIVTARRRDERLIDVPVAITAYSGDALAKAGAIDITDIGATTPNTTLEASRGTNSTLSAFIRGVGQQDPVSGFEQGVGIYLDDVYLNRPQAAVLDIYEVERIEVLRGPQGTLYGRNTIGGAVKYVTKPLPQEFSLRIKGTYGSYDQADLVVSASAPVSDLLRVGVAGARLSRGGFGDNLTNGLENYNKDVWAGRGTVELGGYGEPVLIRISGDYTKDKSAPRGGHRLIPSLATGAPVLDNVFDTRGGLNDPKQEIEAYGLAMNVSAELSDTVTLRSISAWRKDKSATPIDFDALPAVDVDVPGFYFNEQISQELQLLYEGDRLKGLLGFYYLDATADTLFDVRIFNTFAGLTAFTEADVDTTTFAVFGDFTYDFSDQFSLSVGGRYTWDKRTASILRQNYLGGGSPVFGGAGVPFGAPSTNFDGSRKFNKFTPRVSLQYQPTSDHNFYASYSQGFKGGGFDPRGVGVNAPAAIPGSPTDAEVASFLSFLPEQVDSYEVGYKGSLMDGAVNVALAAFYADYSDVQIPGSVACTVGGLPTFCGVVSNAGKATFKGLEFEGRARLAEDMAAAGDRLTLSTALGYIDAQYKEYVTNIGGVPTDVADFREVQNTPKWTASGTLAYSTPVGDGEIRFGTTLSYRSKTHQFEIPNPYIDQKGFALWDASLVYTAPDDRWSLGLFGKNLTNKKYKTSGYTFIVVDPVTGVPALGANGLPRSALGTEGTLTAFYGNPRQVFVTGTVKF

SEQ ID NO: 21815 - protein, 804 aa, Caulobacter crescentus
MTKYYLLTTALFSLILFSLNAQVITVQEKDTEVPLPGVLVFGEEPHLSKITDKYGRVDLSGFSNASKIHFQLLGYESKSTDLETISDSSSIVFLVPGLIQMEQAVITASRWRQSDQETPNKISVFNQEALQLRSPSNTADWLGSNGDVFIQKSQQGGGSPMIRGFSANRLLYSVDGVRVNTAIFRGGNLQNVISLDPLALQNTEVLFGPGSVMYGSDALGGVMAFETLKPNFSDSGIEVKGTFFSRFATANKEKTFHGDISFATKKWAFLSSASHFDYGDLEMGNKGPEDYLRPWYVIPSKDGDQSILNPNPDVQKQSGYSQLNLMQKVRYKPSNRTTWDYAFHYSKSSDIPRYDRLIEGSYEKPKYAEWKYGPQVWLMNQLSVSQLGRGKLYDQMSIKLAQQHFEESRINRRFNNPTLTDRVEKVNALSINADWVKTLFKENFLSYGAEIVYNSVNSSGTEQNIQNNEELPASARYPKSDWTSLAIYSTYHAHISDQLKFQGGLRFNQVLLSADFSSNEEFFPLPYQETTNNNGALTGSAGLVYNPSSSFTISPQVSTGFRAPNVDDLGKFFDSEPGAVIVPNPDLKPEYVYNAEVNLNKHWGNFLKVDASVYYTFLDRAMVRRPFELGGQDTIIYEGVPSKVLAIQNAASARVYGLQAGLEWSPSKNWLLYSKLNWQKGEEELEDETTSPTRHAAPLFGLTRITYSTKRLKVELSSNYSGEISFEDMPVDEKGKPHLYAKDENGNPYSPSWMTINLHSTYQLTGFLDLMLGIENIGDKRYRPYSSGMAGPGRNFSFSIKASF

SEQ ID NO: 21816 - protein, 1036 aa, Caulobacter crescentus
MKKISFLLVYLLTSVIVCAQHKKISGTITGTQNETIIGATVLEKGTTNGVVTDIDGKFSIQLTNDNATLVISYIGYKTQEIKPQGNTLSIQMDEVSEQLNEVIVIGYGTTTVKSNTGSISSVKADDIMNYPSANFANSLAGKATGIQVIQSSGTPGSAPQIRVRGIGTLTAGSNPLIVVDGFPLSEGSTINSINPNSIESIEILKDAASTAIYGSRGANGIIMITTKSGRNGKPSVTVSASYGVQTRSDRVKLVDAYDYAQFLKEARNTGYVNKDPQNRSESDNNTVRKQKGASKRELIPDYIVPYLNGEQGLTNTDWYDEIFRTAPIQDYNIAVAGGSEKASYSFSGGYLKQEGILLGSDMDKFSANVNLRFNPSNYITMGLSMSPSYTRTNSFSSSGTWGGSLIGLASISYPFFSPYNEDGSYAISTQINANKEADGALCENPLAWATMITNNQKRARLFGNFYTEVKLLDQLKYKINLGTDYESAHYNYFNPSSIGAYRVPAPKPTEASRNTTESLNYIIENTLSYNQSFLNNAHNFQVLLGQSYQKEEYEGLKVVASGFTDDSIENIAGGSSFKVTPSQYNWAMTSYFGRINYNFRNKYMLNTSVRWDGSSRFGANSKWGFFPAVSAAWLISGEDFLSNNQTVEYAKMRLSWGKSGNNQIPNYGALALMGSADYVTDGSIASGSIIGDSPNPDLSWEMTSTWNIGFDVTLMKYLDLSADFYIANTQDLLLNVPVPQQSGYTTSLQNIGEVRNTGFEVRLATAKDIRLGAVDWNSNLSLSVNKDKVLALAPGQTQIISGNNITKIGNSIGELYGYEVIGVYKSDADFQKYPYMAGTQIGDYIIADLNGDNEINADDKKSFGSPAAKAVIGFNNTFRYKDFELTFDIYSELGKKKNSGTLQSLECGEGFMMVTQDYFDNRYHPVNNPEGTMATPNMGNYSNARKATAASNIYFKDASYALLRNLKLAYNLPSALLGKVGINKAQVYVLGNNLFMLTGYKGFNIDAEGSNILEQGNEKYVYPVPRTISVGVNINF

SEQ ID NO: 21817 - protein, 866 aa, Caulobacter crescentus
MRAFNKITVFILFIPGLCFGTNGLESKKNIPEEFIDLWMEQDELLEVNLYGRSLGVHRVLTTPTTVKFSSVEEILEKINVKQEKKEDLRSLLLQSYSRNGNMSCNGFDEKEYSCNYIRTDTVNVIVDEENNELNLFIGASFLSVQAQDNIYYQKNINSEKAFIHSQTINFSESEGYKSLSLKGVGAQGLTENSYLVFGWDAIYNSSRKYTYKNQSINNIYYRYDFDKKYYYQLGRMDRSDLSSASSGNFNFNMLPLPDIDGFQIGTTQSYIKNIEKSISSPVTVMLTRFSRVEAFRNEELLGVWYLNSGINDLDTSRLPDGSYDLTLKIFEQDILVREEKVPFNKGGASFGDMQWDVFAQAGNIVNNNDSYIEKQTNKKTGINAGIRTPVTRNLSFLQGGAIIDNDKYYEAGVNWRSGFLDGVLSGNFSFLYGDGARGNYQNISYTDGFNLSFYRNDKSVDNCSHNYSAGWSGCYESYSFSLSVPVSGWTTTLGYNHTNNEAVHKYDYTPEYFFSKKYKGVSKRWQLTSSSSYKWMDYHVIPTIGVYRSDQSRWSEQGGYFSLSFTRVKENSAINAGYSYNYVKHKNATHEAFLDGRITTNTFGYSELGSRINTNKNNTEAGVTGRVKNRFGDLNGSLNVNKSKTSGKMTHSMSANYNSSFAITGDSVYWGGDASGLTKLSGGVVNVRSDDKSKELIKISGSSYGNYILGSNDRSFIPVSALMPSNLTIEEIQSNDKNITVQALSKNDFFILPGNVFPIDVTANVTVSYIGRALDDKGNPLSNAHILDVHGVRLDEDGGFSFETSAQKKSLFLLKDKDIYSCDVKKYDLRSGVLFTGDLICEHSGIERLGKDLVNNPRVKQLLAYK

SEQ ID NO: 21818 - protein, 419 aa, Caulobacter crescentus
MKTIQRSLVSLSVLFACNSLAAGFQVAEHSASGLGRSFSGEGAVADNASVLARNPAAMTLFDTAQFSGAVSIVDPEVDITQKNVPGSGGQSQKSSDVAPLQVVPAAYYISPINDKWAWGIGMFSNYGVATDYPDDIYAGDLAGDTSLISVNINPNVAYRINQQFSVGVGVNFVYAEAELNRHQGSISNITGDPASTKLVSMTGETFAFGWNVGALYELNENNRFAIAYRSEVDLDFDDGDFNDYTGSIVQGSATSTTGRLKITLPSIIEISAFHQLTDQWAIHYGWQQTGWSSFKELKATSPDCVNGECFKKTEHYDDNNRYSLGATYQLNQAWTLRAGLAYDEQAGEATLSIPDSDRFWYSAGLTYQYSPNLSFDAGFALVQSKDGDFKETNELGQELEFSGDAVAYLSAIQMNYTFN

SEQ ID NO: 21819 - protein, 731 aa, Caulobacter crescentus
MSKNRYTARRYTRSVAPRLTPLAALAASLTTTLATAFVAPAALAQTATAPAADAAPATPASAPAAATLREVVVTANPLGSDLNDMVAPVSTLGGDALTVRQASTLGETLDKLPGVSSTYFGPNASRPVIRGLDGDRIKVLQNGGTTVDASTLSYDHAVPVDPLVAERIEVVRGPAALMYGGNAIGGVVNVIDNRIPKEPIEGVGGAVDASATAGGDQARNASALIEAGNGKFAVHADAFARKTSDLRIPGYARSDRLRNAEPLPEGEAEPYGRLPNTSADQQGGSLGGSYTWADGFLGANYSAYRNDYGTPAEDAVRLKMKQDRFALEGEARNLAGNTGGWFESVKGKVSFTDYEHREIEDGETGTIFKNRGWDARFEARHAKIGNMTGVVGTQFGHTNFSALGEEAFVPSTNTDNAALFLFEELPLTAGGDLKLNFGGRLDHSSVKASANGNDRFADASRSFNATSASAGLLYKMNPAWSLTSNLSYTERAPTFYELYANGPHVATGAWEVGDPNANKERATSIDLGVRFKSGAHSAGVSGYYSRFANYLALSATGRARDEAGDVVAAGSPDALPEFQYLGVPATLYGFEAEGKTRLLQKMLTSSDTLDFEARADYVRGENRDTGEPLPRLAPLRLGGALVYGAGPWGARVDVTYAAKQTRVPSNDTPTDAYTLLSLALTYKFKAAGTQTLVYLRGDNLTNQDARNAASILRDIAPMAGRSVKVGFRTSF

SEQ ID NO: 21820 - protein, 742 aa, Caulobacter crescentus
MRRRIAVILALVTTAAPLQARGDGQDNSKETSLDEVVVTATRTEKSIADAPGSVSVVTAAEMKKRNIQSVDEALNMLPGVFDSRRKGLMGTTSSVTFRGLSGAGRSLLLLDGMPLNDAYSASQPWGGLNAQNFSQIEVVRGPSSSLYGGNAMGGVINFLSHMPEKREFTLSSGYGGGLETDAAMDRLWSSYTSYGDRIGKLRLYAALSYRSTDGYPSGLVTTTTNPSASGISGAHPTTDTTGKATKYITGDSGDNGWWDYSAAIRAHYDFSDTANIRISWLRTANKYSYDPPHTYLRDASGAEAYRPGQSSYLNGDGANVQDMYTIHAEALLGQVKGKFLFGINDQHENWYTTPGSSATVANGGTGTKSDSPSRTYFTDLQLSVPVLEKHILTGGFSFRYDVADSDNLPLSDYEDEDSVSGPSTQWGGGTTQTYSTYLQAEIALLDNLTFYAGVRDDYWVSNNGYAGFSGTGASDQKYPEKSKNSINPKGALVWKPLDGTTVRISGGRAFRAPQLNQMYKTWSSSSTSKLYLANPDLNPETVLAWDFGIEQKLWKGAKIKATYFENYIDDMIYTVTLSSTTSIGGKNYTNVKYSNLGAGETRGVELEAEQSLGKNLRLFAGYTYTSSTITEYDENKSLEGKDLQHAPRHMINAGLDASYGPLSFFLSGRYVAKQYGSDNNSDKANGVYGSYDPFFVMDLKAGYRVTDWATLSLSVNNLLDRTYYTYYVAPGRSWFANLDLRF

SEQ ID NO: 21821 - protein, 1013 aa, Caulobacter crescentus
MFASAASTSVSAQQADGTPAPTGQAEVQATDLDAVTVTGYRYAIEKSLEQKRNANAVVDVITAEDVGKFPDKNVADALQRVPGVVISRDGGEGKNVSVRGLSSELVLTELNGNYIATAESNGDPTRSFNYTLLPSNLLGSAELYKTPEARIDEGGIGGTVILQTRRPLELEPNSGFVSAEGTWSDTSKKTDGQFSGSYSWHDQDNRFGVFVGYTQQKRTARTLNASTESWQWYGRDEGGPAVDVNGNPSDFNANWWGGTGFWNQDGNYSTGFMMPTAVSLDAKREERERKGGQLTLQFKPTDDLTLTANYFRFDLSQDSQTNTIKIPEWNIARYNGDGNWRGGRLLDGLQFDPSGTIVTGAAYSLRPGKTYYCSEAQAAAAGLPPGGWGSDDCTVPTPQITGSYNIEKSQSQTVDLGGEWRGEQVDVAFKVGRTWAKGGPELQFSLPIKPRLQNADGSWTNGNFASAWDLTGTPSMTFSPQLMQNLRDGILQVDLGSTGSSWTRNTNQQQYAQIDTTWHFDGEVFDSLQFGIKRRDGGIHRSTGNNYWVCPGTDPSDYDNRYWNGRCNAIATQFSPGLLFAQDNLAGGVNASAFPAINFPGYIGYLNQTYGAMQTRSEDNFVYNVDEEIYSSYLQLNFHTERLRGNVGVRVARTGQRADSTDKVTAYNDYFFDAADGNPLACQQGAAMPSGAPADTYCGTEGYWRLSDSVQRTESFVISGLDRNYTDVLPSFNLAYDLTENLLLRAAAAKVIARPSYNDIAAPGSLEFYSPEYVADRRLTGGASEQGWYGSGSNKNLEPYKANQFDLGLEWYFHPGSVAGLGLFRKNVENFAVDVISDVNMMVDGQPVTVQNYSTQAGGQDAVSQGVELYAQHTLPFGLGVQFNYTYNDASKAAVRLEDGTEAGKTSMPGSARNQTNLTVFYEADSLLLRASYNRRGELVQGLVNGLNVFEEPYYQIDLNAAYNITPALSLTASVLNLTKQESRSDLGDDTRARFYTGGYAGRLAYLGLTYKF

SEQ ID NO: 21822 - protein, 826 aa, Caulobacter crescentus
MMTKKMSLLLTGMLLCLAPDIKGNETDGRIKGIVMDGELGGPLEFVTVQVKAKGSDKILQGAVTGSDGNYSIGGLKKGEYIVTYSYIGYAEISKNITISNNSQTLNLGELTLEEDANQLGEVEIVAKKPQMRFELDRKVFDATQDIASEGGSASDLLANIPSVEVDNEGSVSLRGNSSVTVWINGKASGLTADNQADILEMMPAEDIKQVEVITNPSAKYSPEGTAGIINIILKDDRKPGYYGSVKAGADTDGGYQASGNINYSSSKVDAYANLSYRNREMKGGGITSRENTANNSFLDQTNNSKRQHNNWFGRIGATWHITKSDDLAFNMTGMTGGGDNNESIHYISTDKQKNTVYTSDRTTDGNSDMKMYNLELNYLHKFSENSNIDLTVSNNQWRNDGLSIYEQSTRYTDTDLTDKQEYQTQENNIKNKSWEVQADYTNKISDASRIEAGYKGTFQRESSPVDTYTGTTATDIEQDQALYNRFLYNQDVHALYMTYGGKWNNLSYQAGLRGEYWRVDTRSLDFDQEFNGKPSETFEKDYFKLFPSAFISYALPKNNEIQVNYTRRLRRPWGGQLNSFRNISDASNISFGNPELTPEYSHSFELNYIKTWESGHTLSLSGYYRSTDDVIQRIRFLNTADNVMYTTSENVARQQNSGLEIVGKNNLFSILSLTTTVNLYYSKLDGFSYLPEGAEAPVTGEEDESFNWNVRMIANVSLPWGVSLQGTGNYNSKRLMAQGYREPNYSVDLGLRKSFLKDKLTLSINARDLLDSRRFRTITSGDGFWQDSENWRGGRRVGFTLTYNFGNMNKKKDKSRSEEPDMYEMD

SEQ ID NO: 21823 - protein, 1438 aa, Caulobacter crescentus
MVSGGAMAVSQIATTDTPAVTPIKSTLTGPFERNSAGTSFGSNVDVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFNGGIFSVEGDTAATKTNMTGGKFAVTGNAKIEETVVSAGDVSLADKATANNTTLTGGTFAAAGDTAVSATNMTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 21824 - protein, 1619 aa, Caulobacter crescentus
MWAATQQNRTTVGAATTLDGVGFDQDAANANLAVVPNAVITANVNHGIDFNAPAGSLNGLLLNTANDLAVTVSENTTLGFVTNAANQANFFNLTLAAGKTLAITGQGITAAQAGATKNAQNVVAQVNGGNAVANNDLSGLGTIDFGGVPSALVFNLVNPTTQNAPLILGGNAKIANGANGTLDVTKGFIQVSDKSFATVKTINIGDGQGFIFNTDATNGNALNLQQVAGSTINFNGTDGTGRLVLLSKNGTTDFNVMTGSLGGNLKGIIEFNTTAVAGQLIANAGPANAVIGTNNGAGRAAGFVVSVDNGNAATVAGQVYAKDIVIQSANAGGQVNFNHIVDVGIDGTTTFKTADSKVIIAENSNLGATDFCNLGVQITVPDTKTLTGNFTGDASNKGNTAGVITFAANGTLASGNSDANVAVTNNIKAIEVAGAGVVQLSGTHTAELSLGNAGSVFKLADDTVINGKVNENALIGGAVAGGTIQLDGSATITGDIGNGAGNAALHGITLADDASKTLTLGGAKIIGVNAGGTINFQANGGTIKLTSTQNDILVNFNLAIAADKTGVVDASGLTNTQTLTIAGSIGTIAANNKTLDQLKIGSSATTLNIGDVAINELVIGNNGSVNLGHVNYLIAKTTNASGQGKIIANSTIVGNIGGNNCNVTRLMAGTNLGSAEAPLSEFNFAAPTGGAIGTVLEVLGGASIHANNITTIAPNNGFFRFVGGGTSIISGTVGTPANKIGGVYLDGNSTVQFAGNSVFDGHTFISGNSTLQIGGDYTADFIASDDNTGIVEFVNTSPIAVTLNKQAGLVDDLKQITVSGRGNVVINEIGNAGNNHAIKTNTISFENASLGAGLFLPSDTPLDGLTIKSTVGNGTPGNLNAPIVVVSGIDSVIADGQAIGDQNNIVGLCLGSDNGVTVDATTLYAGIGTTKNNQGTVTLNGGIPNTPGTIYGLGVGSDSPKLKQVTFATDYNNLGSIVATNVTINDGVTVTTGGVVGTDFDGTITLGSVNGNANVRFVDSTFSSPASMIVTTEANNGTVTYLGDAYVGNIGASDANIASVKFTGNHNGAGLQGNIYSQVTDFGTYTLTVLNSNVILGGGTTAINGAIDLLTNTLTFASGTSTWGSNTSIETTLTVANGNMGHIVIAENAQVNATDTGATTINVQDNANANFSGTKTYILIQGGARFNGTLGGPNFAVTGSNRFVNYALIRDANQDYVITRTNNAANVVTNDIANSPFASASGVGQNVTTFVNATNTAAYNNLLLAKNSADSADFVGAITTDTSAAVTNAQLDVAKDIQAQLGNRLGTLRYLGTHETAEMAGPEAGAIPAAVAAGDEAVDNVAYGVWAKPFYTDAHQSKKGGLAGYKAKTTGVVIGLDTLAHDNLMIGAAIGITKTDIKHQDYKKGDKTDINGFSFSLYGAQQLVKNFFAQGSAIFSLNHVKNKSQRYFFDANGKMNKQVAAGNYGNITFGGNLMVGYDYNALQGVLVTPMAGLSYLKSSDENYKESGTTVANKQVNSKFSDRTDLIVGAKVAGGTMNITDLAVYPEAHVFVVHKVNGRLSKTQSQLDGQVTPFISQPDRTAKTSYNLGLSASIRPDAKMDMEVGYDAQIASKYVAHQGT

SEQ ID NO: 21825 - protein, 799 aa, Caulobacter crescentus
MTEGRRMARNRTGNGRTGQDRGMIRPAAVSVFLGVAGIAAGMTLPALAQNYSFSDVRIEGNDRVDATTILGFARINRGQAISAGELNEAYQRLADSGLFETVEIVPQGGTLVIRVQEFPTINIINFEGNARIKDDKLAGLVKSQSRRAYNPAQAEADAAAITEAYRVQGRIAATVTPKIIRRSDNRVDLVFDIAEGKVVEIERLSFVGNRAYSDRRLRQVLETKQAGLLRSIIASDTFIAERVELDKQLLRDFYLSRGFIDFEVLDATAEVTRERDAFFMTFTVQEGQSYSFGQITASSEVEGIDAADFQQALRIRRGVTYSPSVVENNIARLESLALQKGLNFVRIEPRITRNERNQTLDVNFALVRGERIFVERIDIEGNTTTLDQVVRRQFRTVEGDPFNPREVRQSAERIRALGYFANADVNTRPGSSPDQVVVDVNVEEQPTGSLSFGVSYGVSSGVGFSIGFSEQNFLGRGQILGVDVSTGTDNVNTQLNFVEPSFLGRDLRFRFNAYYRETDNQYSRYDTRKIGISPSIEFPVSDSGRLELRYTLSEDKISNVDGGPNDTDDDDDVSSIILINEEARGALIASSVGYTYSWDSNRGGLNPTGRNLLRFSQDFAGVGGDVEYVSTTALAMAERKVWNEEVTVRAIIEGGALSMIGDDPSRVTDRFFGNGKIRGFEPNGIGPRDLNVSNEDALGGNYFAVARLEADFPLGLPEEYGFSGGVFADAGSVWSLDDVGGGTTGDDTVDDDFHIRSSVGVSLFWTTPIGPLRFNFAKAIEKQDYDKEQFFDLTISTRF

SEQ ID NO: 21826 - protein, 821 aa, Caulobacter crescentus
MDMIDNLKRVVWCILLPGLMSLKAQGQTAAPGSGEISGVVLDETNSPFPYTTVSLLNAKDSTVVKGTLTADNGSYVFNNIPEGHYLIAFYAIGYKKAIKGPYLIDKNKTHHQLESSQLLQDAKQLKGVEIVNKKPLIERQIDKTVINVENSAIATGNSALEILQKSPGVSVDKDGNISLRGKQGVNVMIDGKPTYLSADQLANLLRSTEGNALQSIELITNPSAKYDAAGNSGIINIRLKKNRSYGTNGSISAGAGYGRFYKANSGLTLNHREKKFNLFGDLNYGRDKRFGTTDIVRVNNTINNKTYFDQRNYTTRERKNINYKGGMDYFFNDQHTLGLIVNGYTNNGRNEGDALTLIGSQPLKTDSSIVATNPYRSKYSSIAINLNYKGLLDTLGQEISFDLDHSQYRDNENSGFNNHYIDANGQTLKPDYLFRSTTPKETRIWAAKTDYSYPLRRDMKLELGLKSSFVKTDNNFVFENFTGDQWINDPGRSNHFLYDENINSAYVNLNRKLKSTTVQLGLRMEQTNSRGNSITENRIVNRHFLNLFPSIFINQEISNNHDMGLSYSRRIDRPDYESLNPFMSFVDLYSYRYGNPFLKPQYTNAFELSYSYKKSLNISAGYSHTTDVMSDILLTDTAKKTIFISKQNLSTQDYYNLNVSYPVQLTKWWISSNNLTAYYNRFSSEDILGVPYRSGRLAFNLNTNQSITLNETASVELSGYYQSKQIYGTLIIDHQYGIDLGLKKSFLDKKLDLKLAANDVFKLQKSRITSAIPSQQYLVNETWETRVFRLNCTYRFGSTAIKAARARSGGAESEGRRVKSQ

SEQ ID NO: 21827 - protein, 734 aa, Caulobacter crescentus
MSITTTPRKRAASSCAWGLRHLTVATPLAALLAAASAQAQSGDALHHLPDGQGAITVTGVRQAYRGDFQLREIPQAITQIDGETLQQNNIVRLTDALDMNASVARQNTLGGLWDAFAVRGFAGDENLPSGYLVNGFNAGRGFAGQRDVAGIDRIEVLKGPAAALIGRGEPGGTINIVTKQAELGRSFGTGSLQYGSYDRFRADADANLALTSGLTARLIGYYENGDTFRDYVSQKRWGLLPSVGLTLGDRTRLTYDFEWTRVEVPFDRGIVVLNGDFDTVPRSRFLGEPGDGDTVARATGHQLRLDHQFSDDWSLQVGASHRDTKLTGSSSDAEQARARQKLYVDGHSLSRQRRSRRYDAEHSVLRAELAGAFDTASLRHRVLIGGDFDHFRYDNFFTRYRPPAVSTNPDDQAGYVIDIDNPVYGRYPLPATAVLTNRLDTQRSFGFYVQDQIELTDRLQIRVGGRYDNLTLKVDNRLLAPAIRHNSRRYERFSPQAGIVYDLNAAISLYAAYGEGYRANIGADFLNNIFDPETSESIEAGAKLAMLGGALTGTLSVYQLSKKNVLASDNDNPGFSVAIGKARSRGVELDLNGHLPGDIDVLLSYAYTDAQARSTVNDPNFGFQILPGDRLINIPDHVLNLQAAKHFSLAGRAAQLGAGMNYVGKRLGETGTDFTLPSHTLFRLFGSVDVMENVELFGTVSNLFDATWYASSYSSVWVQPGTPRTVTLGVRARF

SEQ ID NO: 21828 - protein, 418 aa, Caulobacter crescentus
MELFHRFKPHTLAVATLFIMCSSSWAANPNQQTEDEWKFTLKNAYINRDFDNDVLKDTGSWSQAASLFYKSKMHDTPLVIADKPITIGADASVQYAVRLSSDKHVADTVLPFNKETQSQASDYLKYGATLKIGYDKTLLSVGELWLDLPVTAVDASRQLLTSYWGTNLKSQLSDQLYAEIGRVEKVSPRNEEDFKKFSFTANGMTKESDGLNYIDLRYQFTPSLKGEYYFGNLEDLYNKHYVGLEHTWKQPTFALTSKFKYFNAKDDGNTFDIDAQNIGLLETVKIKNHTFGLGYQQIIGESAYPLPDGFLPETYFINWNATGFFKEDEKSYHVMYGYDFKDYVPGLNAMVKYVYGHDFKAANGEKNHETESNVILNYTFQQPLLKGFALQYIRIDYNVKHGNDFGEDRLFVNYTKKF

SEQ ID NO: 21829 - protein, 185 aa, Wolbachia endosymbiont
SYYVRLQYTGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEA

SEQ ID NO: 21830 - protein, 192 aa, Wolbachia endosymbiont
SYYVRLQYNGEILPLFTKVDGATGAKKKTADTDTTTDLYKASFMAGGGAFGYKMNDIRVDVEGLYSQLSKDTLDVAPTPAIADSLTAFSGLVNVYYDIAIEDMPITPYVGVGVGAAYISTPLATAVSSQNGKFAFAGQARAGVSYDITPEIKLYAGARYFGSFGAHFDKDTAAASKDKGELKVLYSTVGAEA

SEQ ID NO: 21831 - protein, 185 aa, Wolbachia endosymbiont
  misc_feature (107)..(107): Xaa can be any naturally occurring amino acid
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGXGVGAAYISNPSKADSVKDQKGFGFAYQAKAGVSYDVTPEIKLFAGARYFGSYGASFDKADKDDTGIENVVYSTFGAEA

SEQ ID NO: 21832 - protein, 196 aa, Wolbachia endosymbiont
SYYVRLQYNGEISPFKTKIDGIEYKKNNDAQDPLKASFMAGSGAFGYKMDDIRIDIEGLYSQLNKNDVSGAVFTPATVADNVTAFSGLVNVYYDVAIEDMPVTPYVGVGVGAAYFSNPSSADTVKDQKGFGFAYQAKAGVSYDVTPEIKLYAGARYFGSYGAKFDGEKKQGSGADEVTITDKGAYKVFYSTIGAEV

SEQ ID NO: 21833 - protein, 198 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLINVYYDVAIEDMPITPYVGVGVGAAYVSNPLATKVAGDKDSGFGFAYQAKAGVSYDVTPEIKLYAGARYFGSYGANFDGTKQDPAHPDDLEKKLLIKAHTKFFTVLLVQK

SEQ ID NO: 21834 - protein, 202 aa, Wolbachia endosymbiont
SYYVRLQYNGEISPFKTKIDGIEYKKDNKDAQDPLKASFMAGSGAFGYKMDDIRVDVEGLYSQLNKNDVSGAVFTPATVADNVTAFSGLVNVYYDVAIEDMPVTPYVGVGVGAAYFSNPSSADTVRDQKGFGFAYQAKAGVSYDVTPEIKLYAGARYFGSYGAKFDGEKKQGSGESEVTTDKGAYKVFYSTIGAEAGVAFNF

SEQ ID NO: 21835 - protein, 197 aa, Wolbachia endosymbiont
SYYVRLQYNGEISPFKTKIDGIEYKKDNNDAQDPLKASFMAGSGAFGYKMDDIRVDVEGLYSQLNKNDVSGAVFTPATVADNVTAFSGLVNVYYDVAIEDMPVTPYVGIGVGAAYFSNPSSADTVKDQKGFGFAYQAKAGVSYDVTPEIKLYAGARYFGSYGAKFDGEKKQGSGENEVTTTDKGAYKVFYSTIGAEA

SEQ ID NO: 21836 - protein, 199 aa, Wolbachia endosymbiont
SYYVRLQYNGEVFPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQGKAGVSYDLTPEIKLYAGARYFGSYGANFDGTKQDPAHPDDLEKKVTDKGAHKVFYSTIGAKA

SEQ ID NO: 21837 - protein, 199 aa, Wolbachia endosymbiont
SYYVRLQYNGEISPFKTKIDGIEYKKGNDAQDPLKASFMAGSGAFGYKMDDIRVDVEGLYSQLNKNDVSDAVFTPTTVADNVTAFSGLVNVYYDVAIEDMPVTPYVGVGVGAAYVSNPLATKIAGDKDSGFGFAYQAKAGVSYDVTPEIKLYVGARYFGSYGANFDGTKQDPAHPDDPEKKVTDKGAHKVFYSTIGAEA

SEQ ID NO: 21838 - protein, 200 aa, Wolbachia endosymbiont
SYYVRLQYNGEISPFKTKIDGIEYKKDNNDAQDPLKASFMAGSGAFGYKMDDIRVDVEGLYSQLNKNDVIGAEFTPAIVADNVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDPEKKVTDKGAHKVFYSTIGAEA

SEQ ID NO: 21839 - protein, 194 aa, Wolbachia endosymbiont
SYYVRLQYNGEISPFKTKIDGIEYKKGIDVQDPLKASFMAGSGAFGYKMDDIRVDVEGLYSQLNKNDVSGAEFTLATVADSVTAFSGLVNVYYDVAIEDMPVTPYVGVGVGAAYFSNPSSADTVKDQKGFGFAYQAKAGVSYDVTPEIKLYAGARYFGSYGAKFDGEKKQGSGESEVTTTDKGAYKVFYSTIGA

SEQ ID NO: 21840 - protein, 194 aa, Wolbachia endosymbiont
SYYVRLQYNGEISPFKTKIDGIEYKKNNDAQDPLKASFMAGSGAFGYKMDDIRIDIEGLYSQLNKNDVSGAVFTPATVADNVTAFSGLVNVYYDVAIEDMPVTPYVGVGVGAAYFSNPSSADTVKDQKGFGFAYQAKAGVSYDVTPEIKLYAGARYFGSYGAKFDGEKKQGSGADEVTITDKGAYKVFYSTIGA

SEQ ID NO: 21841 - protein, 183 aa, Wolbachia endosymbiont
SYYVRLQYNGEILSFYTKVDGITNATGKDRDSPLTRSFIAGSGAFGYKMDDIRVDVEGLYSQLTKDATVVSDDKAADSVTAFSGLVNVYYDIAIEDMPITPYVGVGVGAAYISNPSKADGVKEQKGFGFAYQAKAGVSYDVTPEIKLFAGARYFGSYGASFNKEAVSATKEIKVLYSTVGAEA

SEQ ID NO: 21842 - protein, 203 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYNVTPEIKLYAGARYFGSYGANFDGEKKQGSGAEEVTTTDKGAYKVFYSTIGAEAGVVFNF

SEQ ID NO: 21843 - protein, 194 aa, Wolbachia endosymbiont
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYDVTPEIKLYAGARYFGSYGANFDGTKQDPAHPDDLEKKVTDKGAHKVFYST

SEQ ID NO: 21844 - protein, 637 aa, Ehrlichia canis
MLQRLFCSLSLLTLAISAAHAADALDTPHLAGIDNFRDIAGTTSAYGTSHDGVMRTGVFYRTNALTPTAADLAVLNGLGISDVYDLRTASEIAATPDTLPAGASYTNIDIIGSTTSGSNITDISFTSAAQARAMMQETNRAFVSDAGMRGQFSVLFNELASADGAALFHCTAGKDRTGWTAAVLLSIAGVDDATIMNNYLATNEYTAARVAATLAAMPASMAEVYAPLLGVEASYLQAGLDEVTAAYGSMDNYLKQGLGLTQETIYVLRGKMVRYGTLPGEAGLVGNAAAGAQLLRQLQDTSLSGTYSAYNYYLQSAIDAGTLGGVESTVGGQVHADAASYLLRLGVMIDSAAAPFADGTDLKVGQSRLWSSTLAGYLGTDGSSSVASSNEHSQGLMIGMTQRFSEQLSAHAGFGYSSGNVGGAGGEVDTDLTFLSLGARFAPGGLEQGLFIDTDASAGYLDYSSRRDLTGGLGTAKGDSHGTLAGASLAMGYRLNTNRVVLEPSLGVRISRVDVAGFTEKGSELALEVDNLQQTRRSATANLKASFVPFAMGRWQLVPSVQVGYEHALGDHEVESEGHLLGLDIEQRAAFDDRDQFNAGVSLMANLGALSVGADLSALGGGDSHGASGSLKARYAF

SEQ ID NO: 21845 - protein, 215 aa, Pseudomonas fluorescens
MNNKKQHVQVLLGLALIGGAMVNAPAQAGGFSTPTYGAPGWGRAFAGGSLFKNDPSSAYNNPAAMAFVEHNVAQFTVDYARIKIKYKGDASDYAGNPISNTPLDANGFPDVASTTVNNNDGGQGGFTAWLPTGFMVMPLGDRFAFGLSQVVRQGMRSTWDQDSKLRDFAVDTKIETVGLTGSLSFKVNDQFSIGGGVIVQHSKGFVSQNVDLLSA

SEQ ID NO: 21846 - protein, 1068 aa, Neisseria meningitidis
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPPNLHTGDFTNPNDAYKNLINLKPAIEAGYTGRGVEVGIVDTGESVGSISFPELYGRKEHGYNENYKNYTAYMRKEAPEDGGGKDIKASFDDEAVIETEAKPTDIRHVKEIGHIDVVSHIIGGRSVDGRPAGGIAPDATLHIMNTHDGTKNKIMSAAIRNAWVKLGERGVRIVNNSFGTTSRAGTADHFQIANSEEQYRQALLAYSGGDKTDEGIRLMQQSDYGNLSYHIRNKNMLFIFSASNDAQAQPNTLTLLPFYEKDAQKGIITVAGVDRSGEKFNGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDRSGANETVHIKGDLQLGGEGTLYTRLGKLLKVDGTAMTGGKLYMSARGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 21847 - protein, 157 aa, Neisseria meningitidis
AAPYTRPDNSDVFVSAVVGQPGLDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAARASYRFGNAVPRLSYAHGFDLIERGKKGENTSYDSSMA

SEQ ID NO: 21848 - protein, 241 aa, Neisseria meningitidis
AAQAASEDGSRSPYYVQADLAYAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGVRYRF

SEQ ID NO: 21849 - protein, 1058 aa, Pasteurella haemolytica
MLKKNILLCTVAGTLLCSNFNVAFASVPVDEIKPNSWERIKTDVRVQGLYGADDPGRVDFLDDQANYGWGIAKKIEKLQRDVSAFSKQMLDFEHQVSDLAQGNEGKALLRQEQDSMKNTVQALQGRVEYLKTQLDSELQKQNGQKDQLEQNKVEVNNFLARVKDFQDQIKWFGDVLASYDSEAELAGNPVGDSSIVVSNVEYPGQIVTIKDTKIHGEFPMIVSEGGTIYGVNVNTSEEAMVALSNLGGRFELYNSDINVAWRESAGIVFASKDANDHVVKLVNTNIHVEDGVGIFGSTFGDVTGQISLENSKISADILVKKEDANQSPLHLTITADNSVLRGGIRTALEERASVRAVLGEREGVRDPQDTQTDQQRQDVLSLLLQRNRGQRVQLEAGALEVQNNQQVNGVQQVLGNPDINVQAQANQDSTQVSEASTVALAVSEISGEPTSQPRLTVWDAPQGVTVLGPRVELAPRQQQVDPSTQTGSTSLSTVNLDLRNNSKWYLTFSKHEMDDVSLESKDETRIENRKRRLSSDLSSLKVHDSSVIFVEPKSSNHYKTLYVGFDNPERNVYVAKGDARLLINAELDDSKKIGNLKSDQVIVSGNVIGNTTIHVQDMTNSELVKLPKITHRPSILAASEGIIPLNERGVSVVQVFGTAKEDSFKLSDPYITLGGSPYKYVLKAYGPGSQHGESREADVSAVYDLLTANSSESPAFWDYRLQNEYIDSDRYVSAIVPQAASYLVMSNAVFSSGLADVINHNTLITSMQKNPVEKKGEQFAISLSSYGNKLTLSSDRTPFDYGYHADVNYGALQAGLSLVEWDNKDSITHFGLLGNYGRLFFTPKDVPDSDESNLNKWSVAVYSSTQHYDGFYANALISYGMMKGTITNAVIGDTATIDDAKAWNISLALGKKIDTEVKGVRFEPEAQLVYQGLNFETISDIDKFDVDMDDPRQWLVRVGGRVSKIIPMNNIIPMGNKNDFVSLYTKLHLIKTFSDNSTITMGDQFHVDSVGSSLEGGLGFVSEFSNSLSLHSEISYRCALQRSGTSGTSFSGGIRYRF

SEQ ID NO: 21850 - protein, 369 aa, Enterobacter aerogenes
MKVKVLSLLVPALLVAGAANAAEIYNKDGNKLDLYGKIDGLHYFSSDDSVDGDQTYMRIGVKGETQINDQLTGYGQWEYNVQANNVEGSDKQAWTRLAFAGLKFGDAGSFDYGRNYGVVYDVTSWTDVLPEFGGDTYGSDNFLQSRANGVATYRNSDFFGLVDGLNFALQYQGKNGSTSGEDQTNNGRSFQKQNGEGYGTSVTYDIWDGISAGFAYSSSKRTDDQNANGVLGHGDHAETYTGGLKYDANNVYLATQYTQTYNATRAGDIGFADKAQNFEVVAQYQFDFGLRPSVAYLQSKGKNMTVRNGVNYGDQDILKYVDLGATYYFNKNMSTYVDYKINLLDENDFTRAAGISTDNVVALGLVYQF

SEQ ID NO: 21851 - protein, 375 aa, Enterobacter aerogenes
MKVKVLSLLVPALLVAGAANAAEIYNKDGNKLDLYGKIDGLHYFSSDDSVDGDQTYMRIGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEDQTNNGRDFQKQNGEGFGTSVTYDIWDGISAGFAYSSSKRTDEQNNSTFVSKTDGGRYGVLGEGDHAETYTGGLKYDANNIYLATQYTQTYNATRTGNIGFANKAQNFEVVAQYQFDFGLRPSVAYLQSKGKDMGRYGDQDILKYVDLGATYYFNKNMSTYVDYKINLLDDNKFTKDASISTDNVVALGLVYQF

SEQ ID NO: 21852 - protein, 379 aa, Enterobacter aerogenes
MKVKVLSLLVPALLVAGSVNAAEIYNKDGNKLDLFGKVDAEHYFSDDKGADGDQTYMRIGFKGETQVNDQITGYGQWEYQIQGNTAENDNQSWTRVAFAGLKFGDAGSFDYGRNYGVIYDVTSWTDVLPEFGGDTYGADNFLQSRGNGIATYRNTDFFGLVDGLNFALQYQGKNGSVSGENDATGGRSLLKQNGDGYGMSLTYDLGEGFSVGGAMATSKRTADQNASNAALFGEGDHAEVYSGGLKYDANNIYLAAQYSQTYNATRFGTSNGDRSDIYGFADKAQNFEVVAQYQFDFGLRPSVAYLQSRGKDIANKTTGESFGDQDLLKYVDVGATYYFNKNMSTFVDYKINLLDDNKFTRQAGIGTDDVVAVGLVYQF

SEQ ID NO: 21853 - protein, 363 aa, Enterobacter aerogenes
MKVKVLSLLVPALLVAGAANAAEIYNKDGNKLDLYGKIDGLHYFSDDKSVDGDQTYMRVGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEGATNNGRGAQKQNGDGYGTSVTYDIFDGISAGFAYSHSKRTDDQNNLVLGNGDNAETYTGGLKYDANNIYLATQYTQTYNATRAGSLGFANKAQNFEVVAQYQFDFGLRPSVAYLQSKGKDLEGYGDQDLLKYVDVGATYYFNKNMSTYVDYKINLLDDNSFTRNAGVSTDDVVALGLVYQF

SEQ ID NO: 21854 - protein, 1568 aa, Neisseria meningitidis
MKTKRFKINAISLSIFLAYALTPYSEAALVRDDVDYQIFRDFAENKGKFFVGATDLSVKNKQGQNIGNALSNVPMIDFSVADVNRRTLTVIDPQYAVSVKHVKGDEISYYGHHNGHLDVSNDENEYRSVAQNDYEPNKNWHHGNQGRLEDYNMARLNKFVTEVAPIAPTSAGGGVETYKDKNRFSEFVRVGAGTQFEYNSRYNMTELSRAYRYAIAGTPYQDVNVTSNLNQEGLIGFGDNSKHHSPEKLKEVLSQNALTNYAVLGDSGSPLFAYDKQEKRWVFLGAYDYWAGYQKNSWQEWNIYKKEFADKIKQRDNAGTIKGNGEHHWNITFGTNSKIGSTAVRLAGNEKDANNGQNVTFEDNGTLVLDQNINQGAGGLFFKGDYTVKGINNDITWLGAGIDVTDGKKVVWQVKNPNGDRLAKIGKGTLEINGTGVNQGQLKVGDGTVILNQQADADKKVQAFSQVGIVSGRGTLVLNSSNQINPDNLYFGFRGGRLDANGNDLTFEHIRNVDEGARIVNHNTSHASTITLTGKSLITNPNSLSVHSIQNDYDEDDYSYYYRPRRPIPQGKDLYYKNYRYYALKSGGSVNAPMPENGVTENNDWVFMGYTQEEAKKNAMNHKNNQRISGFSGFFGEENGKGHNGALNLNFNGKSAQNRFLLTGGTNLNGKISVTQGNVLLSGRPTPHARDFVNKSSARKDAHFSKNNEVVFEDDWINRTFKAAEIAVNQSASFSSGRNVSNITANITATDNAKVNLGYKNGDEVCVRSDYTGYVTCNTGNLSDKALNSFGATQINGNVNLNQNAALVLGKAALWGQIQGQGNSRVSLNQHSKWHLTGDSQVHNLSLADSHIHLNNASDAQSANQYHTLKINHLSGNGHFHYLTHLAENLGDKVLVKESASGHYQLHVQDKTGEPNQEGLNLFDASSVQDRSRLSVSLANNHVDLGALRYTIKTENGITRLYNPYAENRRRVKPVPSPATNTASQAQTDSAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARQQEEARKAAELAAKQKAETERKAAEIAEQKAEAEREAAELAKQKAEEEGRQAAQSQPKRRNRRAIPPELSSDATTRALPRIARNSNPDASDYEEIPLDALEDEDVSESVDTSDKQPQDNTELHEKVETVSLQPRAAQPRAQAAAQPQAQAAAQPQAQAVAQADAVSTNTNSALSDAMASTQSILLDTGASLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPSAGIRYSRLSSADYKLGNDSVKVSSMSVKTLTAGLDFAYRFKVGNLTVKPLLSAAYFANYGKGGVNVGGNSFAYKADNQQKYSAGAALLYRNVTLNVNGSITKGKQLEKQKSGQIKIQIRF

SEQ ID NO: 21855 - protein, 160 aa, Bordetella pertussis
  misc_feature (2)..(2): Xaa can be any naturally occurring amino acid
IXNGEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFD

SEQ ID NO: 21856 - protein, 792 aa, Shigella flexneri 2a
MKRHLMLGGAACALLLATPMLAMAAEPAAAPAPADTAPADANEVDAVIVLGQGQSRQVQTITTTQIEVLAAGSSPLRAIEKLPGVSFQSADAFGAYEWSTRVAIRGFDQSRLGFTLDGVPLGDMSYGNYNGLHISRAVTSEDLGSVELAQGAGSLSTASTSNLGGTLRFFTRDPSKDFHVQTNATVGSDNMYRVFGRIDTGAIEGLGGLRAYLSAVDQKADKWKGGSEQKQRQYDAKVVLPLGETGSLTAFWNHSERREQDYQDMSFDMIKRLGRDWDNFQPDWNKAVGVGAVLNNPANYAGATPILNGGYWTGVGTNPYAQYGVATPDDAYYAGAGIRDDDIYAVTLKHDLGETARFDLTGYGHKNQGQGLWYTPYTVSPGYGTAGSTAAPLSIRTTEYDIDRKGLIGNLYVDLGSHALSAGFWTEDNDFHQARRFYAETAAAPSRDPLDFQSNPFKTSWEFKFNTKTTTGYLQDVWTVNDALKVNFGFKALKVENQVTSIVGSVNGKIQSKDSFLPQVGAVYSLNNGVELFGGYTENMAAYVSAATSGPFASQNQAAVNFIRDNLKPETSKTFEGGVRYKTDRFQGVAAVYHVDFENRLDSASTAPPILGLPAVLSNVGAVKTKGIELAGQYRLTDAWSLYGSYAYNDSTYKDDVPGAGGTVAMRTKGKDVIYTPKNLLKASLGYDQGTGFFGNLGVSYTSSRWYTFENDGGKVDGFTVADLTVGYRFDGADNAWLRGLEVQGNITNLTDEDYISTVGSGGAAKADPTGQAMTLLPGAPRQAYVTVRKRF

SEQ ID NO: 21857 - protein, 777 aa, Pasteurella multocida
MLTLVFSVIKRSFMKFKYCVIHQLVLSGSLIFPTLSFADSDSTRTTPNKASYLEEISVVGTTVQHIFSSTQSTEQLRKNMVSNERDLFRYEVGIGVPESGRSGSNGFAIRGVDKDRVAVIVDGIPQAESTMSTSARYSTERHNGNINNIEYENVSSLKVQKGATSVMYGSGALGGTVEFTTKDIEDFVEPGRHLGFLSKTGYTSKNREYRQVIGVGGKGEHFFGFVQLTKRWGHETINNGKGTDILGEHRGKPNPLNYYTTSWLTKVGYDINNTHRFTLFLEDRREKKLTEEKTLGLSDAERFANDQTPYLRYGIEYRYNGLSWLETVKLFLAKQKIEQRSALQEFDINNRNKLDSTMSYVYLQRQNIARGEFSTSPLYWGPSRHRLSAKFEFRDKFLENTNKHFTFRTWQIPLFQKQGLNNYTEVFPVKSREFSFSLMDDIKIGELLHLGLGGRWDHYNYKPLLNSQYNINRTQRLPYPKTSSKFSYQLSLEYQLHPSHQIAYRLSTGFRVPRVEDLYFEDRGRTSSQFLPNPDLQPETALNHEISYRFQNQYAHFGVGLFRTRYHNFIQEREMACSKIPHEYNRARGYCTHNTYVMFVNEPEAVIKGVEVSGALNGSAFGLSDGLTFRLKGSYSKGQNHDGDPLKSIQPWTVVTGIDYETEGWSVSLSGRYSAAKKAKDAIETEYTHDKKVVKQWPHLSPSYFVVDFTGQVNLSKNVILNMGVFNLFNRDYMTWDSAYNLFTRGYTSRSIRANGPGINRFTAPKRNFAASVEIRF

SEQ ID NO: 21858 - protein, 281 aa, Bordetella bronchiseptica
RTNPSAAAAGRRRRPWPPLAAPRAEAPAANVVTAGLVPHHAAAEQHADDDPTSRRRPINTPLRLPPSFTSAGTGLHTSGADTVGLTVSHFLTDHIAVTSVAGVPPVFKVSGQGTIKPPGPAGALGTQNIGLGSVNPIVKSVRQWSPAVILQYYFGQATAKFRPFLGLGVSYNWFSDLQLNTNFIKQTQDNLGAILAAGAGKPGTTSVEAKASSSWQPVFNAGLQYNLTEHFGLIASVTYIPLKTTSTVTIKAADGSVLAESKSDLKADPIISYVGMTYKFW

SEQ ID NO: 21859 - protein, 198 aa, Bordetella bronchiseptica
WSNSDEETSYYVRLQYNGEVLPLKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTVGAEAGVAFNF

SEQ ID NO: 21860 - protein, 2366 aa, Pseudomonas fluorescens
MNIAHSKKSGESFPRFLLPTGVFLALSGAGIVSAYATCSTAGTTVTCSGVANPLAPSYSNSANNLNVTVNPGASVGVLLGVGGTAMSLTGSNNTLTNNGTIDPSLLGSGLGVLSSGAVVGNAAASTTTVTNNGTMNGSTGVAVSGVTGMALSVQNGTGGTSTITNTGTMGTTALAGATLIGADAPVVAAYGGGTVNMTNSGTITGRVSLGSNGTPGLGNTFTNSGTINGSVSMGANSTNTFNAVTGSSVNTAGGTGGAFNITVGPVTLGVAATGTVDGGAGGNNTLVLQQGVSANGTIAVNNYINFNHLDVTSGNWTINGASTAQDATLAGGVAIIGDNASLGTGTITATGGALQAGTAGLDVSNNVNLGAGGLTVQGATGLSLSGTVSGAGALTKNDGGILTLSGANSYTGGTNLNAGGLVVGNNDALGSGALNVNASASLDTSTNVTLGNAVNLATGATLTLGGSNDLGLAGTIGGAGGLVKNGTATTTLTGANTYAGDTTINSGTLALGAGGSLASTGTVNLTGAGATFDLAGATGAQTIGSLAGAAGTNVNLGGNSLTLDGSANTTYAGTIAGTGGLTLSGTGTQALTGANVYTGDTNLNGGNVVVGSNTALGFGAVNVNGSSTLDATTNVSLANGVNLATGTTLTVGGSTDLGLSGTIAGAGGLVKNGAAALTLTGANSYTGGTTLNAGGLVLGNDAALGSGALSVGGAATLDTTTSLSVANAIDIGTSATLTLGGSNALGLSGAITGAGALVKDGAATTTLTGTNTYTGGTTINAGTLAIGAGGSLSSTGTVNLANAGAAFDIAAGGAQSIGALSGAAGTSVNLGANALTLGGTASGTFGGTIGGTGSLTLEGTGTQTLNGVNTYTGGTNLNSGSLVLGNNAALGTGALNVGGAATLDTNASLSVANAIDIGTGATLTLGGSNALGLGGAISGAGALVKDGAATTTLTGTNTYTGGTTINAGTLAVGAGGSLAATGTMNLASAGATLDLSGASGGQSLGALSGVAGTNIDLGGNALTLGGTASGTFGGAIGGTGSLTLAGTGTQTLNGASTYSGGTNLISGGLVLGNNAALGVGALNVGGAATLDTNASLSVANAIDIGTGATLTLGGTNALGLSGVISGSGALVKDGTATTTLTGTNTYTGGTTINAGTLAVGAGGSLAATGTMNLAGAGATLDLSGASGGQTFGALSGVAGTNVSLGANALTLGGTASGTFGGTIGGTGSLTLAGTGTQTLSGANTYTGGTTINGGSTLALGAGGSLASTGTVNLAGAGATFDLGGASGAQTIGALTGATGSTVNLGANALTLSGSGNNTFGGAIGGTGSLTLAGAGTQTLTGANTYTGGTTINGGSTLALVSGGSLASTGTVNLAGTGATFDVSGAAGAETIGALSGAAGTTVNLGANALTLNGSGASTFGGTIGGTGAVTVAGTGTQTLTGANTYTGGTTINGGSTLALGSGGSLASGSTVNLAGTGSTFDLSGASGTQTLGTLTGTAGTNVNLGANALTLNGSGNGTFGGAIGGTGGLMLAGTGTQTFTGANTYTGGTTINGGSTLALGSGGSLASTGTLNLAGSGATFDVSGAAGAETIGALSGVAGTNVNLGANALTLNGSGSSTFGGVIGGTGAVTVAGTGTQTLTGANTYTGGTTINGSSTLALGSGGSLASTGAVNLAGTGATFDVSGAAGTQTIGTLSGAAGSTVNLGANALALNGSTNGTFDGVIGGTGGVTVAGTGVQTLTGSNTYTGGTTIASGGTLQLGNGGTSGSVVGNVVDNGALIVNQSGSVMLANVLSGTGSLTQAGSGALTLTGTNTLSGPTTVAAGTLDVAGSLAQSAVTVQNGATLTGTGTVGGVVVQSGGIAAASQPGAALNVAGNVTFQPGSTLQVAVTPQQSGSIAAGGTATLNGGTVQVLANQASFQPSTTYTILSASSGVQGAFSQVNSNYAFLMPTLSYDPNHVYLRLVTNGTALPDVATTPNQRSVATAIGALGAGNTLYDKVLTTDAATARQAYSVLDGELQASLKSMLLLDSRYVRDAVTDRVRQGLAPGSGPLAALSSGGAALCGDNTAGVTDPTLAPERRIGSREGCYGGTPYQPVVWGQAFGGRSRLAGDGNASTINRSMTGFIAGADMALNDKWRAGLAAGVTHSSLDNDQSSSAAVNSYYLSLYGGAQYGALGVRGGASYTWYRINTDRYPGFAGFSDHDSAGYNAHSAQVFGEVGYALPLGPVALEPFAGLAYVNLHTDGYTESGGAAALQAGGQTTHIGFSTLGLRAASQLGSIASGTFTARGTVGWRHAFGNVRPSSAFTFANGGTSFQVSGVPIARDSAVLEAGIDANITKRLTLGLTFSGQYGSGVRDNAVLGNILWKF

SEQ ID NO: 21861 - protein, 162 aa, Wolbachia endosymbiont
SYYVRLQYNGEILPLFTKVDGITYKKDNSDYSPLKASFIAGGGAFGYKMDDIRVDVEGVYSYLNKNDVTDAKFTPDTIAGSLTAISGLVNVYYDIAIEDMPITPYIGVGVGAAYISTPLKDAVNDQKSKFGFAGQVKAGVSYDVTPEVKLYAGARYFGSFGA

SEQ ID NO: 21862 - protein, 375 aa, Enterobacter aerogenes
MKVKVLSLLVPALLVAGAANAAEIYNKDGNKLDLYGKIDGLHYFSSDDSVDGDQTYMRIGVKGETQINDQLTGYGQWEYNVQANNTESSSDQAWTRLAFAGLKFGDAGSFDYGRNYGVVYDVTSWTDVLPEFDGDTYGSDNFLQSRANGVATYRNSDFFGLVDGLNFALQYQGKNGSVSGEDQTNNGRGFQKQNGEGFGTSVTYEIWDGISAGFAYSSSKRTDEQNNSTYFSKSYQRTYGVLGEGDHAETYTGGLKYDANNIYLATQYTQTYNATRTGDIGFANKAQNFEVVAQYQFDFGLRPSVAYLQSKGKDMGRYGDQDILKYVDLGATYYFNKNMSTYVDYKINLLDDNKFTKDASISTDNVVALGLVYQF

SEQ ID NO: 21863 - protein, 186 aa, Wolbachia pipientis
TSYYVRLQYNGEILPFYTKVDGIKNVTSKGEDSPLKRSFIAGGVAFGYKMDDIRVDVEGLYSRLAKNKAVIDASEANVADSLTAFSGLVNVYYDIVIEDMPITPYVGVGVGAAYISNPSNAADVKDQRRFGFAYQAKAGVSYDVAPEIKLFAGARYFGSYGASFDKAAKGDDGIKNVLYNTFGAEA

SEQ ID NO: 21864 - protein, 315 aa, Bradyrhizobium japonicum
MRPGPWLMALAACAVASSAWGQQGLRLSKDDLQKRANGVLALMSFSIVPDITTSALNIAGGGGSTSGSTEFYMTQLGGGDTISKSVPLYLEGVLAASRYDPTFVATQGADSRRIPAKWNSVSATGGIGWDFPLTDELKLRPIFNVALGNVTSDLRAASWYVGRQTGQDVDFLDRGSLNAYGLGGSLMLDYEHYRPGYEVDVELRYSDIRLRSFDSSAAVRGQATAQSANLWARYRAPTGATLLQRPLRYVLELTHSEFLGDQRGVLGFDRLTSVGAGLELDSSAYDVFVTRTRLVGRYVFGNNVSGFSVGLAVSF

SEQ ID NO: 21865 - protein, 616 aa, Bradyrhizobium japonicum
MALLQISEPGLSAAPHQRRLAAGIDLGTTNSLVATVRSGQAETLADHEGRHLLPSVVHYQQQGHSVGYDARTNAALDTANTISSVKRLMGRSLADIQQRYPHLPYQFQASENGLPMIETAAGLLNPVRVSADILKALAARATEALAGELDGVVITVPAYFDDAQRQGTKDAARLAGLHVLRLLNEPTAAAIAYGLDSGQEGVIAVYDLGGGTFDISILRLSRGVFEVLATGGDSALGGDDFDHLLADYIREQAGIPDRSDNRVQRELLDAAIAAKIALSDADSVTVNVAGWQGEISREQFNELIAPLVKRTLLACRRALKDAGVEADEVLEVVMVGGSTRVPLVRERVGEFFGRPPLTSIDPDKVVAIGAAIQADILVGNKPDSEMLLLDVIPLSLGLETMGGLVEKVIPRNTTIPVARAQDFTTFKDGQTAMSIHVMQGERELVQDCRSLARFALRGIPALPAGGAHIRVTFQVDADGLLSVTAMEKSTGVEASIQVKPSYGLTDSEIASMIKDSMSYAEQDVKARMLAEQKVEAARVLESLHGALAADAALLSAAERQVIDDAAAHLSEVAQGDDVDAIEQAIKNVDKQTQDFAARRMDQSVRRALKGHSVDEV

SEQ ID NO: 21866 - protein, 66 aa, Bradyrhizobium japonicum
MPGYVRWDAMAAYYFKVGKSRLTAQVNVKNILDKKYFSYADQFGNPRFDAMPGAPLTVLGSLKLAY

SEQ ID NO: 21867 - protein, 130 aa, Bradyrhizobium japonicum
MGGYRWGFTEFANGATLSRDDFWWAGGSYQATTALNFQLGYYYWNIKSLRLGATATEGNPANPWEVAFVADYAFSKRTDVYLTTAYARNAGVNFDSSNTGFATGYFPTPGQRGMTAVAVGGPPHFLRELS

SEQ ID NO: 21868 - protein, 470 aa, Bradyrhizobium japonicum
MLRGTITIKYKKERTMRANKLFAGGAIATALFISGNAAATNGYFTHGIGTHNKAQAGAGTASPEQSIDAANNIASGVLVGDRLDVGIALFSPRRSYNTSDSQLNGQFGSFTVNADNVESGSEYFPIPYIGKSWTLENDRALSLIFYGRGGMNSDYKDGSATFDPDGPGPAPVMTLPGTFGTGNTGVNLNQAFLELGYSFKTGDFAFGIGPVIAMQAFEIEGVSAFGGFTKTFAASGGTQPPTGLSNNGTDYSLGYGLKVGAIWDATDTLDFAVSYQSRMEMQEFDDYSDLFARGGSFDIPAVGRVGMSWQATERLRLHLDIEHAQYGEIESIATPLQRIFDCPTAGQGGTNVEACFGGNQGAGFGWSDVTTYKIGGSYVRGDAPFTYRFGYNYSEQPIDESAVVLNILAPGTVEQHFTFGVSRKTQSGNEFSVAFMYAPENTISGPNAFDPTQTIDLTMDQFEIEFSWSW

SEQ ID NO: 21869 - protein, 1139 aa, Bradyrhizobium japonicum
MENRTPFVKLPQSTAGRSKNWRTLRAICLLLFMSISLTAYSQITVDLKGISLRASLKKIEQVSNYKFFYSESLPELSWKVSLNVRDVTIDQTMTRLLEGMELTYKKEQENVIVLIRKTQSKQLTKKVTGTVVDANGEPIIGASIVIKGESHGTITDFDGKFALPDVPEKAVLTISYIGYKTVNLATTDQTLVKVVLEEDSKMIDEVVVVGYGVQSQKLVTTSISKVKMENIDQGNDYNPIKMLQGRVAGVNISSASGTPGETPNITVRGIGSVSGGSSPLYVVDGIPSEKYPNLNPNDIESMEVLKDASAAAIYGSRANAGVVLITTKSGQQGKTKIEVSGRYGFASLASDIEMANSTEYMNTMQAAIDNYNVQMGTNLQLYIPSQIQETDWVKEISRKNSKTGAGSISISGGNEKTTFFASLGANTQEGYLNKSKYDQYNMRAKFSHKINSIFKLNMNLAGSASRSDLLEETSTSLKVLRTAREEQPWYSPYKEDGTSYKVNGTDILRHNPLMLINEEDWVAKKYQLSGVFSIDVTPFKGFKYTPTVSAYGILDNVSKKLSDKHDARKNSSGWGALAQQKDQSFRYVIDNVFSYNNEWNKLIYSVMLGHSFEKYTYEQFGAKSDNYANGAYPSSSFDLINAGPNIYAGDISYTSYALESYFGRIALNWDNKYILNASLRSDGSSRFAKNKRYGYFPSASFAWRASNEGFFPKNKYVNDAKLRLSWGMTGSMAGVSNYAPLSLISAGGASYNGSAGFQISQDARALTWEKASQFNIGFDIEMFQSRLTLNVDMFYQKTTDLLFKKPVNASTGYTTLQSNIGSLENKGLELALNGKILTGKFKWDLGGNISFVKNKLLSLIEGSEMYVVPSSGSNLLGGSMHALINGEPISTFYMLKMEGIYQRDDEVPAKLYAKGVRAGDVRYFDYNEDGDITDADRVNVGKAIPDFYGGITSNFSYKGFDLSLFGQFSVGGKVMAAWRGVNGSEGTDHLGLALSNVKVGDRGESVEQFFNISKEVANGYWRGEGTSNSIPRPVRIGVHTGYDYDYNVQTSTRYLEDASYFKLKTVTLGYTLPESITKKIHVNSLRFYVSADNLLAFTKYSGYDPETSFSGSPGDSNYGVDFGLQPVLRTFIFGLNLNF

SEQ ID NO: 21870 - protein, 170 aa, Wolbachia sp. wUnif
VNLPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIQNVVYST

SEQ ID NO: 21871 - protein, 196 aa, Wolbachia sp. wInd
VNDNGLQKPLIKFPPYAGAGFEVGYKQFFGKKKWFGARYYGFFDYAHNRFGVMKNGIPVGESGFIYNSFSFGGTTLTERDSYQGQYYINLFTYGVGLDTLWNFVNKENMVFGFVVGIQLAGDSWATSISKEIANYAKHHSNSSYSPANFQFLWKFGVRTHIAKHNSLELGIKVPTITHQLFSLTNEKGYTLQADVR

SEQ ID NO: 21872 - protein, 181 aa, Wolbachia sp. wSit
SYYVRLQYNGEILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFGKTAKDDGGIKVLYSTVG

SEQ ID NO: 21873 - protein, 242 aa, Wolbachia sp. wLop
SVYISAKYMPTASHFGKMSIKEDSKNTQTVFGLKKDWDGVKVPTSENTNYSSLFTEKDYSFRYENNPFLGFAGAIGYSMNGPRIEFEVSYETFDVKNPGGNYKNDAHMYCALDTAQQSATNGATLASSVMIKNENLTNISLMLNACYDIMLDGMPVSPYVCAGIGTDLVSVINATNPKLSYQGKLGISYSINSEASIFIGGHFHRVIGNEFKDIATLKIFTATNKVSTVANPGFASATLDVC

SEQ ID NO: 21874 - protein, 186 aa, Wolbachia sp. wKes
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGASFNKEAVSATKEINVLYSAVGAEA

SEQ ID NO: 21875 - protein, 190 aa, Wolbachia sp. wSub
NLFFHTDLPSKVSADLPLILNLQATYSHSKNKLTVARQSSEITHGYWNTHCVGAELGSSLSFDFYEEHNIFHQILPFMNLQGVYAYQRKFQEEGEKRHDISSSQLGNLSLPIGVRLEGHASQWPVFYSTSVAFIADVFRKNPCSIITATYDPFALWTTSGTNLSRQALSAQVSMHCAILDNITLFSKFCT

SEQ ID NO: 21876 - protein, 198 aa, Wolbachia sp. wNov
NFQLQLTEQPQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGKLCL

SEQ ID NO: 21877 - protein, 183 aa, Wolbachia sp. wHod
LQYNGEILPFYTKVDGFTNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDDNDIKNVLYSTVGAEAGVA

SEQ ID NO: 21878 - protein, 255 aa, Wolbachia sp. wGel
FVFLGHSRLKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRIK

SEQ ID NO: 21879 - protein, 183 aa, Wolbachia sp. wFus
SYYVRLQYNGEVLPSKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGASFNKETVSATKEINVLYSAVG

SEQ ID NO: 21880 - protein, 317 aa, Wolbachia sp. wEum
SNLANAATVYNQDGTKVDVNGSVRLILKKEKNERGDLVDNGSRVSFKASHDLGEGLSALAYAELRFSKNEKVEVKDAQNQQVVRKYEVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYHNLKSNVEGKNVLLKWLNLCIMTSKVNCLFGKKGQRALQNRLYVGGSNLQHEPCEGLAKKFMLHKNKWVVRPFIVIKTGTCL

SEQ ID NO: 21881 - protein, 228 aa, Wolbachia sp. wCrag
SYPVMDDLDIYTRLGGMVWRADSKANFGNGTRLSDHDTGVSPLAAVGVEYALTKNWATRLDYQWVNNIGDAGTVGARPDNGMLSVGVSYRFGQDEAAPVVAPAPAPAPVVETKKFTLTSDVLFNFNKATLKPEGQHALDQLYTQLSSLDPKDGSVVVLGFTDAVGSAQYNQRLSEQRAQSVVDYLVSKGIPSDKISARGMGKSNPVTGDSCGYRSGRATAAQIACLAP

SEQ ID NO: 21882 - protein, 161 aa, Wolbachia sp. wCra
  misc_feature (65)..(65): Xaa can be any naturally occurring amino acid
SYYVRLQYNGEILPFYTKVDGITNAKDKEKDSPLTRSFIAGGGAFGYKMDDIRVDVEGLYSQLAXDTAVVNTSETNVADSLTAFSGLVNVYYDIAIEDMPITPYVGVGVGAAYISNPSKADAVKDQKGFGFAYQAKAGVSYDVTPEIKLFAGARFFITYWT

SEQ ID NO: 21883 - protein, 181 aa, Wolbachia sp. wAra
VRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFSFAGQVKAGVSYDVTPEVKLYAGARYFGSFGAHFDKDAAAGKDKGELKVLYSTV

SEQ ID NO: 21884 - protein, 183 aa, Wolbachia sp. wAlbo
EILPLFTKVDGITYKKDNSDYGPLKASFLAGGGAFGYKMGDIRVDVEGVYSYLNKNNITDAKFTPDTIADGVTAISGLVNVYYDIAIEDMPITPYVGVGVGAAYISTPLKDAVNDQKSKFGFAGQVKAVVSYDVTPEVKLYAGARYFGSYGTNFDKSGGEKDKGGHTVPYSTVGAEAGVAFNF

SEQ ID NO: 21885 - protein, 149 aa, Erwinia amylovora
LDVYTRLGGMVWRADATQTNPTFGRISNHDTGVSPLAAVGVEYAVTKNWATRLDYQWVNNIGDAGTVGARPDNSMLSVGVSYRFGQDDVAPVVAPAPAPAPVVETKRFTLKSDVLFTFNKANLKPEGQQALDQLYTQLSNLDPKDGSCC

SEQ ID NO: 21886 - protein, 149 aa, Erwinia amylovora
LDVYTRLGGMVWRADATQGNPTYGRISNHDTGVFPLAAVGVEYAVTKNMGNPLDYQWVNNIGDAGTVGASPDNSMLSVGVSYRFGQDEAAPVVAPAPAPAPVVETKWFTLRSDVLFTFKKSTLKPEGSQALDQLYHQLSNRDPKNGSGV

SEQ ID NO: 21887 - protein, 149 aa, Erwinia amylovora
LDVYTRLGGMVWRADATQTNPTFGRISNHDTGVSPLAAVGVEYAVTKNWATRLDYQWVNNIGDAGTVGARPDNSMLSVGVSYRFGQDDVAPVVAPAPAPAPVVETKRFTLKSDVLFTFNKANLKPEGQQALDQLYTQLSNSDPKDGSCC

SEQ ID NO: 21888 - protein, 146 aa, Erwinia amylovora
LAVYQRLGGLVWGDENQPNSGGISNHDTGISPLAAVGLEYAATKNWATRLDYQWVNNIGEAGTVGGRPDNGMLSVGVSYRFGQETPAPVVAPTPAPAPVVQTKRFTLKFDVLFTFNKAECVLKARASLDQLYTQLSTMDPKDGSVL

SEQ ID NO: 21889 - protein, 192 aa, Erwinia amylovora
LVSISDEETSYYVRLQYNGEFLPLYTKVDGITGAKKDSKETKDLYAASFKAVGGAFGYKMDDIRVDIELLYSQLGKDKDVTGANPEIASDLMAASALANVYYDIAIEDMPITPYVGVGVGVAGVSTPLNTVVSEQKYKFGVAGQVKAGVSYDVTPEIKLFAGARYFGSWGANFDKDATTGKDKGDLKVLQYL

SEQ ID NO: 21890 - protein, 149 aa, Erwinia amylovora
LDVYTRLGGMVWRADATQTNPTYGRISNHDTGVFPLAAVGVEYAVTKNWATRLDYQWVNNIGDAGTVGASPDNSMLSVGVSYRFGQDEAAPVVAPAPAPAPVVETKWFTLRSDVLFTFKKSTLKPEGSQALDQLYHQLSNRDPKNGSGV

SEQ ID NO: 21891 - protein, 149 aa, Erwinia amylovora
LDVYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTMKPEGQQALDQLYTQLSNLDPKDGSVV

SEQ ID NO: 21892 - protein, 149 aa, Erwinia amylovora
LVVYTRLGGMVWRADATQSNPTYGRISNHDTGISPLAAVGVEYAVTKNWATRLDYQWVNNIGDAGTVGARSDNSMLSVRVSYRFGQDKAAPVVAPAPAPAPVVETKRFTLKSVVLFTFNKSTLKPVGQQALDQLYTQLSNLDPKDGSVV

SEQ ID NO: 21893 - protein, 149 aa, Erwinia amylovora
LDVYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSCC

SEQ ID NO: 21894 - protein, 149 aa, Erwinia amylovora
WNVYTRLGGMVWRAELNPNANGTRISEPDTGVSPLAAVGVEYAVTKNWATRLDYQWVNNIGDAGTVGASPDNSMLSVGVSYRLGQDDAVAPVVAPASALAPLFETKRFTLNSTSLFNFNKATLKPEGQQALDQLYTQLSNLDPKDGSVV

SEQ ID NO: 21895 - protein, 145 aa, Erwinia amylovora
WNIYTRLGGMVWRADTKSNVYGKNHDTGVSPVFAGGVEYAITPEIATRLEYQWTNNIGDAHTIGTRPDNSMLSLGVSYRFGQGEEAPVVAPDPAPAPEVQTKHFTLKSDVLFNFDKATLKPEGQAALDQLYSQLSNLDPKNGSVV

SEQ ID NO: 21896 - protein, 149 aa, Erwinia amylovora
LDVYTRLGGMVWRADATKTNPTYGRISNHDTGVSPLAAVGVEYAVTKNWATRLDYRWVNNIGDAGTVGARPDNSMLSVGVSYRFGQDVAAPVVAPAPVPAPVVETKRFTLKSDVLFTFNKSTLKPEGQQALDQLYTQLSNLVPKDGSAV

SEQ ID NO: 21897 - protein, 149 aa, Erwinia amylovora
LDMYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSVV

SEQ ID NO: 21898 - protein, 149 aa, Erwinia amylovora
LDVYTRLGGMVWRADATQTNPTFGRISNHDTGVSPLAAVGVEYAVTKTWATCLDFQWVNTIGNAGTVGARPDTSMLSVGVSLPFVQDDVAPVVAPAPVPAPFVETKRFTLKSDVLFTFNKANLKPEGQQALDQLYTQLSNLDPKDGSCC

SEQ ID NO: 21899 - protein, 146 aa, Erwinia amylovora
LGSVKWTNWSVLQSIAFCPKATKGVVACSASSQLTSLDLFYRDGWTISGGVGHKFNEQWAGALSLTWDRGASQGYGAQTDTWTLGAGVSYTPVENVEWRLAGALGIMTGGESGTYVYNGRTYGNDVSYSFGDDLLAALSTSVKVKF

SEQ ID NO: 21900 - protein, 149 aa, Erwinia amylovora
LDVYTRLGGMVWRADATQTNPTNGRISNHDTGVSPLAAVGVEYAVTKNWATRLDYQRVNNIGDAGTVGARPDNSMLSVGVSYRFGQDEAAPVVAPAPAPAPVGETKRLTLKSDVLLTFNKSTLKPEGQQALDQLYTQLSNLDPKDGSVV

SEQ ID NO: 21901 - protein, 145 aa, Erwinia amylovora
LDLYTRLGGFIWRVDSSDDLGHSNNDTGVSPLAAAGLEYAIDKSWATRLEYQWVNNIGDAATVGGRPDNGLLSVGVSYRFGQDDNYVAPAPAPAPAPVVETKRFTLKSDVLFNFNKSTPKGKGQQPLDQLYPQLSFLDPKDGSVV

SEQ ID NO: 21902 - protein, 149 aa, Erwinia amylovora
LNVYTRLGGMVWRADATQTNPTYGRISNHDTGVSPLAAVGVEYAVTKNWATRLDYQWVNNIGNADTVGARPDNSMLSVGVSYRFGQNEAAPVVAPAPAPAPVVETKRFTLKSDVLFTFNKSTLKPEGQQALDQLYTQLSNLDPKYGSVV

SEQ ID NO: 21903 - protein, 149 aa, Erwinia amylovora
LNVYTRLGGMVWRADATQTNPTYGRISNHDTGVSPLAAVGVEYAVTKNWATRLDYQWVNNIGNAGTVGARPDNSMLSVGVSYRFGQNEAAPVVAPAPAPAPVVETKRFTLKSDVLFTFNKSTLKPEGQQALDQLYTQLSNLDPKDGSVV

SEQ ID NO: 21904 - protein, 447 aa, Erwinia amylovora
LNPTKESAGNTLTVSNYTGTPGSVISLGGVLEGDNSLTDRLVVKGNTSGQSDIVYVNEGGSGGQTREGINIISVEGNSDAEFSLKNRVVAGAYDYTLQKGNVSGTDNKGWYLTSHLPTSDTRQYRPENGSYATNMALANSLFLMDLNERKQFSAVNDSTQPESASVWMKITGGRTSGKLSDGQNKTITNQFINQLGGDIYKYHAEKLGDFTLGIMGGYANAKGKTINHTSKKGARNTLDGYSAGLYGTWYQNGANATGLFAETWMQYNWFNASVKGDGLEEEKYNLNGLTASVGGGYNLNVHTWTSPEGIKGEFWLQPHLQAVWMGVTPDTHQEVNGTVVQGTGKNNLQTKAGIRASWNVKSTLDKDTGREFRPYIEANWIHNTHEFGVKMSGDSQLLSGSRNQGEIKTGIEGVITQNLSVNGGVAYQAGGHGSNAISGALGIKYSF

SEQ ID NO: 21905 - protein, 149 aa, Erwinia amylovora
LDVYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYHQLSNLDPKDGSVV

SEQ ID NO: 21906 - protein, 149 aa, Erwinia amylovora
LNVYTRLGGMVWRADATQTNPTYGRIRTPNAGVSPLAAVGVEYAVTKNWATRLDYQWVNNIGNAGTVGARPDNSMLSVGVSYRFGQNEAAPVVAPAPAPAPVVKTKRFTLKSDVLFTFNKSTLKPEGQQALDQLYTQLSNLDPKDGSVV

SEQ ID NO: 21907 - protein, 149 aa, Erwinia amylovora
LDVYTRLGGMVWRADATQTNPTYGRISNHDTGVSPLAAVGVEYAVTKNWATRLDYQWVNNIGDAGTVGARPDNSMLSVGVSYRFGQDEAAPVVAPAPAPAPVVETKRFTLKSDVLFTFNKSTLKPEGQQALDQLYTQLSNLDPKDGSVV

SEQ ID NO: 21908 - protein, 723 aa, Vibrio mimicus
MYKKSILSASIVIALSQGAYAEESSTFNEVVVSATRTEQNVNDVSASVESVSSKDIERTLSKNLYDAVQYTPGVEATTSGRFGISGFNIRGMEGDRVKVVIDGVEQATPFNPGGGAVQAIYPNAIELDTLTSIEINKGPSSTLYGSDAMAGVVVLKTKDPSDVLKTDGDETRFGIKSSYFSVDEQFKNTLTWAMRSGKLETLLMGTYSTGSELETYGDGADIDGSDRGLENPADKDLSNILAKAYYNVSDEFKLGFVFERYDYNYDENNRRGNYTLNFGPSPGVTYADSKSSDEMTRTRYGVNYELTKANVVFDSMKLDLNYQVTDSKNSNFSNVTDHTGRIGYSGNRTRLRQAEEESRQLDVQFDKVVTSESAIHELTYGLNSSMTDFSLTNVDIFHDNGTSAPGATTVPDADVREWGIFLQDNAFLLNDTLVLNAGIRYDSFEADPSSDEGFTTKHVKNSNDAFTGKLGAVYHLNDKLSTFAQISQGFKAPTVEQLYYEYDKGAEFVPNPDLEAEKSLSYEIGLRGQNDSAQFELTGFITQYKDFIDTEKLESIDPNKDRFTIVNRSEVRISGVEFSSTLLLDDTFSAPEGMYTKVSVTYLDGKDETTGKALDSVAPLSSVLGLGYDNVEHHFGGLASLKLAAKKDDWFTKDQIDSGGYGVMDLTAYYMPVKDLTLTAGLFNAFDKKYLTYQDVRGLDSKDNEDFHSLPGRNWALSVDYQF

SEQ ID NO: 21909 - protein, 878 aa, Vibrio parahaemolyticus
MSYLNLRLYQRNTQCLHIRKHRLAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKTRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 21910 - protein, 678 aa, Vibrio parahaemolyticus
MNKLLTLTPLAVAIGSSLVVPSAVASEETNSTPSATETIQVYGHQYEGYAEHMPQSGTKTDVEWLDVPQAVSVVTKTEMQDRGAVRLVDALDGVAGVNNTLGEGSRDQFMIRGFDSLNDMYRDGMRDDGTLQSYRSLANVERVEIVKGPAGALYGRGSAGGIINLVTKRANGDNFTHVKGSVGSNSQYVGQVDSSMAFSDKVNGRINLEYRQADSYVDHVDSNDFFIAPTIRVLPADGHTIDIDVEYAHQELVPYRGVPSKNGKPVDLPVSTYFGGTNDYQESDSLRVAVDYEWRLNDQWVWNNRAAFNHIELEQKGTRQGKVTGNEVSQTVNNFGYDPRTTTTLQSELIWETNDNQLMLGADFNQIDIDLTLASDKTLPPQNIYNPVVGPTPDPGFKPFRDNTTTTTGVYVQDVYTWGDLSVIGNVRYDSMELEQQKAGSGKEKLDDDKVSYRAGLVYRINYDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKKPNDVSDHLFSLWSTYQLDDNWRLGGGVKYVGDRYAGNDEAVALGDYTTVDLMAAYTTGRHKIQANAYNILDEKYILGATNGTSGLNQIGYGAPAEFMLSYGYQF

SEQ ID NO: 21911 - protein, 735 aa, Pseudomonas resinovorans
MFPVLVLSQEKIEGMVMEVNEQNKHIGLPGASVYWMNSQTGTITKEDGTFSIPYSKEYDKLIISYVGFESDTLIIKEVKKVHHWLKPSNALDEVVVEQKREATQKAYFSAQNVVTVNSAELLKAACCNLSESFETNPAIDVNFSDALTGTKQIQMLGLTSPYLLITQENIPMVRGASQAFGLTFTPGTWVESIQITKGAGSVVNGYESISGQINTELVKPLTDKSLFVNGYANKNGRLELNTHLNHKLSDRLSSGLYIHANKRSQKEDNNDDGFLDAPLANQINVMNRWQYQNPQTGWVSFLNVRFLNDEKQVGQTDFNPAIDKFTTNAWGSEINTRRFDSSLKLGYVFPELPFQSFGFQTSYSNHKQDSYFGFNQYDITHESIYSNLIFNSIIGDTQNKFKAGVTFAYDGYSELVNSDNYDRIDNSAGAFFEYSYDNLEKLSLTAGIRVDKHNRLGAFITPRFHLRYTPWDKASLRGSFGRGKRAANVFAENQQLFGSSRQIRLVDDGGEVYGLDPEDAWNYGVSFLQGFLLSERKGNVTLDYYRTDFKNQVVVDWENPNEISFYYLDGKSVANSFQFEVNYEVFKNLDLRTAYKYYDVKTDYQTGLLQKPLQAKHRYFANIGYETTPKENGAQWRFDYTLHALGEQRLPNTLANPEEYRLAEYSDPYSLMNAQITKVFNESFEVYIGGENLSNFTQKNPVLSANDPFGANFDTSIVYAPIMGRMFYGGFRYKL

SEQ ID NO: 21912 - protein, 641 aa, Pseudomonas sp. CA10
MIYKNHLMQSSTFIRLILLVLPVLTGNYYCFAQINTDSVYVMPVMQVNDYRYNDFSAGSKSITIDSAYLKNNPGSLADVLSNQSSVYIKAYGVSSLASISVRGGSASQTQTTMNGMIMNSPTTGQLDYSTIPSFIFNNLQIQYGSQVSLMGSGAIGGSVHLSNQQDFIKRKQIRITYQQASFSSLLPIASIRAGDSTKQLFISAYYKQAQNNIAYFTNAEKKRIDHAAQNQKGVYVDYSFRIKNHTLKYWSWYQQMNRDLPGTTSALYSDATQYDRNWKQGIQWTYAKKRNVIQGRLGYQEDKMNYESDTSNIHSIISSRIIQAELEYRYQLNTHVNLLAGSQLILQEGMSDNFVTSSVHQNKYAVFISSSIRFLTNKLIFLPSVRQEWCNTWVPFTPSLGINYFIFPTLKLHGLAGYNYRIPSLNDLYWNPGGNNSLKPEHGWGYEGGLTIEKKYHAFEIYQDVTGYTRTISDWILWTPNNGIWMPDNIQRVWSRGLELESGIKIHSSRYSFHIRNSFAYTKSTNESDLQSTDQRLGKQLIYVPYYKNSLSTSIATRRVEAGMIYNYTSWSFITSDNSDYLNPYHLFDVFSNITLDLKKAKSILTLSARINNLFNTNYKVVSSRPMPMRNYQLTISYTFN

SEQ ID NO: 21913 - protein, 529 aa, Pasteurella multocida
MTHLAKLQALLLVGLGAACVLPAQAQLANNLTIGNPKAMAMGNAVTADVTGIDAVHYNPAALSKLKGRQTTVKLLSGVMDIRAKFDAKEDYGFMGYDDDPFKHSSSRTLTPTMYLPGVGGMTELPVLVAPLAGLSINPPGSKFTFATNVYAPMALGYSRDSDSDPGRFQGRQVSLQRITYFSPSLAYQVNDELSLGLSIGFSHQAVALNQDFRNPGMLTGLTRILNEALCLPGLEEIMGPFINVCSGKIGPFDSLANLDLDLQQSLSPTYNLGILWEPTDWFAWGATYQSEARMNLQGKYRVDYSKDWAGFWSGLQSSLFGQILSPLFPYGVDEESGNASLKLTYPDAFSTGIKLRPLDKWQFNLDLRWVGYSDWNNFEIEFDRELDLLRIAKTFGGGNATDRSIILDRGYRDTWSWGVGVQYDVNDRLALRAGYEYRPSAIPKNKADVLAPVGDADLYGLGLGYRWDKDTTIDVGFNYFVSRQSIPAGSSCNVSCEGLDNLVYNPYAGLNIETTVKAYIFSMTYSSRF

SEQ ID NO: 21914 - protein, 848 aa, Pasteurella multocida
MQKQQPYPIHLGIFLMLGLPTWAFSQANLEKSTINKLETILVNESEEKNKFDENLIKTYLSSGSYSYLSQSDISTFRGSSVGDFLSGVPGVIVGNKRNSGALSVNIRGIANENRVPVWIDKGLQSVPSYQGYAGSSTRTYLDPDLISQVEIEKGPSLQMDATGATGGVVRVETLRWQDIIPQGKNWGVRLKLGTMANTVSPPPYYTRGGYQTKYISKCLSNHTGLCQTQTYAPNARYSSHGFDLNAYNYSLAFANKWQNADLVLAYAKRKQGNYFVGRHGQTPVIESIEFEEDSVEVKEPRVHEDVEIGSLTFKENRSTLYRPGEEALNTSQDNTSYLAKINVYNDVHRLGLAYRHYHSRFGEIMSSILNFRAYGALQGEGTEVKVDSYHANYSYNSTTPYVNLSVNAYFTDSDSSNFTPFIEEYGYSLSSRHAHFLVSKQKGLSIENTSIFQLNDKPFTLKYGLAHSYERIYQPRNAQARVRAKGYPEDAIGPLYIRDGKRKEWSAFVAANYPITSWLKADIGLRYLQSTIYDYIVRTERVNIGGALVPNPNGSGNIWVEKYKDVVHKQAPVKNKGMSPIVMFTFEPINGVQIYTKYAEALRSPSLFQATKGWSMSATADNLEQLRPERAKNWEAGINLFYENLGGKDNILGFKLAYFNNRIKDYLTRSYSPKDKVTQTINIQSAQFKGIELSAYYDMGKFYAKLAGTYYTKTKFCLTAEQAGKGEQCNSGYVYRSNLNNAVPPRLNLHATLGTRLFEQKLDIGARYSYYSKRLVPVLSAERFVNTSSIEWAPYSLVDLYANYNVSNNLKLTMTMDNVFNRYYLDINNTGLNTAPGRTLHLGLEYRF

SEQ ID NO: 21915 - protein, 777 aa, Pasteurella multocida
MISQVGKRGTNEWHFGAQAVWEPKALASSRGDVWFPNATLPTNFGYTDPTQPGTLYRSGKDNTQTRTVYSAYAGGPLIEDKLFIFVAGETDKTDGVTTNAVTDSTQARNNYDYSSPKFYGKIDWNINDNNILEYTRVQNTDRRSGYYTSFDYDSLSGGEATGTYPDTFKIKDTYDIFKYTGYITDDLTLSATWGRSKQENKQFNQLVSDLPFLGSFTNQDPAITGGQPIGNNQTTNRAKADDPTNKTRSLRVELEYRLGDHDLTAGVDNMYFNAYNEGVRTTGPGYQWIYGRQTDPTQAIRPGLGVGPSGGNGYYAQRRIFTTTTSMAVEQKAYYLEDRWQVSDNWLVTLGIRNDKFTNFNSDHVAYVDSGDQWAPRVGASWDIFGDSSLKVFANLGRYYLALPNSVAIRGASASTYTDEYFAYTGIDANGEPTGLRSLGPGPVSSNGEYGQAPDPNSFAPTDLKSQYQDEFLIGFEKTLGSSWNSGAKFTYRKLQSAIDDVCDTAKIGDKLTAQGGDADAVSIPGCVMFNPGQTNTYNLRNVDGSGYTSVRMSQSDWGFTDKARRNYVAVDLFLEHPFDEKWYGRVDYTWSHSYGNTEGQVKSDIGQSDVSKTQDWDAAALMYYAGGSLANDRRHQLKAFGAYQLTPEWMASATLRVMSGTPKSCLGYFGTDESDPISYGSAYHYCGGQPSRPGDAGRTPWTTNLDLGVTYRPSFADHKLALGLQVFNVLNQRDVLRVNGVYETAPSTVSNTYGIGTDTFSFNTPRFVRLSASYDF

SEQ ID NO: 21916 - protein, 741 aa, Pasteurella multocida
MLCIVIVYFFTLSIIFTTMKKILFVSFFMTLNLCVYAQNTFKAVIKDSEKKEPLMGVTAQVTGTTIATISDENGQIILTGIANGLQEIQFSYIGFAQRTDSFNFPLEDTAPIEILLKESSVELDEIVISSTRSTRSIQNIPTRIEFIGGEELDEKGNMKAGDIRMLLSESTGIQTQQTSATSANASIRIQGLDGRYTQILKDGFPIYSGASSGLGLLQIPPLDLKQVEVIKGSTSTLYGGGAIAGLVNLISKTPTEERDLRFHLNGTSGRGLDINGFYGQKFNKIGTTIFASHNRNVAYDPAQIGLSAIPQFERYVLNPKLFVYFNDKTKMNFGINATIENRLGGDMLYIKGKADNTHQFFEENKTQRYSTQFVFDHTVNKNSFVQVKNSVSYFNRNTAIPNYEFEGTQTATFTEASYTHSKEKSEWITGVNIWTDNFKEKQITSFPLRDYNQTTFGAFVQNSFKATDWLQLETGLRTDYVIDYGAVFLPRVSAIFRIANGLTSRIGGGFGYKTPTIFTEESERIQYQNVMPIYDNTNKLEKSYGANADINYRTNIGDDWTFSINHLFFYTYLDNPLLLQNIATNTYQFMNSSGYIHTKGTETNIKIGYDDFKLFLGYTFTDTRLIENGTNTENPLTPKHRINSVLMYEIEDKWKIGLEAYYFSQQKLNDGTTGKDYVICGFMAEKIWERFSLYINFENFLDTRQTRFDNIYTGTITNPVFRDIYAPLDGFVINGGIKFRL

SEQ ID NO: 21917 - protein, 588 aa, Pasteurella multocida
MPLLRWTLSVKVLGGDPGVDADKAEFVDKALAKEGIFNNAAQRFPNSLYDSSFNRKATANRRYSYMPLRHTKDDRQWGIKLDLTGTYGLFGREHDFFVGYAYGDEKIRSEYLEIYERRHRVRPNTGATHGVYAGSCQEEPDGDLSSPLVRGHKEPDWKAYDEKGNRTVYAEECRNAKKIKTEPKLDAEGKQVYYYDEYSGSRTPVYVDVYELDEKGNKIQETNPDGSPAFTGFSGTVPVWKTVKVADDHVPALYNYAKYLNTNKTHSLTAGTRFNVTGRLHLLGGLHYTRYETSQTKDMPVRYGQPASDFQTASSIKADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNTGADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 21918 - protein, 356 aa, Pasteurella multocida
MMKKSLFCMTAALFALPTVTSAASPYFSLKDGDGFKRFSVSAGPLYVKPTGKAQPFRINTSVKENEQSKVGDIKVKTIQDNISDSNSNVVLEELIDVIGLGTDTIPAWLSGTAEIRGLSQWEAENTGLEADDVTTLGLMTNYFFTDNISLEVKAGIPPKVDLQGKGKIYAPFSATAKPAGGILGSMELENNIFITDLEAHGSAASARAWTPAFELQYHFGKTGVNKFRPYVGLGVMYAYFNELEINPEIENDLVNAGHMIVNIKDGKSGAALERKTSSGDPKVDLEASDAIAPVATLGFTYDFNDKWYAVGSVSYAHLKTDTTITVNDAKYGELINAKADIEINPILGYAGIGYRF

SEQ ID NO: 21919 - protein, 679 aa, Pasteurella multocida
MKKFNKKWLIYSSLFFLLSPLVAEDDGFFIGASYQTSLAIQNVNNPGLNTSQAASAYIRQNAVILDSAAVPLAYYLEAMGRQAKVLMQMLCPNPSERCLLYAGGYKNGGQSNGDSGNNPPRGNVNATFDMQSLVNNLDQLTKLIGETLTLNPQNTPNTKTVQVKFGNQNATIALPEGIANVMDALNNDITNALTTLWYNQTLTNRSFNSNGSVNFSPQVLQHLLQDGLATAKNGNNSADTPTDQAKAIAQNAQNIFQALMQATILGGLANEEQFGFTYNKAPNGSDSQQGYQRFSGPGYYTQNGSNTQVPLKDLPAGATVGTGSGQYTYHPSSATYYLANSIIANGITPSTIFSGMQNFANKTANLTGASSYSQMQEAINYGESLLNNTIQYGDFITNWVAPYLNNKSLNFLPNYGGKANGSSQTPQSTQQTQEQIANQLKQALADPTGAEINKILATPYSPQARALMGYGLYRSQEMIGGVINEMQNKVNEAYQVGFARNFLAYNTNSNNMNGVGVKMGYKQFFGKKRMFGLRYYGFYDFGYAQFGSGSSVVKAMLSSYGGGTDLLYNVFTRKRGLEAVDIGFFAGVQFAGQTWKTNFLDQVDGDHLKPKDTSFQVLFDLGIRTNFSKIHRQRKSRFSQGVEFGLKVPVLYHTYYQSEGVTAKYKRVFSFYLGYNIGF

SEQ ID NO: 21920 - protein, 866 aa, Pasteurella multocida
MKVSVFACAISGFALSALTIAMAHAADDDKAISAESKLEKIQITGSRLKGVDMEGANPLQSFDQEELVKRGYDTIAEFLKDLPQAASAGTFTETGGVGGADGAPAGAAGVSLRGLGSSSTLVLVNGRRVAVDSFSNGSDSFVNVNAIPMAAIERIDVLTDGASSIYGSDAIAGVINFILRKDFVGHELTAQYGNDTSDHDASRTGLTYAGGFATDNTNTTVVLDYAKRNAIFNSDRPIKVTYTSYTEMVIDGNYYAEDWCGDDTRWGGEACNYDYVIQRAIQPDFENLGATLNHQWQLDNDMTFFAEAMYQQNTGHAYEAPAGYTVTVPGDAAYVPGYVRDINAADGDDSNSIRVRTRMPERRIQEYDTESYRVLAGLRGEWGDWGWESAASYGKSTNEVTHVAGYMNRDALADAIASGSFNPFNLGMDNSEEAIAALRDSAIRRGESEVMSLDANISGELFEMDAGLVSAVFGAELRSEEIVDNPAASAVNDDVIGLGASDAAADRTQYALYGEINLPLFEGLDLITALRYDHYSDFGGDINPKVSLRYKATDDLVLRASWSTGFRAPSLSQLGAGTSLGSQYINCGAGEPFNALCGTNGAIDGELEFDQETIGNKGLDAESSEAINAGLSWNLTDNWQLTVDYWRYDHEDIVDIDASTTLNACVKGTAPVVGSVSELKGEFGCVIDGNGDISFLRTGYFNVGSQTTDGLDYRMTYRLETAAAGEFSFYVSGTETFSFERQVTPDADVEDLLGRLSGANEIARPERVLDAGTDWSLGDWSASLSAHYVSSMGDGDFRFDNETVDSWLTFSASVGVTLMENHSLMLSVRNLTDEEPPYASSPTNGYASSAHDWLGQRWNLRYSLRF

SEQ ID NO: 21921 - protein, 174 aa, Pasteurella multocida
MEKIAVAVLVGLALGSIGVANAAGYKNTVSIGYAYTDLSGWLSGNANGANIKYNWEDLDSGFGAMGSVTYTSADVNNYGYKVGDADYTSLLVGPSYRFNDYLNAYVMIGAANGHIKDNWGNSDNKTAFAYGAGIQLNPVENIAVNASYEHTSFSTDADSDVKAGTWVLGVGYSF

SEQ ID NO: 21922 - protein, 352 aa, Pasteurella multocida
MKKTAIALLALTGLAAGTAAAQTSVTLYGIADISMRYLSRSSQDDGSRFGLANGAISNSRWGLRGTEDLGDGMKAFFRLENGFSMQNGNGSDPDKTFSRLAYLGLDGGAIGTLTLGLQNTPMFNLLADHFDPLTVGNYDQNAWLPAAMSRVRTGNMFTYSNTLGGLALVLSYANGEDYDDHKVGSQYGASLRYTFGQLALGGAYQQTYSDTNSDDRQRVWNLNASYQFDSAKLFAGYFNGRDETGFVNAVMGGTPMPGLDRKDDGYFAGVTWQATPRWAVTGAAYYDRSKNVAESGDKGKRYALVAVAEYALSKRSQVYATVDYNKVKDAARDEINGGSSQLGAAVGFRHIF

SEQ ID NO: 21923 - protein, 169 aa, Pasteurella multocida
MVNHQYNTAANVQWWADYFFCARQEGGNLGGEKKPRPDISVAGCANGTLLHSDIGKDTYLIPVTTKNNVLYFGDNVQLTSWLGLDLNYRYDHVKYLPSYDKNIPVPNGLITGLFKKFGLKQYVYGNKYSVPSGYENCTYDTDCYKQNFKDNLALLLRKTDYKHHSYNLG

SEQ ID NO: 21924 - protein, 674 aa, Pasteurella multocida
MKYPLSRTTIAASLLLAFGSSFAAEPANESNVFKLGEINVAGSGARAPAVGGGSVTREDLDDFNRDTLVDALDLLPGVTTTGGGQRNERMVTVRGFDSRQVPVFIDGIPIYVPYDGNVDMSRFTTYDLSTIEVAKGFSSVLYGSNTIGGAINLVTRRPVKAFEGNVGVGIRSNDSFNSNGKSTNINLGTNQGLWYAQLGLSYLDRDAYTLSRDFRPVPEQADRERRNSYSTDKKLNLKVGLTPNATDEYALNYINQKGEKGSPPYAGKVDTARYWQWPAWDKESLYFISNTAIGQDSYIKTRLYYDKFTNRLTSYDDATYTGVSKGYAFRSFYDDHTYGGSVELGTKISDVNTLKVSLHVKKDFHKEHNLGEPEQRSEDRTTSIGIEDTHKLTNKLDLIVGASYDKRKEEIAQKWDKARGLYEFPVKDSSAFNPQAGLIYHTSETGNAYFTIARKSRFPTIKQRYSGGLGTAIPNPDLSVERAINYQLGISEKLNSKVRVDAAIFYSDITDMMQSNIVAGTVCPDSKNAGKACNQMQNIGKVASKGIELGLTAAVTNTLELGGNYTYLDRKNKSDSKYLTDAPAHKLFTYAKWAATPSMNVIGSAEYNSKRYSNDTGTRIANGFSMVNAKLSYTLQKDVTLEAGVNNLLDRNYAYSEGYYEEGRNFFANMNYRF

SEQ ID NO: 21925 - protein, 920 aa, Pasteurella multocida
MGEDTQTLDEVVVTALGIKREQKALSYNVQQVKGDELTNIKDANFINALSGKVAGVTINASSAGAGAAARVVMRGTKSLEKNDNALYVIDGIPMFNVNSGDNAGGTMNKQPGSNSVADINPEDIESMTILTGPSAAALYGSDASNGVILITTKKGTVGKVQISYSNSTSFSSPMMMPKFQNIYGNREGELGSWGSLMDTPSNFDPSDFFNTGMTEMNGFTLTTGTEQNQTYASVSTTNSTGILPNNAYNRYNFSIRNTAKFCDNKLSLDLGAQYIIQNNKNMVGSGQYFNPLVSLYLFPRGENFQEVQMYERYSEARNLMVQYWPESIFGTDLDMQNPYWIMNRMQNELSKRRYMFNASLKWDITDWVNVTGRVRVDNSDSDSYEKYYASTRGTFTESSSKGYYGHTKQNDRSVYADVMASINKNFFDDKLSLNATVGASINDIQEDAMYLKGGLEQIPNFFHYGNINVNTSKRNESKWHDQVQSVFASAELGWNHQLYLTVTGRNDWASQLAFTSKGSYFYPSVGLSWLVSESVKLPKAISYLKVRGSWAEVASSPNRYLTQMQYTYNEQTNTYEYPASHYNTNLKPENTKSWELGVNAKFLGNRINLDMTFYRSNTFNQTFYVDASASSGYKNNIVQTGNIQNQGIELALGYSDTFDKVKVSTNFTYTLNQNKIVSLANGAINPETGEAIEMEYYSKGTLGTSGGPTLRLYENGSMGDIYINQRLRQSPNGYIWKDPSNGSLAIENTEYRKVGSILPKYYLGWNGSVAWKGWNLGFAFTGRFGGLVVSDTQAMIDKYGVSESSAVARQAGGVWVGDSKVDAEEYYSKVTTAVGTYYTYSATNIRLSELSLSYQLPKTWFKNHVNMTLGLTGKNLWMIYCKAPYDPESTSSVTSNFYQGVDYFQQPSLRSLGFNVKLTF

SEQ ID NO: 21926 - protein, 461 aa, Pasteurella multocida
MDKNLKVSAFTAAMLGAFASAPTMANDPIGPEYASQVSEFFSESTISGNVNFFMRARDRGNVDANGNDTKKVTNLDHGSIFANLGFNSGYVGDVVGLDVVVFSTFDMWQNGGADHEMNFWGVNNPYDKAAKDSACSDVWTDCTDNGVSFATAAAKFKLGSSATAKLGYFQPSVPSSLGVNWSFAPGTYLGGEVGGKIGGFDLGLVVATEYKAPWFKETYEFRTTKGKDAGTLYSVGGRYTLNNGISLDAAYGGLSDGDRRNAHFKVKGTTDGGLYWSPQLYIVDDNEQYDSTAFQLALLTSLSSGQYSYRAEATYTGADSGDPANVGNMSYRLTSQYGGSNGAYEIWWNNRSDFNHDEELAVFASVSRDFSDIGGKGFSAGLSGAYGFGSSAQGFDDLSEYAYSVFANYAIQAGALKDANISFYYTNYYNDTNAPNWTGYSNLFQDEEDFKLALTIPFAVK

SEQ ID NO: 21927 - protein, 386 aa, Pasteurella multocida
MKKTLIALAALGAMAGAAQAQSTVTLYGLLDADFGSFKTNVGVGSSVQSLKQVKIDGGGLNGNRWGLRVKEDIGGGMAVIGNIESGFDISTGASSQGALFGRKAIVGLAGGFGTVTLGRNTSSYDDVAADHAMMGATIFDPSNTNTNNGNSTTTASAALLGLTVPSAAGATALASFLGRNTTWIGYNSRFNNSVKYASPSFGGFSGGLMYGLGEDKTTTSSASKTVSANLKYANGPLLISGGYQSEAVSRTATAKPALENTLLNFAYNFGVAKVGLGFNRAKYKDVINPSTGTEIDPQKEVSLSVAVPLGATTLSAGVARSKGDDLGKSTGFGVQALYSLSKRTTLYAGALSTKAYSDLADETKLVYPTSNIGRTTTYAAGIRHTF

SEQ ID NO: 21928 - protein, 349 aa, Pasteurella multocida
MSLTFSSHAAINLTSGGVNLQLSGLIDTGIASVSNVKQGTKTKTTGVDSILGVSNLGLSGDYKIDEDYQAFFKLQAGFNPSKGEQSKDGELFDRNAYIGMKTPYGAVSIGKQWTFNDDWLVGSVFKGGYNSGAIFKFSEFDAVSEIYSNLVKYTSPEMNGWQFGAIYGLKDDSTKNTHGQIFSGAFKYATNQWMIGGAYEDHEAQDNDHHYKLSTLASRYNFSKLSTRLGIAYADIDGPGQYAAIASNSVKQQAWATEIGIDYLFTPKLTLSGDIIYKENTTFDHHAMVYRALAIYQVRQPLSLIANVAYLKNSDGSSESLVNTDSNLAGGGYANQDQLSTAVGVRLTF

SEQ ID NO: 21929 - protein, 401 aa, Pasteurella multocida
MKLKKLSVAVMALAALPATQAMAEGDNGFKVDLGLKTFYMNRDFNQGINDTIAAGQAIRLDVDSPMWNDTIGFGLGAVQVLELTDRKTVNSSDVLNPEGDGYGTLEQAFIKFKPIENLDIKAGRMVMMTPLLNDLTSRISAPSTQGVHANLALENGSLYAIYSDEASMNNEEGFVAYSKNGEEYEIVSLGGTYKFSNGLSTHLQYAVADDYQKQSYFNLNYPTKLGDYDLSLDLAHMRGESDGALYGNDNYESNLTGLTARLSHGNLAYTLAYQTIGGNAAYDQKWGGDDNTQFFTWGAVQLLDFNAKDEQSLQARIDYDVPSVPGLHLMARHTESWDIDYNGGDDGQRRETNFDVKYTLQDGAAKGLSMRLRVAHADGDAAVVPRINDIRFIVDYKTNLF

SEQ ID NO: 21930 - protein, 342 aa, Pasteurella multocida
MKKTVLAALLPAMLVAGAAQAATVYQGEDGSNVDVYGRLGFNISDKGSEDTQGNFDGRFGLGGSQTVNDKVSVIGWAEYQVNAAEGANAGKGNDSLTARYVWAGIDASEYGKITGGRVASGLIMLTDIADVFAASDVAIARQVGDVDSTATQVFRQDGTLQYQNSFDALDVSVAYILGNGSSDLDAAYNTALRYTFDLGNAGKLAPVVAYQYNKGNDGDKYTFWGAGTRYYVGDLMLGAMYSEDEVKRDGSSAKSTDEVYELTAVYDLNADWVLRAGYRSLDNKDGDNLELKDTTFEAQYKLTDRSSIFTSYVFRDGDNGQSQGFAGDASEDFYHLGLRYEF

SEQ ID NO: 21931 - protein, 372 aa, Pasteurella multocida
MRTTSLALCGATLALASGAALAADSSVTLYGIADTFIQYLGNGGAHSFAERSGGSSTSVFGLTGTEDLGGGLRVRFVLENGFNVNNGSLYLDSTAMFVRQSWIGLQHDRYGTLSFGRQYGPGFYLVYPTDPFGLNDATSLYSGNMATIDRRTLATQYDTGRADNSILYQSPVLGGWRLRAMYAFASSVTQPLRRTNGNEFGATLSYSGHGLYAGIGYGNQRSGTLSFPGLPAALDVPSAQYFGAALGYRWGIVNFQFHYTYSRPDDPSPGSLTARLDSAHPYSVVQFGATIAATVSDTIEVAVVHRNVRGAHDNAIGAELGIDHSLSKRTSVYARAGWIRNNGSSTASWSGVSVSAPGATQVLAGVGITHRF

SEQ ID NO: 21932 - protein, 230 aa, Pasteurella multocida
MKINRYLLGMVSFIEFSSYLQAATLDYRHEYADRTRINKDRIAIIEKLPNGIGFYVDASVKSGGVDGEQDKHLSDLVANAIELGVSYNYKVTDHFVLQPGFIFESGPDTSIYKPYLRGQYNFDSGVYMAGRYRYDYARKTANYNDDEKTNRFDTYIGYVFDELKLEYNFTWMDSDQIKFDNKKTNYEHNVALAWKLNKSFTPYVEVGNVAVRNNTDERQTRYRVGLQYHF

SEQ ID NO: 21933 - protein, 699 aa, Pasteurella multocida
MSFKGRLSFSISMFALMASPAFADERDNDYHRPESADIIVTAPLQRDRMDVLAGTSVLTGAQLTTALRPTIGETIEHTPGVSATSFGPNASRPILRGLQGERVRVLTDGIGSVDVSNTSVDHAVAINPLLAERIEVLRGPEALLYGSAAIGGVVNVIDKRIPRAIPDEPVHVDAILTYGSAANERSGGAALDAPIGGGFVAHLDGSYQKTGNLRIGGYALSPAARAQALASAQLPADPDEEIDFAANAAVKGKLPNSQSETWVAGGGLSYIDGDSHYGIAYSHYDSRYGVPIRFATEPGQEQEAPRIDLVQNRFDARAEIAAGGSVIQTIRARLAYAKYRHFELEEDGSVGTAFYNNGFEGRVELVQADHGAWHGATGAQFFIRDFNVVGDEAFLPRNQTQQIGLFTLQQLDYGVVKLEGGLRYEKSWLSANPFEDQPQFPKGSRNFDTLSGSIGASYRVTDDWRLGVNLSRTERAPAAEELFANGPHAGTEAFEIGSPDFKTERSWGLEGVLHGKGPGFTIHASIYHNWFDNFIYDSPDGTLEDGLPVFRYAQAKARFYGAELEATADLAQLGGFAIKADALGDFVHAKITGFGPAPRIPPLRLLGGLSAESARVDGRVEVEWTDKAQRLASFETPTAGYTLVNASLTLRPFADRPETSIVLAAHNIFDVNARRHASYLKDFAPLAGRDFRVTARVGF

SEQ ID NO: 21934 - protein, 179 aa, Wolbachia endosymbiont
SYYVRLQYNGEILPLFTKVDGIAHKSGKDNNSPLKASFIAGGGAFGCKMDDIRVDVEGPYSWLNKDADVVVDTVAESLTAISGLVNVYYDVAIEDMPITPYVGVGVGAAYISTPLATAVSSQNGKFAFAGQARAGVSYDVTPEVILYAGARYFGSYGANFDKTDKDGKGELKVIYSTVG

SEQ ID NO: 21935 - protein, 185 aa, Salmonella enteritidis
MKKIVLSSLLLSAAGLAAVPVAQADTHSVSVGYAQSRIEHFKDIRGVNLKYRYEAQTPLGLMASFSWQSGKRGESGGIPGGMSWRDDVKATYWSLMAGPAVRVNELVSLYALAGAGTGRAEVKERISMPGYNGRFTGSERRTGFAWGAGVQFNPVENVVIDLGYEGSKVGAAKLNGVNVGVGYRF

SEQ ID NO: 21936 - protein, 196 aa, Wolbachia sp.
ISDEETSYYVRLQYNGEILPLYTKVDGIKYEKESKAQDPLKASFIAGGGAFGYKMDDIRVDIEGLYSQLNKNDVTGAAFTPDTVADNVTAFSGLVNVYYDIAIEDMPITPYIGVGVGAAYLSNPSKADGVKDQRGLGFAGQVKAGVSYDVTPEIKLYAGARYFGSYGASFKKATASTNKDINVLYSTVGAEAGVAL

SEQ ID NO: 21937 - protein, 192 aa, Wolbachia sp.
ISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 21938 - protein, 1522 aa, Wolbachia sp.
ISAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKVHGGAAINANDLSGLGSITFAAAPSVLEFNLINPTTQEAPLTLGANSKIVNGGNGTLNITNGFIQVSDNTFAGIKTINIDDCQGLMFNSTPDAANTLNLQAGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKTGVVDASSLTNNQTLTINGSIGTVVANTKTLAQLNIGSSKTILNAGDVAINELVIENNGSVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLTIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNSIFTLNKVKSKSQRYFFESNGKMSKQIAAGNYDNMTFGGNLIFGYDYNAMPNVLVTPMAGLSYLKSSNENYKETGTTVANKRIN

SEQ ID NO: 21939 - protein, 190 aa, Wolbachia sp.
SYYVRLQYNGEVLPFKTKIDGITYKTGKDNNSPLKASFLAGSGAFGYKMDDIRVDVEGLYSQSSKDVDVVDGNPGVVKSLTAFSGLVNVYYDIAIEDMPITPYVGVGVGAAYVGNPLVTKVAGDKESGFGFAYQAKAGVSYDVTPEIKLYAGARYFGSYGANFGKAAKGDGGIKVLYSAVGAEAGVAFNF

SEQ ID NO: 21940 - protein, 185 aa, Wolbachia sp.
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVG

SEQ ID NO: 21941 - protein, 379 aa, Klebsiella pneumoniae
MMKRNILAVVIPALLVAGAANAAEIYNKDGNKLDLYGKVDARHQFSDNAGQDGDESYVRFGFKGETQITDQLTGYGQWEYNVQANHAESQGDKGNKTRLGFAGLKFAEFGSLDYGRNYGVIYDVNAWTDMLPVFGGDSISNSDNYMTGRSTGLATYRNTNFFGLVDGLNFALQYQGKNEDGRNGVVETTDALGNVTSTTYSNLKDQNGDGFGISSTYDIGYGVNFGAGFSSSNRTDQQKRFSTAEGDKAQAWNVGAKYDANNVYLAVMYAETQNMTPYGDANDTIANKTRDIEITAQYQFDFGLRPSLGYVQSKGKDLNANGDNQDLLKYVSVGSYYYFNKNMSTYVDYKINLLDENDFTRANGLNTDDVVGVGLVYQF

SEQ ID NO: 21942 - protein, 720 aa, Xanthomonas oryzae
MSATFPLLSRCPLALVLALCCTPALAQQQPDANAVELDAVNVRGERVETSTALSGFGATRLLDAPASIALIDRQQLLDRQARVLSEVLRADASAGDAYAPIGYYENFVVRGYSLNAANSYRINGMSAVGEQSIALENKQQVQLLKGLAGLQSGVNEPAGLIDYRTKRPEHVRSVTLGTDEQGSRYLAADLGDWFGAERTLGVRINAAREDIDSDVDHADGYRNFLSLAGDWKITPQALLQLDVEYQHRQQRSVPGYQLLGGTQVPRDIDVHRLLGYQPWARPVEMDSLNAQFRYAYQFNDDWRATADASRSRSTINDFSAFAWGCYGAASCADFATPNFFSAQGEYDVYDYRSPDDTRVHNQLRATLEGRVATGALEHRLSVGGEWLRRTIDRFGSVNAFVGSGSIDRDPEVFAQTDVPLAPKQRRLDSRQRALVLADRIGLGAQWELSLGGRYVQLDERSFDRDGLLERRMRKDTVLPQAALLFKPQQNVSLYASYAKSLAAGGTAPWFADNADEILPPTNAYQLETGAKIDLQSLRLGAALFDIRQAYQFTQPQADGGLLYVQQGRLHNRGLELSADGAATRQLRLFASIAAIRARAEDTDIAEYEGHQAINVPKLRASVQADYSVPGVDGLALLAGVQYSGRKFADRLGNASVPAYAVANLGARYATALGGLATTWRLNVDNVFDKRYWRDSGEYQGDAYLFPGAPRTARLTVQVDF

SEQ ID NO: 21943 - protein, 304 aa, Neisseria gonorrhoeae
PVAAMADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVAT

SEQ ID NO: 21944 - protein, 325 aa, Neisseria gonorrhoeae
PVAAMADVTLYGAIKAGVQTYRSVEHTKGKVSSVETGSEIADFGSKIGFKGQEDLGNGLKAVWQLEQGASVAGTNSGWGNKQSFVGLKGGFGTIRTGSLNSPLKNTGANVNAWESGKYTGEFLEISKMAQREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGAKRANSHNSQTEVAATAAYRFGNVTPRVSYAHGFKGTVDSADHDNTYDQVVVGAEYDFSKRTSALVSAGWLQEGKGADKIVST

SEQ ID NO: 21945 - protein, 304 aa, Neisseria gonorrhoeae
PVAAMADVTLYGTIKAGVETSRSVAHHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNHSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVAT

SEQ ID NO: 21946 - protein, 325 aa, Neisseria gonorrhoeae
PVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEYDFSKRTSALVSAGWLQEGKGADKIVST

SEQ ID NO: 21947 - protein, 325 aa, Neisseria gonorrhoeae
PVAAMADVTLYGAIKAGVQTYRSVEHTKGKVSKVETGSEIADFGSKIGFKGQEDLGNGLKAVWQLEQGASVAGANSGWGNKQSFVGLKGGFGTIRVGSLNSPLKNTGSKVNAWESGKFTGNVLEISGMAEREHRYLSARYDSPEFAGFSGSVQYAPKDNSGSNGESYHVGLNYQNSGFFAQYAGLFQRYGEGTKKIEYDDQTYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEYDFSKRTSALVSAGWLQEGKGADKIVST

SEQ ID NO: 21948 - protein, 325 aa, Neisseria gonorrhoeae
PVAATADVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVST

SEQ ID NO: 21949 - protein, 325 aa, Neisseria gonorrhoeae
PVAAMADVTLYGAIKAGVQTYRSVEHTDGKVNKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDNQAYSIPSLFVEKLQVHRLVGGYDNNALYVSVAAQQQDAKLYGAKKANSHNSQTEVAATAAYRFGNVTPRVSYAHGFKGTVDSADHDNTYDQVVVGAEYDFSKRTSALVSAGWLQEGKGADKIVST

SEQ ID NO: 21950 - protein, 325 aa, Neisseria gonorrhoeae
PVAAMADVTLYGAIKAGVQTYRSVEHTDGKVNKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGAKKANSHNSQTEVAATAAYRFGNVTPRVSYAHGFKGTVDSADHDNTYDQVVVGAEYDFSKRTSALVSAGWLQEGKGADKIVST

SEQ ID NO: 21951 - protein, 192 aa, Neisseria gonorrhoeae
PSYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAF

SEQ ID NO: 21952 - protein, 326 aa, Neisseria gonorrhoeae
PVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVST

SEQ ID NO: 21953 - protein, 325 aa, Neisseria gonorrhoeae
PVAATADVTLYGAIKAGVQTYRSVEHREGKVVGVETGSEISDFGSKIGFKGQEDLGNGLKAVWQLEQGVSVAGTNSGWGNKQSFVGLKGGFGTIRAGSLNSPLKNTGSKVNAWESGKYTGEFLEISKMAEREHRYLSARYDSPEFAGFSGSVQYAPKDNSGSNGESYHVGLNYRNNGFFAQYAGLFQRYGEGTKKMEGSLYNIPSLFVEKLQVHRLVGGYDNNALYASVAVQQQDAKLYQNQLVRDNSHNSQTEVAATAAYRFGNVTPRVSYAHGFKGTVDSANHDNTYDQVVVGAEYDFSKRTSALVSAGWLQEGKGADKIVST

SEQ ID NO: 21954 - protein, 325 aa, Neisseria gonorrhoeae
PVAATADVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQHYSIPSLPVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVST

SEQ ID NO: 21955 - protein, 325 aa, Neisseria gonorrhoeae
PVAATADVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKIVST

SEQ ID NO: 21956 - protein, 303 aa, Neisseria gonorrhoeae
PVAAMADVTLYGTIKVGVETSRSVDHTGRANRVKTATEIADLGSKIGFKGQEDLGNGLKAIWQLEQKAYVSGTNEGWGNRQSFIGLKGGFGKVRVGRLNSVLKDTGGFNPWEGKSDYLSLSNIAEPEARHISVRYDSPEFAGFSGSVQYELNDNSNKYNSESYHAGFNYKNSGFFVQYAGAYKRHHYATEKHQVHRLVGGYDHDALYASVAVQQQDAKLALIDDNSHNSQTEVAATVAYRFGNVTPRVSYAHGFKGLVYHADLSNDYDQVVVGAEYDFSKRTSALVSAGWLQEGKGAEKFVST

SEQ ID NO: 21957 - protein, 323 aa, Neisseria gonorrhoeae
PVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEEYTYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSVGWLQEGKGADKIVST

SEQ ID NO: 21958 - protein, 325 aa, Neisseria gonorrhoeae
PVAATADVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGPEHRYLSARYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKIVST

SEQ ID NO: 21959 - protein, 252 aa, Zymomonas mobilis
DGDQTYVRLGFKGETQVTDQLTGYGQWEYQIQGNTSENKENSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLYLGNGDRAETYTGGLKYDANNIYLAAQYTQTYNATRVGSLGWANKAQNFEAVAQYQFDFGLRPSVAYLQSKGKNL

SEQ ID NO: 21960 - protein, 163 aa, Wolbachia pipientis
DEETSYYIRLQYNGEVLPFKTEVDGITGAKKKTTDTNTTTDLYKASFMAGGGAFGYKMDDIRVDVEGLYSQLSKDVAGDTPAVADDLTAISGLVNVYYDVVIEDMPITPYVGVGVGAAYIKNPLDTPVGDQKHGFGFAYQAKAGVSYDVTPEIKLYAGARYFG

SEQ ID NO: 21961 - protein, 206 aa, Wolbachia pipientis
DEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAEAGVAFNF

SEQ ID NO: 21962 - protein, 174 aa, Wolbachia pipientis
ETSYYVRLQYNGEFLPLYTKVDGITGAKKDSKETKDLYAASFKAVGGAFGYKMDDIRVDIELLYSQLGKDKDVTGANPEIASDLMAASALANVYYDIAIEDMPITPYVGVGVGVAGVSTPLNTVVSEQKYKFGVAGQVKAGVSYDVTPEIKLFAGARYFGSWGANFDKDATTGK

SEQ ID NO: 21963 - protein, 361 aa, Pasteurella multocida
MMKKALVAAALMAAGVVTAHAQSSVTLYGRLDAGLEYLNGLQNGHQVRAESGDWGTSLWGLKGSEDIGGGNKVLFHLEGAFNTMNGGLGTSGSIWDRFATVGISNDRYGTLLLGRELAIANGVWDFDPLGQSSWSSASLVRGRNWNKTSNNVSYQSPQFYGLDFYGQFAFSNSTSFNGNTTAGQPGRAAGAQVTYTNSLFQVRGIYDETRDSNGRFSDVFNYSREYFAGLNVFLGQFKLQAAYQSSHADGSGGPAVNNGITGTQQVWGGVTWQATPAAALIAAVYHVNANHGGGNANIYTVGGSYNISKRTLFDLQVATVRNSSTANFGLNANGAGTAVSTGNPHPGGSQTGVYAGIQHLF

SEQ ID NO: 21964 - protein, 740 aa, Campylobacter jejuni
MMSIRIQNPAPRHLQGARTPLSLLICALCAAPAPAVWAADEDRPPARNSDTELGTVTVRAAADAGTTEGTARYTSGSTGTATGLQLSARETPQSVSVITRQLMDDAGQLTVSQTLEASAPGLSVSRSDSNRYQFSSRGFGVSNFQFDGLASPINSLWNFGATDMDTAFYDRVEIVRGATGLLNGSGDPSATVNFVRKQPRETAGGHTSLTLGRWNLRRAEADLSLPLDREGRVHGRVVAVQSDSDSYVSHFGQRRQGLYAVVSAALTPATRLVTSLEYQKNTSPGMGAGFPLFYADGSRTDFDRSVSNNARWSHFGTENTTATLDLTHRLDNRWLLRAAYSRNDGNYDMRYVYRGGAPDASTGLGMANSFIKYRGDRSRDSLHLTASGPVALFGRQHEIAVGWNHVRDDIDIRRYAPLGTPPATDNFLDWRNGSLAEPGWSDASNGGDDSRMRQSGGYAVGRFSLADGWTAVAGARLSRWSTRQNYFGSLRDYRYSNEITPYAGLLWDIDARHTAYLSYTEIFTPQNYRDKQGSILDPVTGQAFELGLKGSWLQDRLQGSAALFQTRQDNLAQDTGEFIDGTTDQKAYRGVKGAQVRGIDLELSGEPARGWRLGASYTHYTARSASGAAFNTTHPRSLVKLTAMRSFEGALQGLSLGGNLRWQSRIWQNVTNPLRQSVQVGQGSYLVVNLSAHYRIDPTWSASVQLNNLLDRQYYSQIGFYNQGWWGEPRNLTVSLKADF

SEQ ID NO: 21965 - protein, 1009 aa, Rickettsia prowazekii
MAQKAGKSLTISGIVVDKSSDKEPIIGANIFLKDRPGVGTTTDLDGRFKVQAHKGDVLIVNYIGYDKIEYFVTDSQTNLVLKMTPSATALDEVVVVGMGTQRKVSVVGAITSVDIGDLAVPATSLNNSLGGRVPGVISIQSSGEPGKNISEFWVRGIGTFGANSSALVLIDGLEGDLSQVDPADVESFSVLKDASATAVYGVRGANGVILVTTKRGTVEKLKITARANFTISQLKRLPKYLRAYDYAKLANEARVVSGEKELYSPMEMDLIQYQLDPDLYPDVNWQDEILHKTSFQQTYYVSAQGGGSIARYFVSMGMSKESAAYIQDPDSRYKADTGYNTYNYRTNLDINVTKSTTLYLGLDGFISNKKEPGMANTDLLWNAQSMLTPLTIPTRFSTGQLPAYGVNDAYSPYVMLNHTGMATRETYKNMVTLALNQDLSFLLKGLKVKVQGALNSDVYYDETRFVMPEMYSAIGRTTSGELQLAKKVDAQAATFSKTLNHWRKYHFEFTANYERLFNDKHRTTALLYYYMSDEKATKDITDSMSAIPKRYQGVSGRITYSFKDTYFIDANFGYTGSENFEPGKQFGFFPSGAIGWVPTNYDFMRKAVPWLDFLKIRFSYGQVGNDRISNKRFPYLTIINSNAATGWGSDSNGVNESIVGADNLAWEKSTKADVGIEAKFFKEKLSLVVDYFNDQRNGIFQQRTQVPDFAGIITMPYGNVGKMRSYGADGNISYSQDIGKDFSFTIRGNFTYSKNDVQNWEQADPKYPYQQISGMPYGVQRGYIALGLFRDDQDVESSPSQFGTVRPGDIKYKDVNGDGRITEDDQVPLAYSNYPLLMYGFGGEFRYKSFTLACLFKGTGNTTYFKVGNGYEMGYVPFHGEKTGNVPVEAGVQANRWTPAWYSGDPSTENPNAAFPRLSYGKNENNTKKSTFWKDNARYLRLQEISLTYNLKTKGFVKRLGIQSFDFQLVGYNLAVWSGVKTVDPEQAQKMGRVYPIPARYAFQTYIHF

SEQ ID NO: 21966 - protein, 1643 aa, Rickettsia prowazekii
MAQKPNFLKKIISAGLVTASTATIVAGFSGVAMGAAMQYNRTTNAAATTFDGIGFDQAAGANIPVAPNSVITANANNPITFNTPNGHLNSLFLDTANDLAVTINEDTTLGFITNIAQQAKFFNFTVAAGKILNITGQGITVQEASNTINAQNALTKAHGGAAINANDLSGLGSITFAAAPSVLEFNLINPTTQEAPLALGANSKIVNGGNGILNITNGFIQVSDNTFAGIKTINIDDCQGLMFNSTPDAANTLNLQVGGNTINFNGIDGTGKLVLVSKNGAATEFNVTGTLGGNLKGIIELNTAAVAGKLISQGGAANAVIGTDNGAGRAAGFIVSVDNGNAATISGQVYAKNMVIQSANAGGQVTFEHIVDVGLGGTTNFKTADSKVIITENSNFGSTNFGNLDTQIVVPDTKILKGNFIGDVKNNGNTAGVITFNANGALVSASTDPNIAVTNINAIEAEGAGVVELSGIHIAELRLGNGGSIFKLADGTVINGPVNQNALMNNNALAAGSIQLDGSAIITGDIGNGGVNAALQHITLANDASKILALDGANIIGANVGGAIHFQANGGTIKLTNTQNNIVVNFDLDITTDKAGVVDASSLTNNQTLTINGSIGTVVANTKTLAQLNIGSSKTILNAGDVAINELVIENNGQVQLNHNTYLITKTINAANQGQIIVAADPLNTNTTLADGTNLGSAENPLSTIHFATKAANADSILNVGKGVNLYANNITTNDANVGSLHFRSGGTSIVSGTVGGQQGHKLNNLILDNGTTVKFLGDTTFNGGTKIEGKSILQISNNYTTDHVESADNTGTLEFVNTDPITVTLNKQGAYFGVLKQVIISGPGNIVFNEIGNVGIVHGIAANSISFENASLGTSLFLPSGTPLDVLPIKSTVGNGTVDNFNAPIVVVSGIDSMINNGQIIGDKKNIIALSLGSDNSITVNANTLYSGIRTTKNNQGTVTLSGGMPNNPGTIYGLGLENGSPKLKQVTFTTDYNNLGSIIANNVTINDDVTLTTGGIAGTDFDAKITLGSVNGNANVRFVDSTFSDPRSMIVATQANKGTVTYLGNALVSNIGSLDTPVASVRFTGNDSGAGLQGNIYSQNIDFGTYNLTILNSNVILGGGTTAINGEIDLLTNNLIFANGTSTWGDNTSISTTLNVSSGNIGQVVIAEDAQVNATTTGTTTIKIQDNANANFSGTQAYTLIQGGARFNGTLGAPNFAVTGSNIFVKYELIRDSNQDYVLTRTNDVLNVVTTAVGNSAIANAPGVSQNISRCLESTNTAAYNNMLLAKDPSDVATFVGAIATDTSAAVTTVNLNDTQKTQDLLSNRLGTLRYLSNAETSDVAGSATGAVSSGDEAEVSYGVWAKPFYNIAEQDKKGGIAGYKAKTTGVVVGLDTLASDNLMIGAAIGITKTDIKHQDYKKGDKTDINGLSFSLYGSQQLVKNFFAQGNAIFTLNKVKSKSQRYFFESNGKMSKQIAAGNYDNMTFGGNLIFGYDYNAMPNVLVTPMAGLSYLKSSNENYKETGTTVANKRINSKFSDRVDLIVGAKVAGSTVNITDIVIYPEIHSFVVHKVNGKLSNSQSMLDGQTAPFISQPDRTAKTSYNIGLSANIKSDAKMEYGIGYDFNSASKYTAHQGTLKVRVNF

SEQ ID NO: 21967 - protein, 1616 aa, Rickettsia sp. California 2
MGAATQQNRTTNRAATTVDGAGFDQTVAPANVAVALNAVITANANNGINLNTPAGSFNGLFLDTANNLAVTVSADTTLGFITNAANQGNSFDLMLGAGKTLTITGQGITNAQAAVTKNAQNVVAQFNGGAAIANNDLSGVGTIDWGAADSTLVFNLANPTTQKAPLVLGNNTVIANGVNGTLNVTNGFIQVSDKSFATVKAINIDDGQGFIFNTDATVGNALNLQAGGATINFNGTDGTGRLVLLSKNGAATDFNVTGSLGGNLKGIITFNTVAVAGQLIANAGPANAVIGTNNGAGRAAGFVVSVDNGNAATIAGQVYAKDMVIQSANAGGQVNFGHIVDVGTDGTTAFKTAASKVAITQNSNFGTTDFGNLAAQITVPDTMTLTGNFTGDASNPGNTAGVITFAANGTLASASADANVAVTNNITAIEASGIGVVQLSGTHTAELRLGNAGSVFKLADGTVINGKVNQTAVVGGALAAGAITLDGSATITGDIGNGGGAAALQGITLANDATKTLTLGGANIIGAVGGTIDFQANGGTIKLTSTQNNILVDFDLDITTDQTGVVDASSLTNAQTLTISGTIGTIGANNKTLGQFNIGSSKTALDGGNVAINELVIGNNGSVQFAHNNYLITSTTNAADQGKIIFNPVVNNNTTLAAGTNLGSAANPLAEINFGSKGAHADTILNVGEGVNLYATNITTTDANVGSFVFNAGGTNIVSGTVGGQQGNKFNIVALDNGTTVKFLGNATFNGETTIEANSTLQIGGNYTADFVASADGTGIVEFVNTGPITVTLNKQAAPVGYLKQITVSGPGNVVVNGVGNAGNNPGAATDTIAFENSSLGAALFLPSGIPFNDAGNTMPLTIKSTVGNKTATGFDVPKVIVLGVDSVIADGQVIGDQNNIVGLGLGSDNGIIVNATTLYAGIGTINNNQGTVTLSGGVPNTPGTVYGLGTGIGASQLKQVTFTTDYNNLGNIIATNATINDGVTVTTGGIAGTDFDGKITLGSVNGNANVRFADGIFSNSTSMIVTTKANNGTVTYLGNACVGNIGDSNTPVASVRFTGSDDGAGLQGNIYSQVIDFGTYDLNILNSNVILGGGTTAINGAINLLTNTLTFASGTSTWGNNTSIKTTLTVANGNIGHIVIAEGAQVNATTTGTTTINVQDNTNANFSGTQTYTLIQGGARFNGTLGGPNFAVTGSNRFVNYGLIRAANQDYVITRTNNAENVVTNDIANSSFGGAPGVGQNVTTFVNATNTAAYNNLLLAKNSADSANFVGAIVTDTSAAVTNAQLDVAKDIQAQLGNRLGALRYLGTPETAEMAGPEAGAIPAAVAAGDEAVDNVAYGIWTKPFYTDAHQSKKGGLAGYKAKTTGVVIGLDTLANDNLMIGAAIGITKTDIKHQDYKKGDKTNVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDLAVYPEAHAFVVHKVKGRLSKTQSVLDGQVTPCISQPDRTAKTSYNLGLSASIRPDAKMEYGIGYDAQIASKYTAHQGTL

SEQ ID NO: 21968 - protein, 444 aa, Enterobacter cloacae
MVMSQKTLFKKTALAVAVAIVSTSAWSAGFQLNEFSSSGLGRAYSGEGAIADDAGNASRNPALIMMFDRPMFSAGAIFVDPGVDITGTSPTGASLNSDNIAPTAWVPNLHFVAPINDQFGWGASVTSNYGLATEFNNNYAAGAYGGKTDLETLNLNLSGAYRLNNHWSFGVGFDAVYARAKIERYAGDLGQIVAGSGVLPPIPGLAQQVAGLPADTQIAHLKGDEWGFGWNAGILYEIDKDNRYGFTYRSEVKIDFDGDYKSSLPSAYNQILGSFGLPMGTDGRTTGGSLSLHLPEMWELSGYNKVAPQWAVHYSLTYTSWSQFQELKATNSNGDTLFYKDESFRDAYRIALGTTYYMDDNWTFRTGIAFDDSPVPADKRSISIPDQDRFWLSAGATYAFNKDASIDAGVSYMHGQKVSFQEGPYEFSSEGKAWLYGMNFNYAF

SEQ ID NO: 21969 - protein, 198 aa, Wolbachia sp. wAnd
GPISDEETSYYIRLQYNGEILPLFTKVDGITYKKDNSDYSPLKASFLAGGGAFGYKMDDIRVDVEGVYSYLNKNNVTDARFTPDAIADSVTAISGLVNVYYDIAIEDMPITPYVGVGVGAAYISTPLKDAVNDQKSKFGFAGQVKAGVSYDVTPEVKLYAGARYFGSYGANFDKSVGEKDKGGHTVLYSTVGAEAGVA

SEQ ID NO: 21970 - protein, 193 aa, Wolbachia endosymbiont
SYYAKGEVGLAMPKKVDGDKLKKSVIFGIEGGYKMNENFRFGLGIGMLNNVKPKDVPAGTTAPKASSLFGEVNAYYDIGEFNGFTPYLTAGVGVSRNKLKNNVSSSSGGGTATLSSTTPAGKKTGAGKIVTVGSDSKTKTNFAWNVGLGAMYNIDPEFAVDLTYRYRDLGKVMKGDNDKLKSHNVTVGLVYKF

SEQ ID NO: 21971 - protein, 158 aa, Wolbachia endosymbiont
SYYVRLQYNGEILPLFTKVDGIAHKSGKDNNSPLKASFIAGGGAFGCKMDDIRVDVEGPYSWLNKDADVVVDTVAESLTAISGLVNVYYDVAIEDMPITPYVGVGVGAAYISTPLATAVSSQNGKFAFAGQARAGVSYDVTPEVILYAGARYFGSYGA

SEQ ID NO: 21972 - protein, 3705 aa, Yersinia pestis
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASDIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLSASNLIINVANTLGTALQITDGIDNTTTIGNEIQLNAENATAINFLGSSSKTLNNNGTIKGSVIFAGVADHIINNNGTLDGTLTTGAGNDTLVLDSSSQSNDVINLGDGNNSVTIQNGATVSSIITGNGNDTFTINGMSVGSTYLGSLDAGTGLNTLNFNASTDELAAATSLQGFTNINLVDSHITLVSDDNIGSGMVNIDSSSELLFGSTFDGILHATLGAGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDIDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTAGGASTVAGGLTGAGTLNINGGNLSVSAANSGLSGQTHIADVASVTLTDTGTLGTSAVEVLGTLNLNGANAAMTNVLSGDGTINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVSNAVTIDIADATLNLDDIALFNHVLTGNGLLNVAKNDASTAFDFGSTVGGAFSGIVNLTNTTFALSADNAAALARATLKLSDDSVTTVGATDRTLHGLDLNGGTLIFDGSPPQSQANGVVTVTDLALNSGTISITGAGNWENEHPVTPPNVSLLEQDRGDILLELINAANVTGNANNLDLLVDGTAITSGTQGVESAIQQGGSTVANAIHNYGLTSSNGNGGSGLYVNYTLSALELLANGANALLLATESGLTANRVLNAELFGVGGLVVDAQNGALTLANGNNRYEGTTTVTAGELILGANGAFGQTSLLNIASGASANINGYRQTVGAVTNSGAVTLGNGGVLTSGLLTNGGILDLTGGALNLAAGGSSTVAGGLTGAGTLNINGGDLAVSATNSGLSGQTHIADVASVTLTGTGTLGTSAVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNTVKVDIADATLNLNDIALFDHVLTGNGTLNVAKNLATTAFDFGSTVGGAFSGIVNLTNTTFALSADNAAALARATLKLSDDSVTTVGTTDRILHGLDLNGGTLIFDGSPPQSQANGVVTVTDLALNSGTISITGAGNWENEHPVTPPNVSLLEQDRGDILLQLIDADNVTGNANDLELMINGTTISAGQGVQSTVQQGGYTVANATHNYGMTSNGGSGLYVNYTLSALELLADGANALLLATESGLTANRELNAELSGVGGLVVDAQNGALTLANGNNRYEGTTTVTAGELILGANGAFGQTSLLNIASGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALLVSFASNMANLTSNVLITANGSLGGYGQVTGNVENYGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTEADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNRVSGQDLATEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQVNSQLNLWGNIGQQVGNKGYSETSVVLGVKYNF

SEQ ID NO: 21973 - protein, 1050 aa, Yersinia pestis
MVMKNVTKKIQKIPYLFLLMLFSFVTASAQKGITVRGTVLDSNGETIIGASVTLKGNNSVGTISDIDGNFVLTVPSEKSVLIVSYVGMKPQEVKVSSKGMIKVTLEDDTKQLEEVVVVGYGQQKKASVVGAITQTSGKTLERAGGVTSLGSALTGSLPGVITSASSGMPGAEDPQIIIRTQSSWNNSEPLILVDGIEREMSSVDISSVENISVLKDASATAVYGVKGANGVILITTKRGKEGKASVQIKANVTAKVASKLPEKYDAYDTFYLLNNSIEREACLNPNGWNDYTPTSIIDKYRHPANAEEWDRYPNTDWEKALFNSTAMSYNTSVNVSGGTKIVSYFAAADFVSEGDLFKVYDNRRGYDYGFGYNRINVRSNLDFQLTKTTKFSTNLFGSNAQRTVPWDYNDQDATFWAAAYKSAPDAMRPIYSNGMWGWYQPRDADVPNSVYKLAVAGSEKRTTTKMTSDFILEQDLHMLTKGLKFKANFSMDYTFVENKRGVNDMYHNSQRMWVRPDTGEIILEQPELGTGLDAIINPIYWEHQAGSVNTGATYRKLYYSMQMDYTRNFGKHEVTALALFSRLKEASGSVFPIYREDWVFRLTYNYAMRYFFETNGAYNGSEKFGPDYRFAFFPSFSLGWMISEEKIVKNNLKFLDMLKLRASWGRVGDDAVVQPWQRFTDGRFLYKNQLDYGGNTLMGNIKPANTPYTYYTISRLGNPNISWETVEKRNLGIDYAFLGGAVAGSVDIFNDTRTDILVKGSDRAIASYFGTDAPYANLGKVSSHGYELELRLNHTFNNGIRAWLNTSMTHAVNKVKFRDDAPLKPDYQKGAGHAINQVYSYIDHGNLATWDDVIGSPVWTTGNDAKLPGDYNIVDFNGDGVIDADDRAPYQYSTMPQNTYNASIGAEWKGFSIFAQFYGVNNVTREVNFPTFRSTAHVAYAEGDYWTPDGSATLPAPRWGTTIDQAASGTRYWYDGSYLRLKNVELSYTFQKSNWLKKMGIKNCRIYLNGDNLYMWTKMPDDRESNTGYSSSDGAYPTMRRFNLGIDITL

SEQ ID NO: 21974 - protein, 417 aa, Yersinia pestis
MINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYTLSHGLSLTPQMQVTYSRVDFDTFRDPFDSEVSLQEGDSLRGRLGVSLNKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 21975 - protein, 1052 aa, Yersinia pestis
MKSRHHLNTRLLPLSILISALIPAAVLAAPSVAIPPPVQDLINQVQSYANAHVISPEQAETLIKRLTVTPEKLKEEEARVKQELAAVEKKQKEANTEIITTSIEKDQFNKALNNKQKAKLAAETVFINANSKQNEAIKAVNKNWSLADENISTKLSVIVNGESKTQAILAEKIKLTETANINQQEQVIKAQQLDTEIQKNQSELDDAINNKTTGTIVLQEKLTQAETKLETAKNNPKSKLSLAEAKHKRTSKNLKNPKKQAKSEALRNQKDYERELKNLQTPITTATEELKVSQEKVEVLTQEKALISTKKIASDAITDNLQGEINRAQQAQLQAEQDAQQAKDATLAQQAMAKAAAAEKSLQEAEQKLAAIAVIAQEAEAKLTAAQRAKADAELQLADKMEQLANINLDLTALNNLDPKVISQQTLAKGEAQPVADGELAVATKVAGGEQNITTGGVVLASVVTEDGVVNLSDSALAHDSQLINGTLNNTRAHDVNTQVGAQGKLLINGTQEAAATSEGATVAAGGSVTAGTNTLVTKMVSAGTVTGNDGALFTETTLNDGQFSLNNGAIAKNTKVNGGQFNVNEGATAKDTEVSAGAVTGNDGALFTETTLNDGQFSLNNGAIAQNTKVNGGQFNVNEGATAEGVTVKGGEFNLRARAQAMKLTIEFGEAQIAGTLTDVTLRGGNTTLASTADVAGTIHSISGSALKVYQGAHTAQADLNLAGRVVLFADDVAPAAALPSRAVRAADNRLSAPFTFRRVNMSGGTLDLRNVKKAQLVMDSLAGNGTFKLGSMLQQDASAPVNVTGNADGDFILQIDGSGIDPTNLNVVSTGGGDARFTLTDGPIGLGNRVYNLVKDASGKVTLVANESTVTPGTASILAVANTTPVIFNAELSSVQQRLDKQSTEANESGIWGTYLHNNFAVKGRAANFDQTLNGITLGGDKATALADGVLSVGGFASASTSSIKTDYQSKGNVDSHSFGAYAQYLANNGGYVNGVVKANKFNQDIHVTSADNSASGNTNFSGMGVAVKAGKHINHNHLYVSPYVAIERL

SEQ ID NO: 21976 - protein, 440 aa, Yersinia pestis
MAVSASFARKKVLTNNALGKNYSLALGLLGISVLPDAAQAQGFVDDSHGTLTLRNYYMDRDYKDDGARTAIREWAQGFIMNAESGFTEGPVGLGIDARALVGMKLDSSPDRSGTELLPVSAGDGRAADEYSRLALTGKLKFRETTVKTGDVSIFLPFAFASPSRLLPQTFRGTTLTSKEIDGLTLNAGYIDRVNKRDSTNYQAISIASPNRRFNAAATSSHMTYAGGDYQVSKALSVRVYHAEVADLYTQNTLALLHKLDVGDGVMTTDLRSFFSRDTGSAKAGEVDNQNLSALLGYKWGGHSVSLGYMHASGATATPYVSGTELMGLSEMTMSSDFLNARERTWQAIYDYDFTAVGVVGLRSRLRYIRGDNIELSAFNADDRKEREFQMELGYVVQSGPLKNVGLLARKSIYRNDFPTGAAFRDENQTRFIVQYSVPIW

SEQ ID NO: 21977 - protein, 433 aa, Thiobacillus ferrooxidans
MNATYALCPLLAALLLPLDCLAQTPPTPRTGPLSGLGDYLADRGITPHVQFLSLAMKNLDTGPRPHSFGNSGDLFVGADIDLGTFAGLDGATLHFEQTLFILDHETGVPTSRNWQGAAGSYFGGAPIHNDLTSNQLSLLTYQQTWLDGRVDLSLGRTNARRYFYIYNCESTVTCNDPIIDSSTGILPPPYGSWGGYLKYQLTPQWYVHGGAFESNPVDYLKERKGLDFSTDDASGTSLLLGIGSQNRDAYSSHYELNGYYNTSKQVDPLTGAMDFGTGGAFFKFQQALWRADAGTGSAPQALLLFGSLSAAADDKQPFSQFAEAGLTYLAPFDRPQDKLNLKASYLRLNDHQLRFQQQARIANGGDPRLGERNVYALEANAHIALTRQLALEPSVQYLVNPDNFYNPEARELSGNGFVVGLQVTLDVGSLLGL

SEQ ID NO: 21978 - protein, 925 aa, Salmonella typhi
MHSWKKKLVVSQLAVACTMAIASQASAATDISGKSYDTFYYDGGIMYQGYVGYDYGSDYYNGNIYPQISGAHVDGVISTWYLDEGTSNNTNPNALTIKDSTIHGMITSQCMTENCDNRTGDYLYNRLALTVDNSTIDDDFEHYTYYNADDKTTASMDVFDLGTAITLDQETDLVIQNNSHVAGITLTQGYEWEDNQDVTSPTGSNSGEIFNNSIVVKDSVLSSGSWTDEGTSGFYGHTGKASDYDNAITADDIALAVIANPAADNSMQTTASFDRSTINGDIYFESSFDENFGGYDRVTLDQDGNPVITHVDAYDVNGDGTLDSNGWDNTDRLDVTLTNGSKWVGAAISNVEATAELYDYQPNSIWPGSTYGIENSDTAFNEAGHVTGNEVYQSGIFNVTLTNGSEWDTRKVSNIDALVVDNHSQVNVESSSLLADSITLTNASTLNIGDDGAVATDSLTLDSGSQATLTEETASLYANTLTVANGAQLNLGLGQVDADNVVLTDDGVLNVASRDYVLDASLNNARYVTNDPHQKDYDEGVIALNSDGHLAVNGDVAGNYRVRIDNATGAGSIADYKGNEVIRVYDDNDATSARFTAANKADLGAYTYEAQQQGDTVVLKQRELTDYANMALSIPSANTNIWNLEQDVLSTRLAQGRHTPGDNGGAWVTYFGGNFNGDNGELSYNQDVNGLMVGLDKLVEGNYAKWMIGAAAGFAKGDMDDHSGSVDQDSQSARLYSSAQFANNVFLDTTLSYSHYSNDLSAVMSNGQAVSGDASSDAWGFGLKLGYDWQFNTQGYLTPYASISGLFQDGDGYQLSNDMRVNSQSYDSLRYELGADLGYTFNYGNDQSFTPYAKLAYVYDDASGNDADVNGDNIDNGMEGSAVRAGLGGKFSFTKNFSAYADANYLGGGDVDQDWAANVGVKYTW

SEQ ID NO: 21979 - protein, 601 aa, Pasteurella multocida
MGQTDSTRIEKLDEVVVSDTRFPLRWEQSGKTVIRLSRRELASYRGATMAEILNAQTGIEISGSRGRPGEVLGVFARGGRGRQVLVLIDGVRVTDPSSASQEYDLRFVQAEEVESVEILKGAASTLYGTNAATAVINIRTRKAPKSPLALRVGSLLGTHRAPEDPEGQFGQYQQYARLGGTSGRLNYQAGITHARATGLSSLRSGTETDPFRNLSLSARLGYRPWDHTRVQLTANRTQLRTAYDDAFNGADADFLFLSEQTRVSLNATREFSKGTLEARAGYSEFDSDNRSDFPTTFRGSNWFGEVLYKHRLNRSLSVLGGIMASEDRAGTEDVESFRFIDPFVNLVWASASGWNLNAGTRVNFHSQYGSQWVYQLNPSYALTLGEHTFKALATWSTAYITPTLNQLYGTFGANPELEPETDRTLEAGLAWQFGNRMRLSVLYFDREEEQAVIYDGAGMQYRNSPDPVEVNGVEFEATWFAADGWQVRAGYTYTDRQGDAAIRIPAHKFQFRLNGEISSRWRGSLYYRYTGTRTDTDFSTFTNRELDAFSLVGGQVGYSFLRGKLDAYLRADNLLNTEFTEVIGYQTPGRTIYLGWSLQLD

SEQ ID NO: 21980 - protein, 584 aa, Pseudomonas aeruginosa
MKRSAILSLMFIAGMLAVPGVLNAQVEKRVEVSKAYVPSVEHATKLAVRPNMVDTAAIQPEIDYSITPLTLETQLATRPIRPATITYWEFDRPLPFYLKAGAGYPLNSALDLYVSTQNPDIGYALGYINHDGRYGRIPYTPDGDHSALWMDNRVGVAAGKYIGRHVLEGEVSYRNRIIDRYGLFPDPDFPTFDNGNRRVIGDLQGKIRIGDDFNDLSRTNFNVEVTAGNWWNPLDSKLYLEDNVVPVLDYPYENEWNLGVDAAVGRRFGRHTLVFRAGFEGRWGGDRKGESVWAAPSDYYNRTYSGAFRYAYRARSVDMEFGLDYYRDDVAGRDAANYFIPYAHLRFDLGGGGFVPYVELDGTLKHNDMRELMETNLYYVPRYTDLMPRNTVDYSVRVGVSGRLVEDKLIYRLFVGYSFIENHNFWYCYTPTTRYEGFSLVQGRLNVMSLNGELEFRPVSNFTFSIGGRGLTYTEHQTLSIGLPEFEGTVRARYHHRKFSVGLVFDLQSNRYISRVIPWFPNDGIVGNMRIPYTVDLGLNVDWYASKRVTVFAEGHNLCNRRIYDWSTFPQYSAGFTAGVKLSF

SEQ ID NO: 21981 - protein, 1454 aa, Neisseria meningitidis
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGSNPDQHRFTYKIVKRNNYKAGTNGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFHDNNNGTGKIDAKHEHNSLPNRLKTRTVQLFNVSLSETAQEPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGKVILDQQADENNKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTNTDISGNVSLADHAHLNLTGLATLNGNLSANGDTRYTVSHNATQNGDLSLVGNAQATFNQATLNGNTSASGNASFNLSDHAVQNGSLTLSGNAKANVSHSALNGNVSLADKAVFHFESSRFTGQISGSKDTALHLKDSEWTLPSGTELGNLNLDNATITLNSAYRHDAAGAQTGSATDAPRRRSRRSLLSVTPPASVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGSKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 21982 - protein, 1468 aa, Neisseria meningitidis
MKTTDKRTTETHRKAPKTGRIRFSPAYLAICLSFGILPQARAGHTYFGINYQYYRDFAENKGKFAVGAKDIEVYNKKGELVGKSMTKAPMIDFSVVSRNGVAALAGDQYIVSVAHNGGYNNVDFGAEGSNPDQHRFSYQIVKRNNYKAGTNGHPYGGDYHMPRLHKFVTDAEPVEMTSYMDGWKYADLNKYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPHQNGKYFFNDNNNGAGKIDAKHKHYSLPYRLKTRTVQLFNVSLSETAREPVYHAAGGVNSYRPRLNNGENISFIDKGKGELILTSNINQGAGGLYFEGNFTVSPKNNETWQGAGVHISDGSTVTWKVNGVANDRLSKIGKGTLLVQAKGENQGSVSVGDGKVILDQQADDQGKKQAFSEIGLVSGRGTVQLNADNQFNPDKLYFGFRGGRLDLNGHSLSFHRIQNTDEGAMIVNHNQDKESTVTITGNKDITTTGNNNNLDSKKEIAYNGWFGEKDATKTNGRLNLNYQPEEADRTLLLSGGTNLNGNITQTNGKLFFSGRPTPHAYNHLGSGWSKMEGIPQGEIVWDNDWIDRTFKAENFHIQGGQAVVSRNVAKVEGDWHLSNHAQAVFGVAPHQSHTICTRSDWTGLTSCTEKTITDDKVIASLSKTDIRGNVSLADHAHLNLTGLATLNGNLSAGGDTHYTVTRNATQNGNLSLVGNAQATFNQATLNGNTSASDNASFNLSNNAVQNGSLTLSDNAKANVSHSALNGNVSLADKAVFHFENSRFTGKISGGKDTALHLKDSEWTLPSGTELGNLNLDNATITLNSAYRHDAAGAQTGSAADAPRRRSRRSLLSVTPPTSAESRFNTLTVNGKLNGQGTFRFMSELFGYRSGKLKLAESSEGTYTLAVNNTGNEPVSLEQLTVVEGKDNTPLSENLNFTLQNEHVDAGAWRYQLIRKDGEFRLHNPVKEQELSDKLGKAGETEAALTAKQAQLAAKQQAEKDNAQSLDALIAAGRNATEKAESVAEPARQAGGENAGIMQAEEEKKRVQADKDTALAKQREAETRPATTAFPRARRARRDLPQPQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTGNTFDDGIGNSARLAHGAVFGQYGIGRFDIGISAGAGFSSGSLSDGIRGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 21983 - protein, 627 aa, Bordetella pertussis
MPSNTTSRVAAGVAAGLAVSAGPAIADTDGESAQLAPLVVTPTRMAQTVDESLSSVSVIDREQIDRQQPRQVSDLLQGQAGSSLTTSGPFGKSTSLFMRGTNSDHTLLLVDGVPMNSATQGGAAWQYLPPAEIDRIEVVRGPRTSVYGADAVGGVVQVFTRQGEEGPPRFRAFGGAGSFNTHEFGLGVSGGTAASRYALSASHYETDGINVQDGEGDEDPDGFENTSFSGRFSHRLPGGAELFATGFRSEGTNEFDGTRLGEEDWTDHYFQALRGGVRGDLTERWFSELAVSQAKDEQDNVDSRGETWQYTERHEVSWRNELYWGAGHVWAFGGDWRDEKVDTADDYDETSRYNAGAYSQLELDLGRHDLGASLRYDDNEAYGDNVTGQVAWGFDATDRLRLRSSYGTAFKAPTFNDLYAPENPNWLLAGGNTDLEAETSASAEVGARWQVRRGYVDAALFRTDIDNLIADKPVDGQQDWTQPGNVEEARIRGAELEAGAHWQEWQFSGAFTYLDHEDRETGEELLRRPSESFRLEIDRELGDFSLGATGLLRGRSYDTDFDMATSQSERVRLSGYGLLNLRTSYAITPEWTLRGTLENALDKEYETVGGYNQPGRAVYVSLHFNQQ

SEQ ID NO: 21984 - protein, 903 aa, Bordetella pertussis
MVGRSCHRAGWLYRATFLLYAANCAYPANAQSVSGFGQVSNGPIQSPHWVVGGELIVGDTGAGTLLIEAGGTVLNDWAYIGSDNGAVGTLTVSGHDGAGAASTWTTVEDVSIGVASGSRGTLEVLGGAMAQSGWGTIGVAAGSVGSVTVSGTGSVWNIATVNSFQIGSSGSGTLWIDQGGAVYSGQGVIGWNPGSDGHVTVLGPATVWNPLNNIYVGLGGTGELAIRDGAAVATAGSSSPGAAASIYIGTSAGSAGTVTVSSATADTSTLTSTDRIEIGSGGAGVLTVAKGGMVGVASDAWIAITGTSSGTLNLTGDASGRGVLETGSVIKGVGNATFNLDGGVLRANRDEANFLNGFSTQAVGSGGAWFDTNAHDVGVVTAFSGTSSFNKLGAGTLTLSGNSAAFTGNTDIQAGTLQVDGILGGPVDVLGGARLTGTGRVGATANKGTIAPGPRSGFGTLTIAGDYAAQGGNLEIRTQLGADDSPTDRLVITGASAGVTPVTVENIGGTGASTQRGIQVVQVNGASAGRFNLANGDYVIEGHPALVAGAYGYVLQQDAADGDWYLRSSLPDPGAPQGGDGLPGAGEPVLYQPGVPVYEAYANTLLHLSRLSTLRQRVGNRLYDSADVGRNGVWSRVEGSASQLDPSASTTGERQDVDSWKVQFGVDRILAGGQEGSRLVGGLALQYGKADTRVSSIYGNGTVDTTAYGLTPTLTWYGRDGAYVDAQAQAIWFDSDLSSRLAGKLKDGRKAHGYGLGIEAGKAFGLREGLALIPQAQLSYASTRFDSFNDRFGARVEDDKGDSLQGRLGIALDYKSSWQASGANRESSVFGIVNVKHEFLDGTRVRVAGVPVSSRMARTWGSVGVGADYGWGERYAIYGQVDADADFAGSYILTATAGFRMMF

SEQ ID NO: 21985 - protein, 919 aa, Pasteurella trehalosi
MRMKKNFAYHPLSAAIFAALISPTVSANTQTNTNTERLELDEVIVTESRYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARAKLNRDNFPVRTFPEYTPEERKQLEQIPYRTEQLSAQEYTGKDRIAPNPLDYKSNSVFMKFGYHFNSSHYLGAILEDTKQRYDIRDMQTPAYYTKDDINIRVDNLSRKNSSVYEGDNILDGLVFDRRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFDRFNSLMDHGDMTAQYTKGGYTSYRGRGRLDNPYIYRRNPRSIETVSLCNNTHGDIINCEPRKIKGYSHFVSFRDLVISEYVDLGLGVRFDQHRFKSDDPWTLSRTYRNWSWNGGITLKPTEFVSLSYRISNGFRVPAFYELYGKRDHIGLKDNEYVQREQRSHQLEPEKSTNHEIGVSFKGQFGYLDVSYFRNNYKNMIATACKRIIQKSHCFSNYHNIQDVALNGINLVAKFDLHGILSILPDGFYSSVAYNRVKVKERKLTDSRLDSVNDPILDAIQPARYVLGFGYDHPEEKWGIGITTTYSKAKNADEVAGTRHHGIHRVDLGGKLTGSWYTHDITGYINYKNYTLRGGIYNVTNRKYSTWESVRQSGVNAVNQDRGSNYTRFA

SEQ ID NO: 21986 - protein, 384 aa, Neisseria meningitidis
MRKKLTALVLSALPLAAVADVSLYGEIKAGVEGRNYQLQLTEQPSRTQGQTSNQVKVTKAKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAA

SEQ ID NO: 21987 - protein, 565 aa, Stigmatella aurantiaca
MKMRPRYSVIASAVSLGFVLSKSVMALGQPDTGSLNRELEQRQIQSEAKPSGELFNQTANSPYTAQYKQGLKFPLTQVQILDRNNQEVVTDELAHILKNYVGKEVSLSDLSNLANEISEFYRHNNYLVAKAILPPQEIEQGTVKILLLKGNVGEIRLQNHSALSNKFVSRLSNTTVNTSEFILKDELEKFALTINDVPGVNAGLQLSAGKKVGEANLLIKINDAKRFSSYVSVDNQGNKYTGRYRLAAGTKVSNLNGWGDELKLDLMSSNQANLKNARIDYSSLIDGYSTRFGVTANYLDYKLGGNFKSLQSQGHSHTLGAYLLHPTIRTPNFRLSTKVSFNHQNLTDKQQAVYVKQKRKINSLTAGIDGSWNLIKDGTTYFSLSTLFGNLANQTSEKKHNAVENFQPKSHFTVYNYRLSHEQILPKSFAFNIGINGQFADKTLESSQKMLLGGLSGVRGHQAGAASVDEGHLIQTEFKHYLPVFSQSVLVSSLFYDYGLGKYYKNSQFLEQGVKNSVKLQSVGAGLSLSDAGSYAINVSVAKPLDNNINNADKHQFWLSMIKTF

SEQ ID NO: 21988 - protein, 186 aa, Wolbachia sp. wCad
SYYVRLQYNGEVLPFKTRIDGIEYKKGTEVHDPLKASFMAGGAAFGYKMDDIRVDVEGLYSQLNKNDVGGATFAPTTVANSVAVFSGLVNVYYDIAIEDMPITPYVGVGVGAAYISNPSEASAVKDQKGFGFAYQAKAGVSYDVTPEIKLYAGARYFGSYGASFNKETVSATKEINVLYSAVGAEA

SEQ ID NO: 21989 - protein, 186 aa, Wolbachia sp. wMod
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAKT

SEQ ID NO: 21990 - protein, 185 aa, Wolbachia sp. wAscCu
  misc_feature (81)..(81): Xaa can be any naturally occurring amino acid
  misc_feature (85)..(85): Xaa can be any naturally occurring amino acid
  misc_feature (142)..(142): Xaa can be any naturally occurring amino acid
SYYVRLQYNGEILPFYTKVDGIKNATSKEKDSPLKRSFIAGGVAFGYKMDDIRVDVEGLYSRLAKNKAVIDASEANVADSXTAFXGLVNVYYDIVIEDMPITPYVGVGVGAAYISNPSSAADVKDQRRFGFAYQAKAGASYXVAPEIKLFAGARYFGSYGASFDKAAKGDDGIKNIVYNTFGAEA

SEQ ID NO: 21991 - protein, 139 aa, Wolbachia sp. wCuc
SYYVRLQYNGEILPFYTKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGN

SEQ ID NO: 21992 - protein, 176 aa, Wolbachia sp. wAscCo
  misc_feature (12)..(12): Xaa can be any naturally occurring amino acid
SYYVRLQYNGEXLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEID

SEQ ID NO: 21993 - protein, 182 aa, Wolbachia sp. wAscD
SYYVRLQYNGEILPLFTKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYDANFDKTDKDGKGELKVLYSTVGAEA

SEQ ID NO: 21994 - protein, 184 aa, Wolbachia sp. wDes
SYYVRLQYNGEILPLFTKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYGAHFDKDAAAGKDKGELKVLYSTVGAEA

SEQ ID NO: 21995 - protein, 188 aa, Wolbachia sp. wDveM
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDKSGGEKDKGGHTVLYSTVGAEA

SEQ ID NO: 21996 - protein, 381 aa, Gamma-proteobacterium EBAC31A08
MKIIITREYIMKRKVLAMLVPALLVAGAANAAEIYNKDGNKVDFYGKMVGERIWSNTDDNNSENEDTSYARFGVKGETQITSELTGFGQFEYNLDASKPEGENQEKTRLTFAGLKYNELGSFDYGRNYGVAYDAAAYTDMLVEWGGDSWASADNFMNGRTNGVATYRNYDFFGLVDGLDFAIQYQGKNSNRSTKKQNGDGYALSVDYNINGFGIVGAYSKSDRTNDQVADGNGSNAELWSLAAKYDANNVYAVVMYGETRNMTPGSIDTGVADREGNTIMRDQLINETQNFEAVVQYQFDFGLRPSLGYVYSKGKDIKGVPGHRYVDADRVNYIEVGTWYYFNKNMNVYTAYKFNMLDKDDAAITGAAADDQFAVGIVYQF

SEQ ID NO: 21997 - protein, 363 aa, Salmonella typhi
MMKRKILAAVIPALLAAATANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADGSADLAKYIQAGATYYFNKNMNVWVDYRFNLLDENDYSSSYVGTDDQAAVGITYQF

SEQ ID NO: 21998 - protein, 1033 aa, Azospirillum brasilense
MNRYLIMLSLILSSVWSYGQNLEIRGKVLEEGSNMPLPGVNVLIKNSSQGTATDFDGLFTLKNVPTGSRLVFTSLGYATQEVVVTSSKELTITMSEDSESLESVIVIGYGTQKKKEVTGAVSILDAESIEKLNPVRVEQALQGQVAGVNVTSNSGSPGSGSNIRIRGITTNGDNAPLILVDGNRITDLSVLNPNDIKSINVLKDATAGIYGVQAANGVILITTKSGRKNTELKFQFDSYTGFQTTSKKIDLLTAPDFARYVNDAADATEFFVFPPEGTDWQDEVFENAAISSINFSGNGGTEKAAYGFGISYLNQDGIVGGSKNNFERLTARINFQYDILENLKLTANGLHTISEKQNLQEGGIGAVLYNAVNINPTLAVRDENGAFSLANDISQIEIINPLAQIENTFNTSRVSKFSAVVGLDYTFLKNFKASSKFQINHANVRDDVFRPEVFYGNGKAANFGDITDDNITNFVVDFGADYDDFTWDNYISYNNTFNDAHDLTVLLGTSLYRNKGFFYGFTGMTETGTNQPGQSVTDVGMTAEPRFNAAAIENGAEWFDVRLSSLFSRLQYSYKEKYLLSLVLRRDVSSQFSPVDDNNVGYFPSGSLGWNVSEESFLQEVSWLNNLKLRASYGIIGNDRIPSFAFITRLNGQATIDPGNINQISGLVFGSAPGELGNPNLKWEEQETANLGMDVRLFDNKLNFSADIYRKETKDLLIRPQASAVLGTTAPGSASPIVNAGTVRNQGFEFVIGYNDSFSDDFKFNVSFNLTTIANEVVSLNGRIPPVGGEFGVGLGITDVTRMVPGLPLGHYYGYQTDGLYQTQAEIDALNATAPSGTYSTVGDIVPGDLKFVDINGDGEITPEDRTNLGDPIPNVTMGLNIGFSYKNIDFSANAFASLGNEMVRDYERKDLYANRGVYMLERWQGSGTSNFVPRASSGASINTDIFSDFFVEDASFLRLQNVQVGYTFGDNFISSLGIDKLRVYVSGNNLLTITDYLGYDPSANTGAPLGGAIDKGFYPVASSYLLGINLNF

SEQ ID NO: 21999 - protein, 149 aa, Rickettsia hulinii
LGVYTRLGGIVWRADATQTNPTYGRISNHDTGVSPLAAVGVEYAVTKNWATRLDYQWVNNIGDAGTVGARPDNSMLSVGVSYRFGEDEAAPVVAPAATPAPVVETKRFTLKSDVLFTFNKSTLKPDGQQALDQLYTQLSNLDPKDGSVV

SEQ ID NO: 22000 - protein, 159 aa, Rickettsia heilongjiangii
ILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 22001 - protein, 307 aa, Helicobacter pylori
MKKALLLTLFFSFWLHAERNGFYLGLNFAEGSYIKGQGSIGEKASAQNALNQAINNAKNSLFPEQNTKAIRDAQNALNKVKDSNKIANRFAGNGGSGGLFNELSFGYKYFLGKKRIIGFRHSLFFGYQLGGVGSVPGSGLIVFLPYGFNTDLLINWTNDKRASQEDVERRVKGLSIFYKDMTGRTLDANTLKKVSRHVFRKSSGLVIGMDIGASTWFASNNLTPFNQVKSHTIFQLQGKFGVRYNSDEYDIDRYGDEIYLGGSSVELGVKVPAFKVNYYSDNYGDKLDYKRVVSVYLNYTYNFKNKH

SEQ ID NO: 22002 - protein, 218 aa, Helicobacter pylori
MKKTLLIAVCAICFFSLCTGAYAEGERTWKFGVGAEVSFLKTLNYDVDDVVDTEQTFEATAMPGVNMTFFFNQYFSTELTLAYAKYEMELDVPGTKIEQGELEQVPLLLTFRAHMPSDGGFSPYIGAGLSYFFNDFDMSDFYSRNLAKGTSIDPDDGLGFHANLGVEIDVTDNVSFDIDGKYTWYEEEFVIKSPGNRDRQEDVELNSLSIGAGMKVYF

SEQ ID NO: 22003 - protein, 742 aa, Helicobacter pylori
MKKTLLLSLSLSRFLLHAEDDGFYMSAGYQIGEAAQMVKNTKGIQELSDNYEKLNNLLTRYSTLNTLIKLSADPSAVSGAINNLNAGATGLLKEKTNSPAYQAVLLAINAAVGFWNVVGYVSQCGGNANGQKSTSSTTIFNNEPGYRSTSITCSLNGHEPGVQGPISIENFKKINEAYQILQTALKNGLPALKENNGKVNVTYTYTCSGEGNNNCSSEVTGVNEQNGGTKNTTQTIDGKSVTTTISSKVVGWQAQGNTQHVSYTEITNKLDGVPDSAQALLAQASTLINTINTACPWFNATSSSSPNAPQWKWNAHSGGLCGAFKDEISAIQKMITDAQELVNQTSVINSHEQSTPVGGNKPFNPFTDASFAQGMLANASAQAKMLNLAHQVGQTINPDNLTGNFQYFVKNFLATCDNPSTAGTSGLQGSAPGTVTTQTFASGCAYVGQTITSLKNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARPKKKDSDHAAQHGIELGLKIPTINTNYYSFMGAELKYRRLYSVYLNYVFAY

SEQ ID NO: 22004 - protein, 323 aa, Wolbachia endosymbiont
EVAQVKHRVNGVSEKDYTETKITDFGSRIGFKGTEHLGSGLNAIWQLEQNASVAGTDSGWGTRDSFIGLEGETWGKFRAGKLSTQLKDMDALDPWEYKNPALGLGVFERTGKRVISARYDSPVWAGFSFNAQFTPRDNQTNTGRDDDVVGRQLSDTSAYYAGLNYENAGFFAQYGVGYKKAAYVANNDSKSAQAHKVEAGYDANNLFVGLGYQYTNGWDSENSYRNTIAGIETDANVTDTSGRLKTHEAALTTSYTFGNVTPRLSYAHGFKAKSGGNKVDGTNYKQVVLGADYDFSKRTTAMVSAGWLKAGSGDNKTENTAGL

SEQ ID NO: 22005 - protein, 144 aa, Onchocerca volvulus endobacterium
DGPNISGEIVFATPDILKVIGKPRPYLVASVNTQGNTSFGAAGLHWNWDFAEGWSLEPGFGYAIHTGEETFPFPQGDPRNDPVSAKTIYFGSRDLFRSSLALSRDLAGPWGVQIMYEHLSHGQIIGSGRNQGLDNIGVRVSYAF

SEQ ID NO: 22006 - protein, 179 aa, Kluyvera ascorbata
MMPFACYFFIFINVGLGEGSALPVGVPVPWPSATPPTGWLKCNGAAFSAEEYPELAKAYPTNKLPDLRGEFIRGWDDGRGIDTGRSILSIQGYATEDHAHGLPSRSTIVTDATINFYFDEIWVNSGTDIIKRGNTNDAGLPAPDYGTFKTYKQSVDGLGAAASETRPRNIAFNYIVRAA

SEQ ID NO: 22007 - protein, 1058 aa, Rickettsia sp. BJ-90
ITLHAGGSLDANNIDFGARSTLEFNGPLDGGGIPYYFKGAIANGNNAILNVNTKLLTAYHLTIGTVAEINIGAGNIFAIDASAGDVTILNAQDIHFRALDSTLVLSNLTGVGVNNILLAADLVAPGAGEGTVIFNGGVNGLHIGSNVAGTARNIGDGGGNKFNALLIYNAVTITDDVNLEGIQNVLINNNADFTSSTAFNAGVIQIQNATYTIDANNGNLNIPAGNIQFAHADAQLILQNSSGNDRTITLGANIDPDNDDEGIVILNSVTAGKKLTIAGGKTFGGAHKLQTIVFKGAGDCGTAGTTFNTKNIVLDITGQLELGATTANVVLFKDAVQLTQTGNIGGFLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAKLGGTTSFAHTFTNTGAVTLAKGSITSFAKNITATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAEAAGGLKPTPKENVKITINNDNRFVDFTFDASTLTLFAKDIAADVIDKDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKIIKTADKNKVESNIYSLYGLYSVPYENLFVEAIASYSDIRIGSKSRRVIATTLETVGYQTANGKYKSESYTGQLMAGYTYMMPENINLTPLVGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKYKMMEYGINYDTNIGSKYFAQQ

SEQ ID NO: 22008 - protein, 417 aa, Pseudomonas aeruginosa
MKIRRKTAVPRNAGAVLPMLACLAAQAAEGGFLEDAKTDLVLRNYYFNRDFRDHDAGKSLVDEWAQGFILKFSSGYTPGTVGVGLDAIGLFGVKLNSGRGTSNSELLPLHDDGRAADNYGRVGVAAKLRVSASELKIGEMLPDIPLLRYDDGRLLPQTFRGFAVVSRELPGLALQAGRFDAVSLRNSADMQDLSAWSAPTQKSDGFNYAGAEYRFNRERTQLGLWHGQLEDVYRQSYANLLHKQRVGDWTLGANLGLFVDRDDGAARAGEIDSHTLYGLFSAGIGLHTFYLGLQKVGGDSGWQSVYGSSGRSMGNDMFNGNFTNADERSWQVRYDYDFVGLGWPGLIGMVRYGHGSNATTKAGSGGKEWERDVELGYTVQSGPLARLNVRLNHASNRRSFNSDFDQTRLVVSYPLSW

SEQ ID NO: 22009 - protein, 789 aa, Pseudomonas aeruginosa
MPFTRSCTLTAVLAAAVSCLQTSAAMAQQQTLFFDLPAGSLASTLNGIARQGNQVISLDPALVAGKQAPAIEGEMTTTQALERALAGSGLELRMTETGGFSVQPIALGDTMSLDVMRVEDNALGTITEQTKSYTPGTIASATRLVLTPRETPQTVTVVTRQHMDDFNLTDIDKVIEHTPGVTLQRMSNFRSLYYARGYPIRNFQYDGVPTFDDSVNSMGQTSSDMIQYDRVEIIKGASGLTTGAGGPGATLNLVRKKPTHEFSGHATAEAGRWDNYRTEWDVGGPLNESGSVRGRIATAFQDRQSFQDHAKEQTRALYGILEVDLTPQMMWTIGGNYDKRIPNGDMWGGIRLFDSNNKEVDVSRSFNPGATWAYNEEFSHAFFTQLDHSFDNGWSSRLYYTFQKNAYIGKLGSLSATPNADNGNTTLQTGYYRYKTRTQALEGYARGPFELFGRTHELVFGFSGYHNHHKGKGRSYLQLPVDNYWEWEGHIQRPDWGAIRSRTEDRINQRAYYASTRLSLTDDLAVILGGRVTNYLRGGDSNMHESGEVVPFAGITYDLNDNFSVYASYTKIFMPQSARDANNSVLDPDEGDSYEVGFKGEWFNGRLNASLAYFEIRQDNRAESTGIRDPELNYLIYRGVKAKSKGIELEITGELMPDWNIQAGFTHQVIREDATNEKLTTYQPENQFKIYTTYRLPGILNKLTIGGGANYQGTTWSDGTDAFGGTRQYRQEAFWLLNAMGKYQVSDSVSATLNINNLLDKYYYSNYGYGNGKMYGEPRNMMLTTRWDF

SEQ ID NO: 22010 - protein, 708 aa, Pseudomonas aeruginosa
MRVSVSLVLGVGLGCSSPALWAETESPAELEVLTVTAEAERAEGPVQGYRANRTASATRTDTRIEDIPQAISVVPRQVLDDLDSARIERALDFAGGVSRQNNFGGLTMFEYNVRGFTTSEFYRDGFSANRGYMNAPDSATIERVEILKGPASSLYGRGDPGGTVNLVTKKPQAERFARLHASAGSWDRYRSTLDLNTPLDEEGDLLYRMNLAVEDSKGFRDYADGQRLLVAPSFSWQLDPDTSLLVEAEVVRNRQVFDRGTVAPHNHLGSLPRSRFFGEPDDGKIDNNNETLQATLRHHFNEQWSLRLASHYKHGHLDGYASENSSLAADGYSLRREYRYRDFEWHDSITQLDLLGDLHTGSIRHQLLMGLEYERYHNDELILRSIPSRNPYAIDIRRPVYGQPKPPFGRDDRNHEEVDAMALNLQDQIEFSEKWRGLLGVRFDRYRQDMNATRLNNGRFRDTSSQQTQRAATPRIGVLYQATPEVGLFANASKSFKPNGGTDMAGKAFDPEEGRGYEAGVKLDLLDGRLGMTLAAFHLKKKNVLTADPSNPGYQQTAGEARSQGFDLQFSGQLTEQLRLIGAYAYIDAEVTKDENIARGSRLLNVPKHSGSLMGVYEFREGWLHGADAGAAVNYVGERAGDSSDSGFELPAYTTVDLLARYPLASNATLGVNVNNLFDRRYYERSYNNVWVAPGEPRNLTMSLTLNY

SEQ ID NO: 22011 - protein, 764 aa, Pseudomonas aeruginosa
MPLSPPFALRPCLALLLLSPSLALAGNAVPLTPTTITATRTEQAVDSVPSTVSVQTREQLDRQNVNNIKELVRYEPGVSVGGAGQRAGITGYNIRGIDGNRILTQIDGVELPNDFFSGPYAQTHRNYVDPDIVKRVEILRGPASALYGSNAIGGAVSYFTLDPSDIIKDGKDVGARLKAGYESASHSWLTSATVAGRADDFDGLLHYGYRQGHETESNGGHGGTGLSRSEANPEDADSYSLLGKLGWNYAEGSRFGLVFEKYKSDVDTDQKSAYGGPYDKGKPAIPPSMLPGGMYQWRKGNDTLTRERYGLEHHFLLDSPVADRIQWSLNYQLAKTDQATREFYYPITRKVLRTRDTTYKERLWVFDSQLDKSFAIGETEHLLSYGINLKHQKVTGMRSGTGTNLDTGADSPRDALERSSDFPDPTVKTYALFAQDSISWNDWTFTPGLRYDYTRMEPHITDEFLRTMKQSQNTAVDESDKKWHRVSPKFGVTYDFAQHYTWYGQYAQGFRTPTAKALYGRFENLQAGYHIEPNPNLKPEKSQSFETGLRGKFDEGSFGVAVFYNKYRDFIDEDALNTDSTGGNGQTFQSNNIERAVIKGVELKGRLELGAFGAPQGLYTQGSVAYAYGRNKDNGEPINSVNPLTGVFGLGYDEADGNYGGLLSWTLVKRKDRVDDSTFHTPDGTASQFKTPGFGVLDLSAYYRLSKDLTLNAGLYNLTDKKYWLWDDVRGYDSVGEASALAPANIDRLSQPGRNFAVNLVWDI

SEQ ID NO: 22012 - protein, 420 aa, Pseudomonas aeruginosa
MMRNIWTVISLGLGGLSVLSSAHATTGYFMHGYGVKVQGQAGTAIAQFNDALTIANNPSGLVWLDSRIDLGATVFKPERRATIQDNQFGANGDYDGNGREYFVLPELAINKKVNDQVALGLAIYGNGGMNTSYKQNPFAAFGNTGTAGVNLSQIFISPAVAWRYTDSQSIGVAANFLYQRFEAKGIQGFAPFSIDPQHLSDQGGDSSKGVGFRVGWSGHLNDQITLGLNYSSKINADRFDKYRGLFAQGGDFDVPESYGLGVNIQATPKLNIAADVQRINYSDVDAIGHDFSVAALQAGHLFGSELGPGFGWDDINIYKIGASYQLAPQLTVRAGYSYNDQPISKDQTFLNILAPGVIQHHVSVGATWQIDPKQELSFAYTYGVKHKLKGDQSIPAAFGGGNTNLEMDQHILGFSYGLKF

SEQ ID NO: 22013 - protein, 431 aa, Pseudomonas aeruginosa
MSSPFSPRSPRTLRGLGALALCGGFVAPAPAAFLEDGSARLEARTVYFNRDFRDGSSANPQGASKREEAAQGFILDLRSGYTEGALGFGVDTLAMLGIKLDSSPADSNSGLLPSSGHDPRRSVDQYAKAGVAGKMRFSQTQFRYGAMLPDMPLLKYNDGRLLPTLFHGAQLTSEEIAGLRFSATRLERYTARDSSDAQDIRLHCKNKRYACDTTGNRFDAYQLDYQVNDGLLLQYAQGGLRNVYRQRYLGAVGKRQLGAGKLSADLRWFDSEDAGAARAGKIDNRALSLLLAYAQGGHTLSAGWQRMNGASSMPYLDGSNPYLANYLQVNDFANPEERSWQLRYDFDLRSVGVPGLSFMTRYVNGDHIRLANGDEGKEWERDIELKYIVQSGRFKDLSLRLRNATYRTDFERSARDVDEVRLIASYNLSLF

SEQ ID NO: 22014 - protein, 802 aa, Pseudomonas aeruginosa
MKHVVSSALLLGLSSLSLAAQAAPIALDLPAQPLAASLEQLQGASGLRIRFDRAAVADRRAPALRGTLEPSEALQRLLAGSGLSGEVRGGDAWVEAAATGAGIAPGDSVDLGALSVVATQDPATAAITEDSGSYTTRAMRTSTKLAMSIRETPQSVSVVTRQRMDDQGMRDLNDAVKGVTGLTVQQYGPARVKYAARGFDVDNIMYDGLPTSISTYTQDVISAADLAMFDRVEVVRGATGLMQGAGNPAAAINMVRKRPTQDFRASLQGSVGTWDRYRSEADVSGPLNSEGTLRGRAVVAYQKGNSFQDHVSSERGVFYGIAEADLSPDTTFAIGASNQNDNRNDNWVGLPSPLGGRHLDLKRSSYYGADWSYWDTDTTHLFSDLTHRFANGWQMKLAADKLWARINMLGLYNDCYYSTTGCASMTQNPGDYSYTDDHDSYDAYANGPFQLLGREHELVVGASYRQERFDGHGGWGSLFNKDGTPTGPMDPTQWDPSSTLKPRLNTSLWGMKLDQEQKGAYLTTRLNLADPLKVILGGRLDWYKADADTDSYKVTRNVTRYAGVIYDLNQTYSVYASYTDIFKPQSNFDAGGGLLDPITGKNYEIGLKGEHFGGALNSQIALFQIDQENRATEDVGGPSPCPFSPTSRYCSRASGKVRSQGVDLELSGALSDDWQMMAGYTYVDAKYKHDSNKANEGKPFDAAKPRHLFKLATSYTLPGELHKWRVGGDLATQSKTEDSSTGFQQGGYTVVNAMLGYKVSERIDTRLNFNNLFDKYYYSGIDFGNLNYGEPRNLMFTVKYSL

SEQ ID NO: 22015 - protein, 745 aa, Pseudomonas aeruginosa
MNARLTICRTATAIGLVLAATPYAALAQETAPATEKTDGTALVLPTVKVVDTAEQELKQAPGVSLITAEDIAKRPPANDLSEVIRRMPGVNLTGNSSSGQYGNNRQIDLRGMGPENTLILIDGKPVASRNSVRFGRSGERNTRGDSNWVPAEQVERIEVIRGPAAARYGSGASGGVVNIITRPPTDTLAGSVTLFTNQPESGDEGDSRRIGFSLSGPLMDALSFRLYGNYNKTDGDDPDINRDASGAAAGTNPPAGREGVENKDIDGLLRWQMTPAQVLEAEAGYSRQGNIYAGDRALGGTTSPIISDLAKKGAETNVMKRTTASLTHKGDWERATSRLMFQYEHTDNTRLQEGLAGGGEGNINTTANFVTSKLKNYIATGELNIPLTVPVDMMLTTGVEWRREELNDPFSMSQAVSSGSIPGIDNTGRSGKADADTSAVFAEANIAVTDRLMLTPGVRFDHHTQFGDNWSPSLNASYDIFDGLQVKGGIARAFKAPNLYQSNPNYLYYTRGNGCPLAYQSLGGGCYIQGNDALDAETSLNKEIGLVYNMDGWAASATYFHNDYEDRIQAGMVPVGLIPSTRARIFKWENVPKAVVAGWEGNVLVPVLETLSFNTNFTYMTESKNKDTGEPLSIIPEYTINSTLDWQATDQLTLLLSMTHYGKQEPRRLNSLGGAATGAELDERGAYTLFGVNASYEFNDSYRLAAGISNLFDRRLYRQDTQSAAGANTYNEPGRAYTLSLTASF

SEQ ID NO: 22016 - protein, 418 aa, Pseudomonas aeruginosa
MITACPRPCAWRSYALGLGLLPLAAQAEFLADSSAHLDLRNFYQLRDYRQHDAPQSQAGNWSQGFVLRLQSGFTDGPLGFGLDATGLLGVKLDSGRGRSNDGTLPFGANSKEPVDDYSHLGLTAKLRYSQTQLQVGILMPQLPVAFRDDVRLLPQTFDGALLTSSEIEGLTLTAGQLWKSRTRESAGSDDMYIMGRDKAHASDEFNLAGATYAFTPRLSASYYYGQLKDIYRQHYLGLLHTLPLGEGLSLRSDLRYFDSGEDGAAISGPVDNRNLNAMLTLRAGAHAFGIGVQKMIGNDAFPVLNGYTTPYVANLMAYQTFTRPQEKSWQLRYDYDFAGLGLPGLNLMTRYVQGRDIDRGAGRADDSEWERNTDLSYVIQSGPLKSVALKWRNITYRSRYGADLDENRFIVNYTLKLW

SEQ ID NO: 22017 - protein, 192 aa, Pseudomonas aeruginosa
MKTLQKTLLALVAGSLMTAGAQAAITYGNGMTAQPYIGAKIGQYDLDDADDEALSYGVYGGAKFTPNFGIEAEYLTTSDEDFAPGSEYSADVYGLYGTYDYTFPGSQMYAKGRLGVAKNKVDVDAKNVAGQVASYNGKHSDTGIAGGLGLGYNIAPNAAVELAYDWYPKVENVGSKGDLDASGITLGANFKF

SEQ ID NO: 22018 - protein, 755 aa, Pseudomonas aeruginosa
MSPSPTASGRNRRLLSSVALTALLWPAAGHAQSAPRGLDPIVVEGQTARPSKPRAASSAAGSSRTRRASAPASRPPAAPAAAPSAAVAAVPTFNLGTMASTASRLGLTPLQTPASVDIITAQTIAERGQRDVLDAVTQNATGITATPEPGNGGVVFSTRGFSGTGSVMTLYDGTRLYVGAGTVTFPFDTWSAERIEVLRGPASVMYGEGAIGGAINVITKQPLDVQRNQAEVSLDTNLTRRIAVDSGGPINKDVSYRITATGNMSDGWVDRDKTSNIAVSAAVKVKQTDHLTWTLSTAYGDRHPSLYYGTPLVNGRLDESLRFKNYNVGDSSIRYQDSWTQLKSEWQVTDSITVRNALYYLNSRRHWKSAEEYAFNPTTRQVDRSTYLEIFHDQQQIGDRMDATVRGHLFGLENTFVAGFDVNRINFKHTNNSPYGGTSSVDPYNFDPGLFASPDLTRPGYSSVTNQYAVFAENRLQLTEQLALIGGIRQDQPTVERTDLRNPANNYTRSYSSTTWRAGAVYTPIQDLAFYGQYSTAVDPVGGLVTASNANAKFELATGKQVEIGVKQSFWGGRGEWTLAGYHIVKNNLLARSSEDPDQVVQVGQQSSRGIEASVGLALDHGWRVDANTTFLQAKYDDFVQSVNDVGVNFAGNVPINVPLNVSNAWLTWAFAAGWSANAGVQVVGKRFADAANTLEMPGYTLVNAGLQWKPDAASTLSLRLYNIFDKVYATSSYVDNQWLLGRPRTAELSYNVKF

SEQ ID NO: 22019 - protein, 416 aa, Pseudomonas aeruginosa
MNNNKKCAFALFASLACDGAPALADGFVEDARASLALRNFYMNRDFRDGAGRAKSEEWAQGFLFDYRSAYTAGTLGIGVDLLGKLGIRFDSGAGRSGTGLLPVREGGGAAGDYARLEPTARLRLSRSELRVGGLLPKLPTVQPNYGRLFPQVFQGMLLTSGELSGLSLHLGRLTEVSQRNEAGTGDLALFNRNRRFAGAAQADRFDLAGLDYRIAPDWTASYHHGELEQVYVQHFLGLKGRIGVAADSLESDLRLALSRDAGGARGGRIDNRSFSGSLTYRLRNGQAFALGYQRMGGDHGFPYLEGSDPYLVNFGQYNDFAEAGESSWQLRYDCDFAPLGWPGLSLMTRYFSGHGAQPKGADGSREWERDSDLRYVLQGGALKGLGLVWRNATYRSGFARDIDENRLYLTYELSLF

SEQ ID NO: 22020 - protein, 721 aa, Pseudomonas aeruginosa
MSSVSSLSRLAVAIALGVSMQAAQAEEEAKELGTVTVVGDWLGEADQAVVQNHPGARSVVRRREMLESGAQNVRDVLRKVPGVQVQDNNGTGGSDISLNVGVRGLTSRLSPRSTVMIDGVPAAVAPYGQPQLSMMPLSIGNLESIDVVRGAGSVRYGPQNVGGVINFVTRAIPEKFSGEIGTTIEHAGHGGWKKLNQAFLGGTADNGLGVALLYSGVKGADYRDGNNDNDIDDVLLKTHWQLTDSDQLAANFHYYDAYADMPGGLTQAQYDDDPFQSVRDWDNFRGRRKDFSLKYTRQVDDLTQFEVLTYYSDSFRGSSIAARNLRTITSYPRDYHVFAVEPRVSRIFFAGPTTQEIGIGYRYLKEAMNERASQLALVDNVPTVRPGSDGHTYQDRTGGTEASAFYIDDKIDVGNWTITPGIRFEKIDSDWRDRPVLGLNGKPVQEKKRSKDYNEPLPALSLMYHLSDEWKLFANYSESFGSLQYFQLGQGGSGNDTAAGLEPEKAKTYELGTRYDNGSWGGEITLFYIDFDDELQYVSNDVGWTNLGATKHQGIETSGHYDFAALDPRLDGLSVYGSLTYTRATYEGDIPSFKGRDLPLYSRQVATAGVRYEVDRWTYNLDAFAQSMQRAPGLSTDSQGNFTHNYITEPSADGQYGDIPGYVTWNARVGYDFGPQASNLKLGLGVKNLFDKQYFTRSSDNNSGIYVGQPRTLFMQASVGF

SEQ ID NO: 22021 - protein, 718 aa, Pseudomonas aeruginosa
MPRFSRLRTEPFALGLSTSLLLVPPALAETEEAALALPSQLVSVRQDPAELDHIDLATPVSAGSRLGLSALDTPASTSSISGEEVRRRNNPSVQAAVTRSPGISFIGTPGDGGTGLSARGFSGHASVMQLFDGTRLYTGMGTVNFPSDPWMVERIDVIRGPASVLYGEGATGAVINVVPKKPFAGEIRNHLRLGYGSYDNRQLALDSGGSLTDSLSYRLNLNQQQSHGWIDRGDSRNLGISAALRWQASDDLAFTLAHDYGDQEPMNDFGTPLVGGKYHKRLREKNYNVRNDVQRYNDQWTRLTSDWSLSDSVTASNQLYYIKARRHWRNAETYEWDVPREELLRKDYLRISHEQEQIGDRQTFAFQHALFGLDSRTLVGAEYNRIRFRLTNNSPYTDVGGDYIDPWHPAPGYFESRSPYRPHSRSQTRTFALFAENRLQLNERLSLVTGVRRDQNHIDRDDLRAGTRSDRSLQGGNWRAGLVFALTPELSLYGQYSTSEDGVSNLITLNAAQQQMDLTHSKQTEVGLKQLFPDGRGEWTLAAYHIVKKKLLSANPLPPHDAQQVGQQSSDGLEASLELNLAQDWRLSANAALVRAEYDDFDETIDKQTYSRNGNRPRNVPRRTANLWLDKSFADTLRVGAGLRYVDRRYADAANQASLPGYTVVDANLGWRVRPDLTLGLELYNLFDRQYALADNNNGQQWIMGQPRSFNVTADFSF

SEQ ID NO: 22022 - protein, 435 aa, Pseudomonas aeruginosa
MIRVRPVGRLALFLALGGTSPCHAATEEAKAPDYLEWRLLNRNYFLYNDYRRADAGRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRPLQGSGGKHWERDLDLRYLFASGPLKDLSLNVSHLSHRANAAQAGDDIDRLYLIVEYPLKGSL

SEQ ID NO: 22023 - protein, 884 aa, Pseudomonas aeruginosa
MPDVRLSSRSLTPVLCAVGLACALQGEVQAADGGPRDVATAPRVFDIAPGELAEVLLNIVRQGHVPIAFDQRLVAGLRGPDIRGRLSVEDALRRALAGSELAYAQDESGAFVLRRGQAPVQETRGATVAPTLSTVVVTGTRKSDVKAQDSLSPIDVVSATQLRSSGAVDLRDALVKLLPSLTRQAQPFNASALTHTQSLRGLSPNHVLVLVNGKRRHETANLNISGGLEKGSTGVDLDTIPINAIERVEVLRDGASAQYGSDAIAGVINVILKSADSGGSAAADVGQTGDGDGFTHGGGGNIGLAFGDSGFVNLTAEYREQERTMRSGIDERTGRRDNISMGDPAFHRQSLALNSGFGLGDDIEVYGFGTYTRRKASSAANYRLASVAPTLYPDGFTPRPNSDEDDYAFLAGVRGERLLDAWHWDLSSGYGVDRPDIGMTQSVNAAIYRETGNSPRSFDLARYRNSQWTSNLDLGREFELDFLAAPLALSLGAEYRRESYRIDAGDPASYYSGGAESLAGLSPLSEGQWSRHAWASYLDLGTSLTPAWEVDVAVRHEKFSDFGSTTNGKFATRYQFDPRVALRASVSSGFRAPSLVQEHYTGLSVGPTIALGLLAANSPAAKMLGADELQPEKSTSFNLGLVLSPWENVGLNIDAYQISIRDRIVDSATYSGQEAIDALAAAGISLPASASTVSTHYLANGADTRTRGVDITGHYLVALGEYGQVDWELSANFNRTTLRKNHRGANGEPLLNAQQVAWITSSTPRSQVSLGGTWSRQDWEVSLRLTRYGRTSSELDYTVGPDAWSTEKFNHFVNDPKYITDIAARYRLSADLTLTAGADNLFDVRPDKLPAQNTTYGDVLRYDTYASQIGFNGAFYYLRAAYRF

SEQ ID NO: 22024 - protein, 183 aa, Pseudomonas aeruginosa
MTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 22025 - protein, 452 aa, Pseudomonas aeruginosa
MKSHLLRPALRPVAGGLLSASLLCNAAHAAEAFDPHSKWMLGDWGGKRTELLEKGYDFKLEYVGEAAANLDGGYDDDKTGRYTDQFALGVHMDLEKIFGWKATEFQFMVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDTSRGLNLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKRPGGVDEVDNALVAGIKIQTVF

SEQ ID NO: 22026 - protein, 710 aa, Pseudomonas aeruginosa
MPSRPRLTTVSHLLPGSLALCGLAFACAAQGEERRSLEPMVVTGSYNPSDTFDLPFSVNSVERRQIADGQLGINLSEVLPRVPGLVVQNRQNYAQDLQISSRGYGARSAFGIRGLKLLADGIPASTPDGQGQAATLNLDVAERIEVLRGPASTIYGSNAGGVIQMFSRDGQGAPRVGAETTVGSDGLSRNHLYTEGEGDGVGFLVDASRMDTDGYRDHSAARRDQTFAKLNFRPDADSRLALIYSSLEQNDTEDPLGQTWDAYKHDPRSVTANAELYDTRKSIDHQQAGMNYERYFGEATLQVNAYVGKRSVVQYQAIPKQIGCESNPRCQRNGAVIDFDRDFHGGTVRWLQPVRQAPGELNLTVGLDYDQSRDDRRGYQNFNGDQLGVKGELRRDEVDTATSLDPYLQASWAIDAWTLQAGVRHSTMKMEVDDRYLSNGDASGSRRYRKNTPSFSVMYAFTPDLHGYLSAGKGFETPTQAEMAYAPVAANAPDVFNFGLKPATSSQYEAGLKARLWGNTRVNAAIFQIRTEDEIVVASSLGGRTSYQNAGKTLRRGFELGVESELSEHWNANLAYTRLSATYDSDFEAGGKTIGKGKHLPGVPASSLFGELVWKPVEGISMGWEGMYRSQVYVEDSNSEKAAPSYAVFNWRTRFEQRLGAWTFHQLVRLDNLFDRQYVGSVIVGDGNRRYYEAAPGLSWYAGAGLEYQF

SEQ ID NO: 22027 - protein, 416 aa, Pseudomonas aeruginosa
MTRSAPNLLKSASLAPVLLAGLPSLAGAEGFIEDASVSLGLRNLYFNRDFRQPGAAQSKQEEWAQGFLLQAKSGYTQGTLGLGVELIGQLGLKLDSSPDRAGSGLLPRHADGRAADDYARLGVAPKLKLSNTELKLGELLPELPILLRNDGRLLPQTFQGGMLTSREIAGLTLHGGQMRSLSQRNSSDHQDLSVDGRGGAFSDRFDYLGAEYCFNAERSQVGLWQARLQDIYRQDYYSLSHKQSFGGWRLGASVGLFDTRDEGAAKLGELENRALTGFFSATRGGHSLGAGYQRMYGDDGMLYIAGTSTPLVNDIQVRNFTSAGERSWQLRYDYDFVALGIPGLTAMARYASGAHARTKAMDDGRAWERDVDVAYVIQSGPLKNLGLRWRNAMLRSNHAADVDENRLILSYSLPLL

SEQ ID NO: 22028 - protein, 413 aa, Pseudomonas aeruginosa
MHPTPRLAAALLAGSGLGWPLLAQADLVEDSHASLELRNFYFNRDFRQSGARDNADEWAQGFLLRLESGFSEGTVGFGVDAIGLLGFKLDSGGGSGGTGLLPADGSAGGSQDDYAKLGLTAKARVSNSLLKVGALHFKSPLVSANDTRLLPELFRSALLDVQRSTTDLRARTLDRNKLTAPATTRCSAPTASAGAAMLRLRRRRLSPDPGADRQPAPGSAQGHLPADVRRPGTHPRPRRTAFAQERPALRPGQRGRRLPRTGQPRLRRPLQPAPGRPRGGRRLPADQWRRSLSLHRRQRPVPGQLHPDRRLRQRRRAFLATALRLRFRRARPARPELHEPLRLRRQRRPRRGQRRQGMGTQHRPRLRGAERAAEEPRGEMAQRHGAFEFRQRPRRKSPDPQLQPDAVVRSGEQ

SEQ ID NO: 22029 - protein, 880 aa, Pseudomonas aeruginosa
MHRSLHTDAPLGAALLLALQLAPGSAAAAEEQAPVDPPTVQLQRIEVTGSAIRRVDAETAVPISVLRAEELRQQGVTSTEELIGRLSGNQGVYNSSRSVGSATGGASFADLRGIGANKTLVLLNGRRLANNAIDGSAVDLNTIPFAAIDRVEVLRDGASALYGTDAIGGVINFITRKSLNEGRFDSGYASPTHDGGGNQRNVSASWGFGELEEDRFNVFAVANYDKQERLGAKDRGYTYNYQPGRGLDYSSGTAFPGNWSQGANASNPLAAGGCKGADLIPRNGICRQSLWRYLDLVPETEKTSVFSRATGKLADEHNVSLEYFWSRNDNATQVGPGTLTGLQIDPGTAFYPGNGITPGPGGFVLDPSRPVEVNWRQSVLGPRLQSSQNTGQRLLLGFDGQFAGWDYDIGASYNQNKVVDHIHSGYVDDRAAALGIANGTLNPFGPQTDAGLAYLGSHALSGDFRTSVGRVKGLDARASREIGDWFGAGPAALALGGEFRKEAFHQDIQDFAGNVQSLGVDPAATVSGERNLKAQYAELNVPVLDSLELSAAIRHDKYSDFGSTSNPKYSFRFQPFRQLVLRGAYSEGFRAPSLYELYNPTFTTYTSANYDDPRLCAGGQPSQGGIANRDCAQQFYNATGGNTDLRPETARNVTLGLVYQPLRDLSVGLDFWWIRIANQIAEFPEAAIFADPQAYAGRIVRKADGSIDHVVTGLANLGKVKTSGVDLSLDYRFPASRYGQFGLDLQGTYVSRYDFQQQIGGQYLDNVGDFQGVGVIARWKHVANATWSRDAWQATLSNRYTSGYNDYDRASHGKVGSWNLWDLAGSYRLSHALGLTLGVKNLFDREPPFSNQTYTFQSGYDPRYTDPYGRILFGRLSYSF

SEQ ID NO: 22030 - protein, 136 aa, Pseudomonas aeruginosa
MVTFSWTINYSRVLEHEYQQSKDHEKDDYLKDLSSLDWRDRFNTSLSWSFGDWASTVLVNRYGKIPNGDQTAYLSPTYLVNWSGTYQISPKASASIIINNLFDKVKRDDTGGWPYYPVGSYSPFGRQGWLEFNYKF

SEQ ID NO: 22031 - protein, 653 aa, Pseudomonas aeruginosa
MTPHSSPHRLPPLRLARAVPFLYLLPCLALAAPVDLEPTVVSATTTERKLRDAPASVSLIAAEDLRRRPVRDLQEALRGSESLQFNGVGMSRRGISVRGMSSEHTLVLVDGQRISTSSGAIAHSDFDLGWVPVESIERIEVVRGPMSSLYGSEALGGVVNVITRRATDTWTGSGLLDGGVREDGLGGQSHQLGAYLAGPLVPGKLGLALNGESRRQQETPDADERRLSELEGGNADSGGLNLSWTPDDAQRIDLGHQRGRERRWRNSETGGPRSRYYESRDVIERERWSLAHNGQWDWGSSQLRTYRNRLERHNARSDGQPPSNPQRLTDSVVDGHLSVPAFERHLFTLGGEWRKEELEDRSVNTAGDASARHKALFLQDEIAFGPDWSLTLGSRFDKHEAFGWESSPRLYLLHHLSDALTLRAGVGRGYKAPSLKQLSPEYAAVGGGGRFTIYGNPDLKPETNTSYELGADYQGDGWSLKGTVFENDVRDLIQTVCVARCGVRGGEIRNYENVDRARIRGLELSGGVDLPADLRWELNYTYLDARNRTAGQRLGDRSRHLANSQLRWSPNARFSAQLRTEYVGSQVAYSSNVGYALPAYSLWHLELSQKLSENLTLRGGIENLGDQRLADDDTHFTYAEPGRTFHLGLVASF

SEQ ID NO: 22032 - protein, 804 aa, Pseudomonas aeruginosa
MPVRTLRPRSLSLAIHAAAMTLALAGAAPALLAAEAPAASSARSYDIAPGPLGRTLSAFASDNGVSLAFDPALTEGRRSAALRGRYAPVEALHRLLLGSGLELQQRSDGSYTLVPAATDGALELQSSLITAQAAGAETLPAEYAGGQVARGARLGMLGNADVMDAPFSITSYTARTIEQQQARSVADLLQANDPSVRVVGGRGDLVDSYTIRGFSVQNADVAFNGLYGLLPFWRVPIEFAERVEVLKGPNALLGGISPGGSVGGTINLVPKRADDQPLTRVSVDWTQRGQLGTHLDIGRRFGENNAFGVRFNGVYRNGDTAVDHQSREFPMLSLGLDFRGERLRLSSDLLYQKESLEGVVRPLLTGPGTTHIPHAPDSKTRFGLRDSYLDQEDYSMVNRGEYDLADNLTAFASIGGRQSNYETIAANSILVGNQGDIVNSLARQRGDRRTYSAEVGLRGNFDTGPLRHDWTLSANRLHERLGMVYAFTGMQPGNLYQTSPHTPLPDFSSLDGSIPKTNETDLGGVALADRLSFLEDRVQVTLGVRRQQIESRNYDQTSGARTSHDKRHVWTPMASVLVKPLQDLSLYANYIQGLSQGEAAPMTAANAGQVLAPYKAEQYEIGAKYDLGGFTTTLALFEIRKPNAYTDASNVFRADGEQRNRGVELSLYGEPLDGVRVMAGATYIKPEQNKTGDPASEGKDAPGVARRQANLGVSWDTPFVDGLTLDSRWIYTGSAYVDSANALAVPHWNRVDLGAAYAFQVAGKPLVARANLENALGKDYWTAANGYLSISSPRTLSLSLTADF

SEQ ID NO: 22033 - protein, 532 aa, Pseudomonas aeruginosa
MKMRIAPLWLALAGVCLAWIPPAGAQMANDLTIGNPKAMALGNAVTADETGIDSVHYNPAALTKMKGRQATVKLLTGVMDIRAGFKAPPNYGEGTFGLRDDPVANSHSRTLTPTMYLPGLGGMTDVPLLVAPLAGISINPPGSKFTFATNVYTPQALGYSRDSDSDPARYQGREVSLQRLTYFSPTLAYQVNDELSVGLSVGFSHQAVALNEDFRAPNQLLGLLQQTKEIGCLPGMQEILEVFFNVCGGNIGPFQNLANIDLDMQQSLSPSFNLGVLWEPTDWFAWGATYQSESRMRLKGKYRVDYGQGWQGFWTGVHKSLGGAILGQMFPYGNVDEEHGNATMNMVYPDAFSTGVKLRPFKKWQFNFDLKWNGYSDWNEFKIEFDRELDLLRIAKYLDSKDATSHSITLDRGYRDTWSWAMGVQYDVNDRLQLRAGYEYRPSAIPKGQADILVPIGDANLYGLGLGYQWDKDTVIDVGFNYFVTKQSVKADTSCNLNCTGLDNLVYNPYAGLDVDTTVKAYIFAMTYRTTF

SEQ ID NO: 22034 - protein, 705 aa, Pseudomonas aeruginosa
MPIASRAPVSLTLLALLALLFGSKLAAADLFNDPSGVPEVLTATRLKQSPAEVPGSISVLDRELIVASGARDIPELMRLVPGMMVGYLSGNQPTVNYHGTSMSGARRLQVLIDGRSVYRPGLASVDWSDLPLALEDVERIEVFRGPNTVSYGANALMGVINIITRAPGESPGTRLKYTAGQRGIRDWYASQSIALEDSDFRLSLSGQEDDGFDHDLDGHALRDGRRLSRFNLNASHSLAPNQSLEWQLAAKEGSNQHPYAYRSPFPQVPDDVDNSDTLAHDYAGSLRWNVDLDPRHSFYIQGYAQHWERRQEWNACEAGIAFSPQLAQLWELNPDYLRRFADDPTRLPPGSAQELQLATQVLDQLRNGGLRPVCGRVDRNIRESRYDLEMQDTLSLGDNLRLLNGLSYRYDQANSETFYGGRVSSQIWRLFSQLEWHAGEHWLLQGGGMLEDVEGSGSSFSPRLAVNYLFNPQHSLRAVYSEAVRSPGMYENDVDWRYRVRHLTPAPYGQSEAYYFASAHGPGDLGKEHTRSREIGYNGFFRETGLAMDVRLFHEEITGLISDPLSVVDFSPDNGDRIRFSGAEGQLDWRLGLRDRLRATYAYLDYDATSRYDRRLTARHGGSAGWMRDWGQGWSSALFYYGDDSLNGHRFERVDLRLAKRIPLGKAALELAGVLQQRLDDQPLTFPDNRYDSRHLLYFSAEVTF

SEQ ID NO: 22035 - protein, 612 aa, Pseudomonas aeruginosa
MNRVFLTPAAVALCGASSLSLAEPVSLADQVVTATRTAQTASQSLAAVSVIDREDIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHQTLEGSAGVSGGAGNGWYSLGVSSFDTAGINAKRAGTSSYEPDRDGYRNLSGNLRGGYRFDNGLELDGTLLRAKSHNDYDQVFGNSGFNTNADGEQNLVGGRARFTPLDPWLVTLQAGRSEDKADAYQDGRFYSRFDTRRDSLSWQNDLTLAEGHVLTLGYDWQKDEISSSEAFSVDSRLNKGWFAQYLGQYGRQDWQLSLRRDDNQQFGVHDTGSAAWGYALSDALRFTVNYGTAFKAPTFNELYYLDYGNPDLDAETSRSLEVGLSGTHDWGHWAVNAYRTDIDSLITYTTRQGLYVPFNIDEARIRGVELVLGSQWLGWDWNANATFLDPQNRSGGVNDGNELPRRARRMFNLELDRRFERLSLGASVHAEGRRYDDPANKVRLGGYATLDLRSEYRLNDEWRLQGRIANLFGADYETAYGYNQPGQAVYLSVRYQAL

SEQ ID NO: 22036 - protein, 416 aa, Pseudomonas aeruginosa
MKILPVPMLAAGLALLPSFAQAEFFADGKAGLELRNFYFNRDYRQPGASQSYSEEWAQGFLLRYESGYTEGLFGLGIDALGLLGVRLDSSPERSGSGLLPYSTSDRRAAHDYSSLGLTAKLRVSHSTLKIGSLMPRLPVVQFNDTRLHPQTFQGGLLEVNEIDGLALQFGQLRQVKQRDSTNAEDLGITRGNKRNVLAGRHSGSDRFDFAGGTYRWSERLSSSYHYANLEDFYRQHYLGVQHLLPLADDQSLKSDIRWARSTDEGGSRVDNRALNALFTYRLGGHAFGLGYQRMSGDSGFAYLGGTDPYLVNFVQIGDFANKDERSWQLRYDYDFAAIGLPGLTFMSRYLRGEHIDLLDGGGRGKEWERDTDIAYLVQSGPLKNLGIKLRNGTFRSDFGNDIDETRLIVSYALPLW

SEQ ID NO: 22037 - protein, 229 aa, Pseudomonas aeruginosa
MYPMDRIQQKHARQIDLLENLTAVIQDYPNPACIRDETGKFIFCNTLFHESFLTQDQSAEKWLLSQRDFCELISVTEMEAYRNEHTHLNLVEDVFIQNRFWTISVQSFLNGHRNIILWQFYDAAHVRHKDSYNQKTIVSDDIRNIIRRMSDDSSVSSYVNDVFYLYSTGISHNAIARILNISISTSKKHASLICDYFSVSNKDELIILLYNKKFIYYLYEKAMCIINTR

SEQ ID NO: 22038 - protein, 427 aa, Pseudomonas aeruginosa
MSTSLPQAARSVRSSRSTTLTTTAVVLAGIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEIKDLGFTAGRLEKTKIRDSSDSEDLALNDKNGRFAGVSADHFDLGGLDYKLTDQLTASYHYSNLQDVYRQHFVGLLHSWPIGPGELTSDLRFARSTDSGSAKAGGIDNKSLNGMFTYSLGNHAFGAAWQRMNGDDAFPYLEGSNPYLVNFVQVNDFAGPKERSWQLRYDYDFVGLGIPGLTFMTRYVKGDNVELAGQRGEGREWERNTELQYVFQSGALKNLGIRWRNATFRSNFTRDIDENRLIVSYTLPIW

SEQ ID NO: 22039 - protein, 806 aa, Pseudomonas aeruginosa
MPRPTFRPGLLAIAIAIALAVPAPFLHAAPAEQASVRDYRIAAGPLAGTLNRIAAQAGLVLTLDPALAEGRSAHAVQGRFDAPGALREALRGSGLELVENAGGTYSLRKVPEDTLSLQAMTVSGAEEDPLGPTSGYVAKRSMTGTKTDTPILETPRSISVATRQQMADRAVHNLDDAVRYMPGVVASSFGSDTRSDWLKVRGFKPTQFLDGLPMAVGVYNNPKLETWNLERVALLRGPASSVYGQTPPGGMLDMVSLRPQNVASHEVKAEVGNYNHKQVSFDSTGPLDDEGRFLYRLSGVVRDSNTQVDHIDDKRYNIAPSLTWNIDDDTRLTFLGQFNRDDTAATSQFLPLRGTKYDAPFGKISHHKNLGDPDWDFYDRTYYWLGYSFERRINDVWQFRQNLRYLRNDLSFQTLTPTSSIDAASADGTLQRMTTSVDEDVSQFVVDNNFQADFETGALRHTLLLGIDHNRTRTDYTSIYNFTGVPPTNVNNPIYGQPIPKPSRSSAFYDYRQKTYQTGLYLQDQIALDNWRLTLGGREDWVHAGATFYNQNDATNTSRDKKFSANAALSYIFDNGLAPYLSYAESFQPSTGADDIGSNKMFKPTEGKQWELGVKYQPVGSDSLFTAAVYDLRQENVRVTDNINGTPTTSQAGEVKVSGIELEATSNVTENLKMIGAYSYTDTEVKKGQYAGNRLQQAPRNQASLWADYTWHEGALNGFSVGAGARYVGSTYGDQANTYDGYAGSYTLYDAAVRYDLGQLNGSLKGVSVAVNANNLFNKDYLASCDGYYCYYGDQRSVVGSVSYKW

SEQ ID NO: 22040 - protein, 730 aa, Pseudomonas aeruginosa
MKKHSTARRVLALGLNLTLAGVPALLWADEEPTELPALTVSAGAAGETPPALDLDDSAGGGSRLGLSLRETPGSVSVANRASFERRGLRSTQDIANSLPGVNASAPPGFGGFVTYRGFSSNQVNQLFNGIPVQYSSAMRPLDDWIVDRVELVGGPSSFLNGAGAVGGSLDYISKLADRYGDFMEGRVRYGSYDDSEVAFGFNQALGIGPEPKHFVRLDVSRSGGNGYVDRNSRESWNVAFSLLSDLTPDLSHTLALEYQDEQEDSPYWGTPVLNPYAGELKIDKSRRRENYNVADGRYEQRVRWLRSILEYRVSDSTRWRNTFYHYDAERDYRNLETYRYNADNSGVVRSNAFLQRHDQQLNGNRFELQHSQPLFGLASDWALGFDYSINKQTRFPSTASGPFGTVDPASFEPGHFYDLPGMRPGHRKDRSNEVRTSALFAENRLGLTDELSLVTGLRYDHLDLDVRNHRTVTASDPAHFERRWDVVTGRAGLVYQFTPHANVYLQYSTAADPPGGVLTSASFGQVRDYDLSTGDQWELGSKFDFLDGRGSATLAAYRIVRRDFSVADPNNPNLSVPVGQQTSRGIEAAASLRITPKLLAEGNFAWVDAQYDEFTENVGGVAVSRKGKTPPNVPERVGNLWLTYDFDPAWQGGVDARYVSSVYANNANTWHVPSYTVYGTFLSYRLDERTRITGRVRNLTDEVYARFVQSTPLYYVGDPRTFELSVQTRF

SEQ ID NO: 22041 - protein, 647 aa, Pseudomonas aeruginosa
MFKPLAVAVGLGCAALSLGANAYQYGEYAGETLERLITDYPGRYRGTASFAGASELMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRTNLLGMINLDSLVTGDKMYAHAGSNSVSNPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLELTNADLLASTASGGALARQMEDQLQRQHQALTRLHDRRWLTLLGSNRPVGSFDGEVGAEGEVSPDSGFDMPGDPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMRYRIDDFREDEALRTALGYEKQDYDSLEASLGWRLRGELALGARMRLQPYASLRWVRELADGRLDDMDLTSRGDGRVRVADMGGVDKDFGRAQLGAQLAITEQLGVFAEANSRFAHSEGNQAGYSLGVNWQF

SEQ ID NO: 22042 - protein, 797 aa, Pseudomonas aeruginosa
MKHHKKFIKTTLSAAIMLALPITGLAEVEKIVVTAQKRSEPLQDVPVAITAFTGATMEALGITDASDLVAVTPGLTSSAQGGSNRNYFLRGIGTGDFHLTASPAVGQYYDGITLTSGFQARAALFDMQRVEVLKGPQNTLFGLNTTGGAINYITNKPEIDGGTNGSVKVKIGSDSLINTESAIGFDISDSVAARLAVMTNKNDGPFTSLSDGRDYGDDDMKAVRLGVLWAPVDDASLLFNVNTMQSENNSTASELLGSRAPDGSGDVCAEFNRGNLDFERNTDCVGRDGGATGEQPTDPSTGSWDTISTNFGLEDIKTKGYYLAFDYDFDIGTLSLISSFDNLDFKVATDVDGSATLGAHLTQEDDRDTYQHELRFVSDGLDAFRWIAGIYYLDQDAESFTGIRSPGIGGGNIIPNVQLAHSKENLGIYTQAEYDLTDDITITSGLRWSDEKIVADYLPSSPNAQTFDNKIPLFSNDIDELVRLQNNVENPNLDVDGYDIRRQVRQNLSNEDIGYTVKLDWKATEDALLYASLSKGFKGGAADIRTAYALVPPANILTGLEDARLEPESLKAWEVGYKSSFLKNSIQLDAAVFYYTYFNKQQFVTAGGIPTLANAPQSEIKGLDANVKYANDYGLFLDFGLALIDSEITDAGEDELFIEGTELGNTPKYSLSMVAKQEIEFQNGTLLTLMGNVNYTDDETKGSITRGSSELKDLITQEAFTLVNMNVKYSFGDDLQYAVSLYGNNLTDEHFCASLGTSDGNKIYADGISPGSLGYNVRCVVTRASTRTFGLSFGLTF

SEQ ID NO: 22043 - protein, 452 aa, Pseudomonas aeruginosa
MQNLRRAVFAGLVAGTLSEGAAATAGDGGFVEDSELQFLARTYYFNRDYRDSPNNAGRNRFKPRSERNGYREEATQGLRLQFASGYTPGSLGFGLDAHAMLGLQLDSGGGRTGTGNLPVGADGHPDHRYGKVGGALRLRHGETRLKYGQTTTSAPVFAASSNRTLAGMAYGLLLEDRSFDGLLLEGGRFTAASGPGESKVRGDISTVYGRLGAYPVRLDAVGFLGGQWQATERLQLSLYASRFDDIWQQAYFGASHRQPLGGERALRVDLDAYRTRDSGQSRFGRIDTLASSLALGYEQGPQRITLAYQRVHGEQPFDYMAFGDGRSSASMVLANSVGYSDFNGPGERSWQLRYDLDLGALGLPGLSLHALHARGRAGASASSAAESIYAGLYGRDGRHRESDLGFAYRVKAGPLAGLALRASQAWHRGNASYLDGDIDETRLVVDYSRSIW

SEQ ID NO: 22044 - protein, 444 aa, Pseudomonas aeruginosa
MRNLFALTPMALALCTASAAWADEGEAKEGFIEGSSLQLLTRNYYFNHDRRHASGHDSKEWAQGFIATFQSGYTPGVVGFGVDAYGMLGLKLDGGGGTGGTSILPITAPSKEGYESGKAPDEFSSGGAALKIRAFDTELKLGDQFLSNPVVAGGESRMLPQTFRGVSLTNNSFEDLTLTAGQVSFTKYYNQSGHRRLGSYYGELPGDRDSHHLSWLGGTWGGIEGFTSSLYAAELQNVWKQYYADVDYTYEIDDNWSLNPGAHYYKTVDSGDSLLGRIDNNTYSLHFAVGYRQHTVTAVLQKVNGNTPFDYINQGDSIFLDNSQQYSDFNGPNEKSWKLQYDYDFVALGLPGLSASASYSRGKLDLTRVDPDSPGYGGWYSADGKNAKHWERDLDLQYVVQGGPAKDLSLRLRWATHRGTGGYSAVDNDIDEYRVIVDYPIDVF

SEQ ID NO: 22045 - protein, 795 aa, Pseudomonas aeruginosa
MTPFPRFALRTLPALFLSLGCLAATAQAAEAVRYRFSQAAAPLAQALNAFSRASGQTLLYTAELPPQATAPALHGSLDAEEALQRLLQGSGLRARRIDERTLTLEPIPASGALDLDATTVSAAAPAQGYRPAANASISRGDAPLLEIPQAISVVPAQALQDQRPRNLDDALGNISGITQANTLGGTQDAVMKRGFGDNRDGSIMRDGMPSVQGRNFTATADHVEVLKGPASLLYGIQDPGGVVNVVSKKPQLQQANALTLRGSAYAHGRNGSGGQLDSTGPLGDSGLAYRMILDHEDEDYWRDFGKSRETLVTPSLAWYGEDTTVNLSYEHREFTTPFDRGTAIDPRTNRPLDIPRSRRLDEPFNITEGRSELTRLDLERQLDDTWKAHFGYGYSRETYDDNQARVMAVNADGTLTRRMDGTHGAVSSDSFATLGLSGTLQLAGMQHDLQFGMDHEKRKIFRADLLRDSKTSRFDYLDPVYGQVVPSTRVVAGDSDQTDKLRSDSLYFQDSIHLDERWILVGGARYQIYDQLAGRGRPFNANTDINGQKWVPRGGLVYRLSDEVSLYGSYTRSFKPNSTIAPLSTGETIDSAILPEEATSWELGAKLDVPGRLSGTLALFDIRKKNVLVNELDGAGNSSVRAAGRVRSRGLELDLTGQLSERWSLIGSYAWLAAEVTEDPTLEGKRLQNVARNTASLSAVYELGQLFGGDRLRLGGGARYVGKRPGDPANSFDLPSYTVADAFASYDTRFGGHGVKFQLNVKNLFDRTYYPSSANRLYVAMGEPRQFQLSTTVEF

SEQ ID NO: 22046 - protein, 392 aa, Neisseria meningitidis
MRKKLTALVLSALPLAAVADVSLYGEIKAGVEGRNYQLQLTEQPSRTQGQTSNQVKVTKAKSRIRTKISDFGSFIGFKGSEDLGEGLKAVWQLEQDVSVAGGGATQWGNRESFIGLAGEFGTLRAGRVANQFDDASKAIDPWDSNNVVASQLGIFKRHDDMPVSVRYDSPDFSGFSGSVQFVPAQNSKSAYTPAYYTKDKNNALTLVPAVVGKPGSDVYYAGLNYKNGGFAGNYAFKYARHANVGRDAFELFLLGSGSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22047 - protein, 381 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22048 - protein, 212 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGK

SEQ ID NO: 22049 - protein, 389 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVRSQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22050 - protein, 384 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 22051 - protein, 915 aa, Neisseria meningitidis
MQQQHLFRFNILCLSLMTALPAYAENVQAGQAQEKQLDTIQVKAKKQKTRRDNEVTGLGKLVKSSDTLSKEQVLNIRDLTRYDPGIAVVEQGRGASSGYSIRGMDKNRVSLTVDGVSQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVPVEDSSNYAYFIVKEECKNGSYETCKANPKKDVVGKDERQTVSTRDYTGPNRFLADPLSYESRSWLFRPGFRFENKRHYIGGILEHTQQTFDTRDMTVPAFLTKAVFDANKKQAGSLPGNGKYAGNHKYGGLFTNGENGALVGAEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNLGFDRFGSNLRHQDYYYQHANRAYSSNTPPQNNGKKISPNGSETSPYWVTIGRGNVVTGQICRLGNNTYTDCTPRSINGKSYYAAVRDNVRLGRWADVGAGLRYDYRSTHSDDGSVSTGTHRTLSWNAGIVLKPTDWLDLTYRTSTGFRLPSFAEMYGWRAGVQSKAVKIDPEKSFNKEAGIVFKGDFGNLEASWFNNAYRDLIVRGYEAQIKDGKEEAKGDPAYLNAQSARITGINILGKIDWNGVWDKLPEGWYSTFAYNRVRVRDIKKRADRTDIQSHLFDAIQPSRYVVGLGYDQPEGKWGVNGMLTYSKAKEITELLGSRALLNGNSRNTKATARRTRPWYIVDVSGYYTVKKHFTLRAGVYNLLNYRYVTWENVRQTAGGAVNQHKNVGVYNRYAAPGRNYTFSLEMKF

SEQ ID NO: 22052 - protein, 381 aa, Neisseria meningitidis
MRKKLTALVLSALPLAAVADVSLYGEIKAGVEGNNIQLQLTVPPSQGQTGNKVTKGKSRIRTKISDFGSFIGFKGGEDLGEGLKAVWQLEQDVSVAGGGATQWGNRESFIGLAGEFGTLRAGRVANQFDDASQAIDPWDSNNDVASQLGIFKRHDDMSVSVRYDSPEFSGFSGSVQFVPAQNSKSAYKPAYVDDQGKVKGPVVGKPGSDVYYAGLNYKNGGFAGNYAFKYAKHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22053 - protein, 387 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNTDVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22054 - protein, 850 aa, Neisseria meningitidis
MKIRYSSSFLLLILLVSKSYAASESDISGRNPEKILAQENKNVLTFSSASLFGGQSQSVDLSIFRNANYVAEGTYIVDTAVNERSIGELKVLFKHLDANSTAVLCIDADILKRLDLQPHYLASLAKKDCLTIKDINPDAYYDFDLSTQKIAIYIPQKFVVDRPAGYIDPALFDSGINSAFIGYNANFNQNDQEDSKYLALTAGLNLKGWYFRHAGNFDSKDSGLGKYRSYQNVLYRDITAINARISAGQFNTSSLQTESLPIVGIQLASDLSMLPWSMRSYAPVIENVANTNALVRVFQNGQKIYERTVPAGPFRITDLTSFASGVMTLEITENGGEKKTYIIPVQNNMNLLKPGQKTFSIALGNYKTIEKLTDDSVLQASYNYGLNNYLTLLSGMNLTQDYQGGMLGAGLNTVLGGISIKANVSQATLRDQDYSGQKIALDYSYYLPAYKINFYANAQTQTQHYLSVLNLLSYKNYDYLNTDELNSLSLTADLRNQVNFSLSKSFDNPKMGALSLGFLVSDYWNSDNNRYQYNLSYGNSWKRMSYSIGFSQTNYRENTFDKDRSIYFSVSLPLDLRKSNINLNSTYQHSEQQGISSDNFGAYLSGTAGSNNNINFGLGATSNRYDGSTNNSYNANVNYLLPQVNLGATVYHSNQDTQYSLSAQGAIVAHRYGITTTNTAADTYTIVHVDHGAGASVENAWGIKLDRWGNAIYPNASAYSINTLSINPDQLPPEITLDGNQTRVIPRMYSSTLATFKANQQSNILMRIDSKNTQQFPMGSRIETSSGELIGLMGQSNQSLLTHDIRDLKEPLKVVWGDQVKQSCNIPLTEFSSVVKKKNSQLDIINVECH

SEQ ID NO: 22055 - protein, 703 aa, Neisseria meningitidis
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNVTFAAANLLNQKYWRSDSMPGNPRGYTARVNYRF

SEQ ID NO: 22056 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHTLETSDNARIRLNTKDEKLTVHKAYQGGADFLFGYDVRESDEPALTFEQNVSGKSNVVLERRPENLKTLDGRKLIAAEKADPNSFAFKQNYRQGLYELLLKQCEGGFCLGVQRLAIPEAEAVLYAQQAYAANTLFGLRAADRGGDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRVERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMFARIGYGKRTDGDKEAALSLKWLF

SEQ ID NO: 22057 - protein, 389 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22058 - protein, 359 aa, Neisseria meningitidis
MRKKLTALVLSALPLAAVADVSLYGEIKAGVEGRNYQLQLTEPASKSQPQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAHFVQQTPQSQPTLVPAVVGKPGSDVYYAGLNYKNGGFAGNYAFKYARHANVGRNAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIV

SEQ ID NO: 22059 - protein, 88 aa, Neisseria meningitidis
MRKKLTALVLSALPLAAVADVSLYGEIKAGVEGRNIQLQLTEPLQNIKQPQVTKRKSRIRTKISDFGSFIGFKGSEDLGEGLKAVWQL

SEQ ID NO: 22060 - protein, 97 aa, Neisseria meningitidis
MRKKLTALVLSALPLAAVADVSLYGEIKAGVEGRNYQLQLTEAQAANGGAVASGQVKVTKVTKAKSRIRTKISDFGSFIGFKGSEDLGEGLKAVLAS

SEQ ID NO: 22061 - protein, 1083 aa, Neisseria meningitidis
GEGVIGASVVVKGTTNGTITGLDGDFSLSNVKEGDIIVISFVGYATQEIKWTGKPLDVLLKDDTQLLGEVVVTALGMKREEKALGYAVTELKSEELYTNTVNPVASLQGKVAGVEISNSDGGIFGSAKIQIRGASTLGSNNQPIYVVDGVILDNSTQGRDMDGEEIDAIDYGNELKNLNPDDFETVSVLKGAAATALYGSRGLNGAVVITTKGGGKFKGFGVDVTQTLGIDHAYKQPSIQTVYGPGARPGRIGYGENGNTWIPTYYTNAKGEPSLIGASTLGWGLPYDSSVMIEDYDGRKVPYSPIKNNMLDMYQLGFNTNTNVSVRGGNEKTSFYSSVSYKKVNATTPNNTFERYAFLVKGSHKISDRVDVAASVSFANSKPRNAARAVGEYFYQGLTPLYDAKYYRDKYLSEQGGIARSGDTYANVPESSKSYWFNIDNMDYNRKETVVRPILEVNVKIADWVRFKGEGNMNYVYIREENKELGTGVAYEGGNYKLAQQTKEQTTFAGTFTFDKAVKDFNLGGFIRGEYYNNYQTAYSVETDGLIVPGQFFIGNSKRQVKASGKIEGTKRMLSAVFAFNASWKNQLYLDVTGRNDWSSALVYANKNGNYSYFYPSVSGSWLISETFKDKMPSWISFAKIRGSWAQVGNDTGAYTINSGYNVGNLQLIDGSYVYTNSFSSTAISPNLKPERKNAWEVGLDLRFLDNRINLDATYYKENTRDQIMNISTPSISGVSNQLINAGNIQNSGVEIALNTIPFRNKDWEWNLDFTFTKNNNKIIELHPDAAEYIGLRGSTGWGNMRIQSAARVGGPYGVLISDITPKRDDNGNIILKWSDSDRSAYADRSLKNEVIGDMNPDFLGSVSTGLTWKNLSFRMALDMRFGGKVAVYGNRYGTAYGWTESSLKFRDEAHGGMTWTSQYLNADGSQSGSYGVTYHDGMIPQGIFASGTQVTGIDGKTHDVGGMSYQQAYENGILEPMHAASYYNYANQWATGVTNDGWIHDLKYIALREITVGYTFPSNIAGKIGAKRLGVSFSARNLGYLYNSLPNDVNPEGVRGNLSGEFRIRSFDPYTANYTMTINVGF

SEQ ID NO: 22062 - protein, 379 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22063 - protein, 384 aa, Neisseria meningitidis
MRKKLTALVLSALPLAAVADVSLYGEIKAGVEGRNFQLQLTEPPSKSQSQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNAGVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22064 - protein, 384 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAINPWDSNNDVASQLGIFKRHDDMPVSVRYDSPDFSGFSGSVQFVPIQNSKSAYTPAHYTRQNNANVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22065 - protein, 386 aa, Neisseria meningitidis
MRKKLTALVLSALPLAAVADVSLYGEIKAGVEGRNYQLQLTEAQAANGGASDQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHFVADSQGEITRVPAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22066 - protein, 395 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22067 - protein, 387 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22068 - protein, 384 aa, Neisseria meningitidis
MRKKLTALVLSALPLAAVADVSLYGEIKAGVEGRNFQLQLTEPPSRSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22069 - protein, 392 aa, Neisseria meningitidis
MRKKLTALVLSALPLAAVADVSLYGEIKAGVEGRNYQLQLTEKPSSTNAKTGNKVEVTKAKSRIRTRISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22070 - protein, 399 aa, Neisseria meningitidis
MRKKLTALVLSALPLAAVADVSLYGEIKAGVEGRNFQLQLTEQPQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPAQNSKSAYTPAHWNTVYNTNGTTTTTTTFVPAVVGKPGSDVYYAGLNYKNGGFAGNYAFKYARHANVGRDAFELFLIGSATSDQAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22071 - protein, 392 aa, Neisseria meningitidis
MRKKLTALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGATQWGNRESFIGLAGEFGTLRTGRVANQFDDASQAIDPWDSNNDVASQLGIFKRHDDMPVSVRYDSPEFSGFSGSVQFVPAQNSKSAYTPAYFTADPNDQNKITRVPAVVGKPGSDVYYAGLNYKNGGFAGNYAFKYARHANVGRDAFELFLLGSGSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRH

SEQ ID NO: 22072 - protein, 386 aa, Neisseria meningitidis
MRKKLTALVLSALPLAAVADVSLYGEIKAGVEGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSGVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAASVGLRHK

SEQ ID NO: 22073 - protein, 380 aa, Neisseria meningitidis
MRKKLTALVLSALPLAAVADVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22074 - protein, 1109 aa, Neisseria meningitidis
MRKKLLRFLRLAPLALLFASTASAQTTGTILGVVTDASTGKPVAGAVIIATSPSLQGEQTAVTDNNGSFRLPQLPPGDYKLAVQLDGYKPAERSDITVRLDKTIRANLAVVPEAVQMEEQVVRTGAAPVINIGAAESGAVISREFVASVPVGRTVEAVSATVPTASVDQYGVGFAGSQSPENAYILDGMNVTDPVYGTFGGNPTAQNPQTTLITNFIQEVDVKTGGFMPEYGRATGGVLNMVAKSGSNEFHGSVFGNLTPRFLFQPTGRTAGAAGEAVAWRFKPDEGSYDLDLGFEIGGPIQKDKLWFYAGFAPVITKRNTERFLRSNVLGDVGTGNCAVEDPLELGRCIDSNGNFVQNTIPGTSEIIESGRSTYQFTGKLTYLLNENNNFTLSGFGLPSTEKRYAMNGAEQRRTIESTDNIFDVIGRYSGKFLDKRLITEVVAGWHGSTSVDDPSSFQASNSAIEWYDNLPLSGFEGDRPGVDAACNTADPLASCTVFGYLTGGSGFLNDSAANRLAGRVNATYLFDAFGSHATKGGLDVERSTYGITKRYGGGAYFRAVPNATGTDASLRVFRGYGVVNNGTPSDTFGVIAEPGALIGPDGINQFESIETNSQTTSTALYLQDSWQLPIQNVTLNYGLRWEMQDMSNRDNPEDNGFTISNNWAPRVQAIWDFTGNGRGKLAGSWGRFYYMMPLDMGDRAFGLEDNLRYRLTASTCGNWAQSGAVGNYAAFDATQVGLGRSTCEIETRTAAGETFDAFQSGGFTPVDPNLDATYVDQFGGQLEYEVLSDLSLGLEYQGRRQGATIEDMSSDDGVHYYIGNPGTGSPFTIDGVTYDPVNVTTFDVMTGREVNVKFPEPERSYDAITVFGRKNFSQNWQAFASYTYSYLRGNLAGPYREEDGQIDPGITSEYDLASLMANKHGRLPGDRPHQVKLYGSYTFNFGPRFNLTTGAGYTGTSGNPVNALGADGGAGDYGEGQAFILPRGMAGRSPFLHNVDLKGSLSYVITPPYALQFSVDVFNVFNTEEVRLTDENYTFDAVQPIVGLNCDTSAGGSSNPVAKLQADCSDVRYLKTVDGRPVSVNPNWGKAAPGVNSFQAPLSLRFGVALSF

SEQ ID NO: 22075 - protein, 379 aa, Neisseria meningitidis
MRKKLTALVLSALPLAAVADVSLYGEIKAGVEGNNIQLQLTEPPSKGQVGNKVTKGKSRIRTKINDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22076 - protein, 377 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGNRQLHSN

SEQ ID NO: 22077 - protein, 300 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTK

SEQ ID NO: 22078 - protein, 383 aa, Neisseria meningitidis
MRKKLTALVLSALPLAAVADVSLYGEIKAGVEGRNIQLQLTEPLQNIQKPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22079 - protein, 381 aa, Neisseria meningitidis
MRKKLTALVLSALPLAAVADVSLYGEIKAGVEGRNIQLQLTEQPSKAQGQTNNQVKVTKAKSRIRTKISDFGSFIGFKGSEDLGDELKAVWQLEQDVSVAGGGATRWGNRESFVGLAGEFGTLRAGRVANQFDDASQAIDPWDSNNDVASQLGIFKRHDDMPVSVRYDSPDFSGFSGSVQFVPIQNSKSAYKPAYVDEKKKMVHAAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22080 - protein, 381 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAA

SEQ ID NO: 22081 - protein, 390 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMSVSVRYDSPEFSGFSGSVQFVPAQNSKSAYTPAHFVPDKKGQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22082 - protein, 386 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNKQNQPPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22083 - protein, 356 aa, Chlamydia pneumoniae
MKDLGTLGGTSSTAKTVSPDGKVIMGRSQIADGSWHAFMCHTDFSSNNVLFDLDNTYKTLRENGRQLNSIFNLQNMMLQRASDHEFTEFGRSNIALGAGLYVNALQNLPSNLAAQYFGIAYKIRPKYRLGVFLDHNFSSHVPNNFNVSHNRLWMGAFIGWQDSDALGSSVKVSFGYGKQKATITREQLENTEAGSGESHFEGVAAQIEGRYGKSLGGHVRVQPFLGLQFVHITRKEYTENAVQFPVHYDPIDYSTGVVYLGIGSHIALVDSLHVGTRMGMEQNFAAHTDRFSGSIASIGNFVFEKLDVTHTRAFAEMRVNYELPYLQSLNLILRVNQQPLQGVMGFSSDLRYALGF

SEQ ID NO: 22084 - protein, 729 aa, Chlamydia pneumoniae
MLRISISSPQIKGSFPLSLLSLMILNIQGANAEELIEFSSKAAATMPTIKIEAMSELDPIKSYIDYDKANVTRNGLDKKDIPQTIDTIDVQKYKIYGSNDLSVMLQGTPGVSTSYDMRGDGITIRGFGADTGDIYRDGIRESGQVRRSTANIERIEILKGPASVLYGRSAGGGVVNMVSKFANFDSKSSVGAYTGSYDNYGTTADINQVLNDNLAVRLTGEYGEAGSFRSGIENKIEMFSPSFTYKNDDGKLTWTTQYTYDKLGRVPDRGPTRDNLPAGTSIKMGFAQDGDYVDDILQVVRSDVNYEYAPDWNFHWAASYRQAEQNFDHFYFGNYCGLDEKNSKNEACTKKGYIDQIYYWQQTSNKTTTNTFDIKGKFKTGQLEHQIMVGTDWTYEQREPRLANKTQNGSAIYGYVNPITGEREYSRGNGPLKISQHNYNEGTTYGVFIQDLIGLNDQLKLMMGLRYDYFDFSTTNKIKNELRNVKDSTFSPNVGLVWQPVPEHSFYTSYSKSFAPFGGQMGVNQVTGSTDVAKMDKEPQYNEQYEVGVKSEWFDNRLNTQFSVFDIRKNNIRYKPNPNSEPEVWATAGQHQSRGLEFSFIGRVLDNVFVRGGYGYTDAKVKEDKQNPEREGNYLANTSKNTGNLFVRYLPTEQWYTEVGVTYVGSYYPNINNQVKMEGFNRVDAAIGYSADPWNVTLAVNNLTNKEYWRSDSMPGTPRNVLLRLNYQF

SEQ ID NO: 22085 - protein, 387 aa, Chlamydia pneumoniae
MGTRVADRFARGHRPRHLEQRSGDQMVKHAVATLLGALAAAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 22086 - protein, 1430 aa, Neisseria meningitidis serogroup B
MRFTHTTPFCSVLSTLGLFAVSPAYSSIVRNDVDYQYFRDFAENKGAFTVGASNISIQDKQGKILGRVLNGIPMPDFRVSNRQTAIATLVHPQYVNSVKHNVGYGSIQFGNDTQNPEEQAYTYRLVSRNPHPDYDYHLPRLNKLVTEISPTALSSVPLLGNGQPKANAYLDTDRFPYFVRLGSGTQQVRKADGTRTRTAPAYQYLTGGTPLKVLGFQNHGLLVGGSLTDQPLNTYAIAGDSGSPLFAFDKHENRWVLAGVLSTYAGFDNFFNKYIVTQPEFIRSTIRQYETRLDVGLTTNELIWRDNGNGNSTLQGLNERITLPIANPSLAPQNDSRHMPSEDAGKTLILSSRFDNKTLMLADNINQGAGALQFDSNFTVVGKNHTWQGAGVIVADGKRVFWQVSNPKGDRLSKLGAGTLIANGQGINQGDISIGEGTVVLAQKAASDGSKQAFNQVGITSGRGTAVLADSQQIKPENLYFGFRGGRLDLNGNNLAFTHIRHADGGAQIVNHNPDQAATLTLTGNPVLSPEHVEWVQWGNRPQGNAAVYEYINPHRNRRTDYFILKPGGNPREFFPLNMKNSTSWQFIGNNRQQAAEQVAQAENARPDLITFGGYLGENAQTGKAAPSYSKTNEAAIEKTRHIANAAVYGRPEYRYNGALNLHYRPKRTDSTLLLNGGMNLNGEVLIEGGNMIVSGRPVPHAYDHQAKREPVLENEWTDGSFKAARFTLRNHARLTAGRNTAHLDGDITAYDLSGIDLGFTQGKTPECYRSYHSGSTHCTPNAVLKAENYRALPATQVRGDITLNDRSELRLGKAHLYGSIRAGKDTAVRMEADSNWTLSQSSHTGALTLDGAQITLNPDFANNTHNNRFNTLTVNGTLDGFGTFRFLTGIVRKQNAPLKLEGDSRGAFQIHVKNTGQEPQTTESLALVSLNPKHSHQARFTLQNGYADLGAYRYILRKNNNGYSLYNPLKEAELQIEATRAEHERNQQAYNQLQATDISRQVQHDSDATRQALQAWQNSQTELARIDSQVQYLSAQLKQTDPLTGILTRAQNLCAAQGYSVDICRQVAKAADTNDLTLFETELDTYIERVEMAESELDKARQGGDAQAVETARHAYLNALNRLSRQIHSLKTGVAGIRMPNLAELISRSANTAVSEQAAYNTGRQQAGRRIDRHLTDPQQQNIWLETGTQQTDYHSGTHRPYQQTTNYAHIGIQTGITDRLSVGTILTDERTNNRFDEGVSARNRSNGAHLFVKGENGALFAAADLGYSNSRTRFTDYDGAAVRRHAWDAGINTGIKIDTGINLRPYAGIHINRSNGNRYVLDGAEINSPAQIQTTWHAGIRLDKTVELGQAKLTPAFSSDYYHTRQNSGSALSVNDRTLLQQAAHGTLHTLQIDAGYKGWNAKLHAAYGKDSNTARHKQAGIKIGYNW

SEQ ID NO: 22087 - protein, 720 aa, Neisseria meningitidis serogroup B
MNTPLFRLSLLSLTLAAGFAHAAENNAKVVLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIIAKTVDAQDLLKGLDKNWGVRLNSGFASNEGVSYGASVFGKEGNFDGLFSYNRNDEKDYEAGKGFRNVNGGKTVPYSALDKRSYLAKIGTTFGDDDHRIVLSHMKDQHRGIRTVREEFTVGDKSSRINIDRQAPAYRETTQSNTNLAYTGKNLGFVEKLDANAYVLEKERYSADDSGTGYAGNVKGPNHTRITTRGANFNFDSRLAEQTLLKYGINYRHQEIKPQAFLNSKFSIPTTEEKNGQKVDKPMEQQMKDRADEDTVHAYKLSNPTKTDTGVYVEAIHDIGDFTLTGGLRYDRFKVKTHDGKTVSSSNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKATGSILAAGQKDRKGNLENVVRKGFGVNDVFANWKPLGKDTLNVNLSVNNVFNKFYYPHSQRWTNTLPGVGRDVRLGVNYKF

SEQ ID NO: 22088 - protein, 1457 aa, Neisseria meningitidis serogroup B
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDAHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGSLSANGDTRYTVSHYATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHNAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 22089 - protein, 1067 aa, Neisseria meningitidis serogroup B
MRTTPTFPTKTFKPAAMALAVATTLSACLGGGGGTSAPDFNAGGTGIGSNSRATTAKSAAVSYAGIKNEMCKDRSMLCAGRDDVAVTDRDAKINAPPPNLHTGDFTNPNDAYKNLINLKPAIEAGYTGRGVEVGIVDTGESVGSISFPELYGRKEHGYNENYKNYTAYMRKEAPEDGGGKDIKASFDDEAVIETEAKPTDIRHVKEIGHIDVVSHIIGGRSVDGRPAGGIAPDATLHIMNTHDGTKNEIMSAAIRNAWVKLGERGVRIVNNSFGTTSRAGTADHFQIANSEEQYRQALLAYSGGDKTDEGIRLMQQSDYGNLSYHIRNKNMLFIFSASNDAQAQPNTLTLLPFYEKDAQKGIITVAGVDRSGEKFNGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDRSGANETVHIKGDLQLGGEGTLYTRLGKLLKVDGTAMTGGKLYMSARGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 22090 - protein, 725 aa, Neisseria meningitidis serogroup B
MTRFKYSLLFAALLPVYAQADVSVSDDPKPQESTELPTITVTADRTASSNDGYTVSGTHTPLGLPMTLREIPQSVSVITSQQMRDQNIKALDRALLQATGTSRQIYGSDRAGYNYLFARGSRIANYQINGIPVADALADTGNANTAAYERVEVVRGVAGLLDGTGEPSATVNLVRKRPTRKPLFEVRAEAGNRKHFGLGADVSGSLNTEGTLRGRLVSTFGRGDSWRQRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYSRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQGETHTDPATLRIPNPAAKARAAANSRQKAYAVADIMARYRFNPRAELSLNVDNLFNKHYRTQPDRHSYGALRTVNAAFTYRFK

SEQ ID NO: 22091 - protein, 722 aa, Neisseria meningitidis serogroup B
MGQFMSVFRINMTAATVLAALSSSVFAAQTADLETVHIKGQRSYNAIATEKNGDYSSFAATVGTKIPASLREIPQSVSIITNQQVKDRNVDTFDQLARKTPGLRVLSNDDGRSSVYARGYEYSEYNIDGLPAQMQSINGTLPNLFAFDRVEVMRGPSGLFDSSGEMGGIVNLVCKRPAKAFQGHAAAGFGTHKQYKAEADVSGSLNSDGSVRGRVMAQTVGASPRPAEKNNRHETFYAAADWDINPDTVLGAGYLYQQRHLAPYNGLPADANNKLPSLPQHVFVGADWNKFKMNSHDVFADLKHYFGNGGYGKVGMRYSDRDADSNYAFAGSKLGMKTLAGRPGCNTADDKACAVGLGTEIKQKALAFDASYSRPFRLGNTANEFVIGADYNRFRSTNEQGRTTLYARGGLALNEFRSIPQVDLIANARKGVRGYSHTVATENLDEFGIYGKSTFHPADGLSLIGGGRLGHYKIELGEGKTLHKASKTKFTGYAGAVYDLNDNNSLYLSLSQLYTPQTNLDADGKLLKPRQGNQFEVGYKGSYMDDRLNARVSFYRMKDKNAAAPLNPNNKKTRYAALGKRVMEGVETEISGAVTPKWQIHAGYSYLHSQIKTASNSRDDGIFLLMPKHSANLWTTYQVTPELTIGGGVNAMSGITSSAGMHAGGYATFDAMAAYRFTPKLKLQINADNIFNRHYYARVGGANTFNIPGSERSLTANLRYSF

SEQ ID NO: 22092 - protein, 792 aa, Neisseria meningitidis serogroup B
MKPLQMLPIAALVGSIFGNPVFAADEAATETTPVKAEVKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIDIVKGADSFNTGSGALGGGVNYQTLQGRDLLLPERQFGVMMKNGYSTRNREWTNTLGFGVSNDRVDAALLYSQRRGHETESAGKRGYPVEGAGSGANIRGSARGIPDPSQHKYHSFLGKIAYQINDNHRIGASLNGQQGHNYTVEESYNLLASYWREADDVNRRRNTNLFYEWTPESDRLSMVKADVDYQKTKVSAVNYKGSFPIEDSSTLTRNYNQKDLDEIYNRSMDTRFKRITLRLDSHPLQLGGGRHRLSFKTFASRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERTTTHTLSLQGRSEKGTLDANLYQSNYRNFLSEEQKLTTSGDVSCTQMNYYYGMCSNPYSEKLEWQMQNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNVFNRKYTTWDSLRGLYSYSTTNSVDRDGKGLDRYRAPSRNYAVSLEWKF

SEQ ID NO: 22093 - protein, 1818 aa, Neisseria meningitidis serogroup B
MKTKRFKINAISLSIFLAYALTPYSEAALVRDDVDYQIFRDFAENKGKFFVGATDLSVKNKQGQNIGNALSNVPMIDFSVADVNKRIATVVDPQYAVSVKHAKAEVHTFYYGQYNGHNDVADKENEYRVVEQNNYKPHKAWNASNLGRLEDYNMARFNKFVTEVAPIAPTDAGGGLDTYKDKNRFSSFVRVGAGRQLVYEKGAYHPEGKEKGYDLRDLSQAYRYAIAGTPYKDINIDQTMNTEGLIGFGNHNKQYSAEELKQALSQDALTNYGVLGDSGSPLFAFDKQKNQWVFLGTYDYWADYGKKSWQEWNIYKKEFADEIKQRDNAGTIKGYGEHHWKTTGTNSHIGSTAVRLAGNERGANNGQNVTFENNGTLVLDQNINQGAGGLFFKGDYTVKGINNDITWLGAGIDVADGKKVVWQVKNPNGDRLAKIGKGTLEINGTGVNQGQLKVGDGTVILNQKADSNQKVQAFSQVGIVSGRGTLVLNSPNQINPDNLYFGFRGGRLDANGNDLTFEHIRNVDEGARIVNHNTGHTSTITLTGKSLITNPNSLSVHSIQNDYDEDDYSYYYRPRRPIPQGKDLYYKNYRYYALKSGGSVNAPMPENGQTENNDWILMGSTQEEAKKNAMNHKNNQRISGFSGFFGEENGKGHNGALNLNFNGKSAQNRFLLTGGTNLNGKISVTQGNVLLSGRPTPHARDFVNKSSARKDAHFSKNNEVVFEDDWINRTFKATEIAVNQSASFSSGRNVSDITANITATDNAKVNLGYKNGDEVCVRSDYTGYVTCNTDNLSDKALNSFGATQINGNVNLSQNAALTLGKAALWGQIQGQGNSRVSLNQHSKWHLTGDSQVHNLSLADSHIHLNNASDAQSANKYHTLKINHLSGNGHFHYLTHLAKNLGDKVLVKESASGHYQLHVQDKTGEPNQEGLNLFDASSVRDRSHLSVSLANNHVDLGALRYTIKTENGITRLYNPYAENRRRVKPAPSPATNTASQAQTDSAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARRHEKEREAAELSAKQRVGEEERRQTAQSQPQRRKRRAAPQDYMAASQDRPKRRGHRSVQQNNVEIAQAQAELARRQQEERKAAELLAKQRAEAEREAQALAARRKAEAEEAKRQAAELAHRQEAERKAAELSANQKAAAEAQALAARQQKALARQQEEARKAAELAVKQKAETERKTAELAKQRAAAEAAKRQQEARQTAELARRQEAERQAAELSAKQKAETDREAAESAKRKAEEEEHRQAAQSQPQRRKRRAAPQDYMAASQNRPKRRGRRSTLPAPPSPSFDSSAYAAPRALHNPDWYENDYEEIPLDALEDENVSESVDTSDKQPQDNTELHEKYENDYEEIPLDALEDEDVSESVDTSDKQPQDNTELHEKVETVSLQPRAAQPRAQAAAQPQAQADAVSTNTNSALSDAMASTQSILLDTGASLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPSAGIRYSRLSSADYKLGNDSVKVSSMSVKTLTAGLDFAYRFKVGNLTVKPLLSAAYFANYGKGGVNVGGNSFAYKADNQQQYSAGAALLYRNVTLNVNGSITKGKQLEKQKSGQIKIQIRF

SEQ ID NO: 22094 - protein, 156 aa, Chlamydia pneumoniae
MSIVLPLTGRSSRRHNLIDNNGRRLARSVLTFIFFKPLVEAMKTFFRTVLFGSLMAVCANSYALSESEAEDMADLTAVFVFLKNDCGYQNLPNGQIRRALVFFAQQNQWDLSNYDTFDMKALGEDSYRDLSGIGIPVAKKCKALARDSLSLLAYVK

SEQ ID NO: 22095 - protein, 451 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVAASITGTSMQTTKYGSASQRNVVPGDFVPNLYFVAPVNDKFALGAGMNVNFGLKSEYDDSYDAGVFGGKTDLSAINLNLSGAYRVTEGLSLGLGVNAVYAKAQIERNAGIIADSVKDGQAQTALKAVVPGTTIPDYLTSKDKSVVSLQDRAAWGFGWNAGVMYQFNEGNRIGLAYHSKVDIDFTDRTATSLGKKGIEAGKTGDLTLTLPDYLELSGFHQLTDKLAVHYSYKYTHWSRLTKLHASYEDGKKAFDKELQYSNNSRVALGASYNLDEKLTLRAGIAYDQAASRHQRSAAIPDTDRTWYSLGATYKFTPNLSVDLGYAYLKGKRVHFKEVQKVADGNLTTTANYTSQAHANLYGLNLNYSF

SEQ ID NO: 22096 - protein, 163 aa, Wolbachia sp. wPap
SYYVRLQYNGEFLPLFTKVDDITYKKDKSDYSPLKPSLIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGA

SEQ ID NO: 22097 - protein, 191 aa, Wolbachia sp. wWhi
SYYVRLQYNGEILPLFTKIDGIKNVAGKEKDSPLKASFIAGGGAFGYKMDDIRVDVEGLYSQLNKDAGVAGTTVADNLTAISGLVNVYYDIAIEDMPITPYVGVGVGAAYVSTPLKTAINNQNSKFGFAGQVKAGVSYDVTPEIKLYAGARYFGSYSAHFDGEKADPKDATKKVADKGAYKVLYSTVGAEA

SEQ ID NO: 22098 - protein, 459 aa, Haemophilus influenzae
MKKFNQSLLATAMLLAAGGANAAAFQLAEVSTSGLGRAYAGEAAIADNASVVATNPALMSLFKTAQFSTGGVYIDSRINMNGDVNSDAIITSTSNGVKTIKHGSASQRNVIPGAFVPNLYFVAPVNDKFALGAGMNVNFGLKSEYDDSYDAGIFGGKTDLSAINLNLSGAYRVTEGLSLGLGVNAVYAKAQVERNAGIIVDSLKDNQVQTALSVQKEPLKYLHKYLPSKDTSVVSLQDRAAWGFGWNAGVMYQFNEANRIGLAYHSKVDIDFADRTATSVEADVIKAGKKGDLTLTLPDYLELSGFHQLTDKLAVHYSYKYTHWSRLTKLNASFEDGKKAFDKELQYSNNSRIALGASYNLYEKLTLRAGIAYDQAASRHQRSAAIPDTDRTWYSLGATYKFTPNLSVDLGYAYLKGKKVHFKEVKTIGDERSLALNTTANYTSQAHANLYGLNLNYSF

SEQ ID NO: 22099 - protein, 378 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDAWTRVAFAGLKFADAGSFDYGRNYGVTYDVTSWTDVLPEFGGDTYGADNFMQQRGNGYATYRNTDFFGLVDGLDFALQYQGKNGSVSGENTSGRSLLNQNGDGYGGSLTYAIGEGFSVGGAITTSKRTADQNNTANAHLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 22100 - protein, 360 aa, Salmonella enterica
MMKRKILAAVIPALLAAATANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADGSADLAKYIQAGATYYFNKNMNVWVDYRFNLLDENDYSSSYVGTDDQAAVGIV

SEQ ID NO: 22101 - protein, 218 aa, Neisseria subflava
LFSLAFCQLFDRDKDYMISKNRTHVYAGSLFFEHFHMLHPQTYLTQARAKIPSSFLSKLPENVPVIFNILFSYSHAENDMKTRYTQRYAPKNIIYPEVKGSWATNCFAGEISGSLPIELSDSYVLDKFVPFLKAQMIYGEQESFQEPTSEGRAFESSHLLNLSLPIGVKFESVFGNDQDTFDLMLAYSPDVFRVNPHCTTSLVVTGAAWETKAAPLAR

SEQ ID NO: 22102 - protein, 237 aa, Neisseria lactamica
LFSSLLFSSAAQAASEDNGRGPYVQADLTYASELISRDYPKATDTKFDKNIHTHSIHPRVSVGYDFGGWRIAADYARYRKWYNNKNSVQIKEINNVPPNRKDLKTENQENGTFHAISSLGLSAVYDFDTGSRFKPYAGVRVSYGHVRHSIDSTKKTTEVVTTAGSNGAADTVLPGASTQNAYHESHSIRRVGFGAVAGVGIDITPNLTLDTGYRYHYWGHLENTRFKTHEASLGMRY

SEQ ID NO: 22103 - protein, 279 aa, Neisseria lactamica
FFFFFIFPLVRERGFGRRAEGCWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRIRYAHGFDLIERGKKGENTSYDQVCL

SEQ ID NO: 22104 - protein, 232 aa, Neisseria lactamica
LFSSLLFSSAAQAASEDNGRGPYVQADLNYAYEHITHDYPADNAKVFDDYRDIKTRSTHPRLSVGYDFGNWRIALDYARYNKWKHGKHIRTEQNKSVQNGTSVKLIADHTDKGTFKAESNYGISAIYDFDTGTRFKPYAGVRVGLGKIRHSIALEDKAEIIIGNIPNGGLKDVHPPVHESHSIRRVGFGAVAGVGIDITPKLTLDTGYRYHYWGHLENTRFKTHEASLGMRY

SEQ ID NO: 22105 - protein, 232 aa, Neisseria lactamica
LFSSLLFSSAAQAANEDNGRGPYVQADLTYAYEHITHDYPADNAKLFDDYRDIKTHSTHPRLSVGYDFGNWRIALDYARYNTWEHGKHIHAEQTKTYANGAVTAKIEADNTDKGTFKAESGYGISAIYDFDTGTRFKPYAGVRVGLGKIRHSISLEGTKTTTINNIVRGPEKAYEPIHESRSIRRVGFGAVAGVGIDITPNLTLDTGYRYHYWGHLENTRFKTHEASLGMRY

SEQ ID NO: 22106 - protein, 232 aa, Neisseria lactamica
LFSSLLFSSAVQAANEDNGRGPYVQADLTYAYEHITHDYPGNNAKLFDDYRDVKTRSTHPRLSVGYDFGNWRIALDYARYNKWKHGKHIRTEQNKSVQNGTSVKLIADHTDKGTFKAESNYGISAIYDFDTGTRFKPYVGARVGLGKIRHSIALEDKAEIIIGNIPSGGLKDAHPPIHESHSIRRVGFGAVAGVGIDITPNLTLDTGYRYHYWGRLENTRFKTHEASLGMRY

SEQ ID NO: 22107 - protein, 241 aa, Neisseria lactamica
LFSSLLFSSAAQAASVDNGRGPYVQADLTYAAERITHNYPEATGADKGKISTVSDYFKNIRTHSVQPRLSLGYDFGNWRIAADYTRYRKWNENNSSTKKVTERINDNNKETKTEHQENGSFHAASSLGLSAIYDFQISDKFKPYIGARVAYGHVRHQVNSVNKETITVTPMGGGSIIQGPTSKPAYHESHSIRRLGLGVIAGVGFDITSNLTLDAGYRYYNWGRLENTRFKTHEASLGMRY

SEQ ID NO: 22108 - protein, 180 aa, Wolbachia endosymbiont
PLNTKVDGIIGAQKDSKDTNDLYKPSFMSGGGAFGYKMDDIRVDIEGLYSQLGKDTLSRTPTPDIVDDLTAISGLVNVYYDIAIEDMPIIPYISVGLGAAYVSNPAKTQVIADQKRGFGFAYQAKAGVSYNVTPEIKLFAGARYFGSYGASFDKSETVNKKASDDKKIEDKETKVTVGAY

SEQ ID NO: 22109 - protein, 203 aa, Wolbachia endosymbiont
PFGPISDEETSYYVRLQYNGEILPLFTKIEGIEYKKATDIHNPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 22110 - protein, 171 aa, Wolbachia endosymbiont
PFKTEIDGVTGAKKKNADTNVTTDLYKASFMAGGSAFGYKMDDIRVDIEGLYSQLSRDTFETAPAPAIADNLNALSGLVNVYYDVVIEDMPVIPYVGIGVGAAYLSNPLAIKVTGDKEYGFGFAYQAKAGVSYDVTPEVKLFAGARYFGSYGAKFDKPVVESGQQPTKDGI

SEQ ID NO: 22111 - protein, 185 aa, Wolbachia endosymbiont
PLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLETAVNDQKSKFGFAGQVKAGVSYDVTPEVKLYAGARYFGSYGANFDGKKTGPQDSTRQVTGAGAYKVLYSTVGAEAGV

SEQ ID NO: 22112 - protein, 204 aa, Wolbachia endosymbiont
FGPISDEETSYYVRLQYNGEILPLFTNIDGATGAKKKTADTGTTTDLYKASFMAGGGAFGYKMDDIRVDIEGLYSQLNKDTLDVAPNPAIADSLTAFSGLVNVYYDIAIEDMPITPYVGVGVGAAYVSNPLATKANGDKASGFGVAYQAKAGVSYDVTPEIKLYAGARYFGSYGANFGKANKDDAGIKVLYSTVGAEAGVAFNF

SEQ ID NO: 22113 - protein, 175 aa, Wolbachia endosymbiont
PLNTKVDGITGAQKDSKDTNDLYKPSFMAGGSAFGYRMDDIRVDIEGLYSQLSKGALSRVPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAY

SEQ ID NO: 22114 - protein, 228 aa, Wolbachia endosymbiont
MHYKKFFSAAALVTLLSLSNSAFSSDPIGPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 22115 - protein, 323 aa, Rhodospirillum rubrum
MKKVLFATTALVATAGVAAADVTFGGYGRFGVLYQENAAGTDETNVTSRFRLQIDATAESDMGVTFGARARIQQNNTDENVSVTKGADGIFGTADDGLTTAGPAGTGINGVRFFARTGGFEVGVGNIYGALESMPGMYEIDLGLTGLSYEYTAYNFRGDAYSSGGNGAAGSNGVEALYSMGDLKVHISASDTNDRVAGYVAYTFNGFTFAAAAQDSNAAGDTDYALSVVGNVGPAKVSFAYADNGDDTGVGTVNGDHYALTASFDIGAATNLDVYVADADYFAETSYGIGAHHDLGGGVSLRGGVISKGDDTIRADMGVRFTF

SEQ ID NO: 22116 - protein, 364 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRAAGINTDDIVALGLVYQF

SEQ ID NO: 22117 - protein, 708 aa, Pseudomonas brassicacearum
MKVAWAAATVAALGGGVLVPGVAQAQTAEPDPHGRTGIEEIVITASPFGQRRFDVLQGTSVLAGEALERALSASIGETLDRLPGVSQTAFGQGASRPVIRGLGGDRVRVLVGGIGTIDASSTSPDHAPAVDLATAQRVEVVRGPAALLYGSNAIGGVVNVLDGRVPMARPEGGTSALARLGYGSNANERLAAAGVDQALGDTLVLHADGYYRKADDFEVDGHAWSAARRAEEAAEHAGHDHEIDQGPVGTVDNSDLEQKGGTLGLSAVGDWGFLGASVGRTDSRYGIPGGHSHGHAEGEDHDHDHDHGHDHGEEENVHIDLEQTRLDVIGEIDRDFLVFDSARLRFGWADYKHTELEGDEVGTVFKNKGWEGRVELVQRPIQGVLGGSLDGASGVQALRRDFRADGEEAFVPPSVTEQYGLFTAQRLDIGPWALEAGARIERQSVEASGIGFDRDFTGLSLSGGAAYRFADGWLLGASLSRTERAPNAEELLSDGPHLATGIYEVGDRTLDEETAVGVEATLKKTGGPVTGAINIYRTDFDGFIYEAFTGAEEDGLPVAQYSAADARFWGFEVELGTAVWRSGDQAVLLDASAEYVRTRNKDLDEPLPRIPPLQLRGGVSYETPVFAARAEVVWADDQDRTASFEVPTDGYTVLNASLDWHPFADRDISLLLEARNLTDEEVRLSTSFLKDRVPQPGRDFRVLLRGAF

SEQ ID NO: 22118 - protein, 205 aa, Plectonema boryanum
IRFGPISDEETIYYIRLQYNGEFLPLFTKVDGIEYKKGTESHNPLKASFIAGGGAFGYKMDDIRVDVEGVYSYLNKNDVTGATFTPTDAIADSLTAISGLVNVYYDIAIEDMPITPYIGAGIGAAYLSTPLKTAVNGQNSKFGFAGQVKAGISYDVTPEVKFYAGARYFGSYGANFDTSTGGKGKGGHTVLYSTVGAEAGVAFNF

SEQ ID NO: 22119 - protein, 355 aa, Aeromonas hydrophila
MKKTILAIAIPALFASAANAAVVYDKDGTTFDVYGRVQANYYGDHNTADSTAASGYKDVDGELVGSSRLGWSGKIALNNTWSGIAKTEWQVSAENSANKFDSRHIYVGFDGTQYGKIIFGQTDTAFYDVLEPTDIFNEWGDAGNFYDGRQEGQVIYSNTYGGFKGKLSYQTNDDKAVKVTDVGQGIKETAVYGADVKRNYGYAAAAGYDFDFGLGLNAGYSYSDLENTKTNNTGDKKEWALGAHYAINGFYFAGVYTQGDLSYDNTTGGDKDKGRGYELAASYNVDAWTFLAGYNFKEAKVNSNTAGAEYKDLLDETLLGVQYAFTSKLKAYTEYKIQGIDKLDDEWTVALQYNF

SEQ ID NO: 22120 - protein, 394 aa, Bartonella quintana
MNIKRAVFALNPVCACVALLGAGVSMQAVAQSSVTLYGVVDTAMAYSSNQGGHSNTYMSQGNLLASKFGLYGTEDLGGGTQALFRLESGFNSATGAQSAAGYIFNRQAFVGLSNKDYGMLTAGRQYTPYFQYVAALGPTNVLTGATGAHPGDVDALDTTLRFNNSLTYTLPKIGGLQASVQYGMGEQPGSISGGSSFSGAVRYDYQAFAWSAGYIHLKNISTSNSIGTFANNAPINSGYASADSAQMIATAARYTFDKLMVGLNYSNVQYKPGAGSLFTETAMFNTYGLIATYTLTPAVTVAAGYSYTAEKARNGVSSAARYHQFSMEQTYALSKRTAFYALEAYQKASGKTLRTVGGVSTIVDAVASVGDSQNGTPSNTGHQFVGMVGIRHLF

SEQ ID NO: 22121 - protein, 1204 aa, Synechococcus elongatus
MNFFNNAPAVRHSASLFLLRVLTVFMVLTGLSSTIKAQSDNYTFSFKNKPLDQVIAEVAKKSGYEFVFDAAYLKDAKPITAEIAATTIDKVLERVFRGQNFSYEISRKTIILKPKEAVQEVYQVRGKVIDSLGAAIPGAIVRIKGATVGTQTDGEGKFVLNVATGNSTVVFSYMGYTAREFDVSPAISASNISIVLKPAQSLLNEVFVNGFQTISKERAAAAYTIVNNKELNRQINVDLLSALEGRVAGLVYVKNPNGAAADQPVLRGISTMSSEVGTSPLIVIDGLPTEYTLDEVNPYDIESVTVLKDAAAASIYGSRSANGVIVLTTKQGKGSGVQISLNADLFVTGKPDLSKMHYASTSDLIDFETDVYNAERSRYSTISSMFAPYGTLGGSSRKYYSPLYELYRLQELGTVSADEVNNTLTQWRQNDYMNEYSDQVWQNELRQRYNLSLSSNADKNNTYLSLNYDQGKGRVINNINKSLNLNMKSTFKFKSWLTATFGLNGTYANDKATDGDYNNFEIQPRYARILDAQGNRVTADYVGIDDGFTSGGAINGALLAAVANNTNLKSFGFNVLDALDEGITTTKYTKLRTFANIEAKLYKGLSISTQFQYENSSSDAEQYYEANSYKMRYAYNIMTTLNSTTGKYDHALPEGGRYYQFNKSSNNYTFRNQLNFNRGFGKDQNEHYVAAVAGFEMRQTFIPRTLEQLRYGYDPVTLSSTNLDYATLGNAGVATYLGGTRTLGTVGRTQSEIKHRYLSYYSNMSYTYQGKYNLTGSIRVDQADLFGVDPKYKNRPLWSLGGSWNASSEDFLKDLKWLSSLKARLTYGINGNVDQGSSPYLVARRRNDVLYPALQYLDITTLPNPMLRWEKTATTNFGIDYAMFDSRLRGSVDIYNRNSSDLLVTTDLDPTVGATSRVLNNGALRNRGLEWTVSGDWFKTKDWTITSAIVVAFNKNEVMKVNNAATTGYSYIGSPTDYFFQNTPFNSLYAYKYGGMVNGYPYFLNEKGESNVTFDASGTPTAITAINSPDALVRVGQLNPKYNGSFSQRISYKQFELGALLVFSGGNQLRKDVTALDADDVNDEDITRRWNSSGTSDLPRLLLDYPQAWRSSAGTLSSLWQYSDKQVVDADYVKLRNVSLSYSLPKRISRKMNVSAVKLTGQVNNLWYWSAAGDDIDPETYSLNSGTRAYSIPKSFLLGFNITF

SEQ ID NO: 22122 - protein, 459 aa, Haemophilus influenzae
MKKFNQSLLATAMLLAAGGANAAAFQLAEVSTSGLGRAYAGEAAIADNASVVATNPALMSLFKTAQFSTGGVYIDSRINMNGDVTSYAQIITNQIGMKAIKDGSASQRNVVPGAFVPNLYFVAPVNDKFALGAGMNVNFGLKSEYDDSYDAGVFGGKTDLSAINLNLSGAYRVTEGLSLGLGVNAVYAKAQVERNAGLIADSVKDNQITSALSTQQEPFRDLKKYLPSKDKSVVSLQDRAAWGFGWNAGVMYQFNEANRIGLAYHSKVDIDFADRTATSLEANVIKEGKKGNLTFTLPDYLELSGFHQLTDKLAVHYSYKYTHWSRLTKLHASFEDGKKAFDKELQYSNNSRVALGASYNLYEKLTLRAGIAYDQAASRHHRSAAIPDTDRTWYSLGATYKFTPNLSVDLGYAYLKGKKVHFKEVKTIGDKRTLTLNTTANYTSQAHANLYGLNLNYSF

SEQ ID NO: 22123 - protein, 451 aa, Haemophilus influenzae
MKKFNQSLLATAMLLAAGGANAAAFQLAEVSTSGLGRAYAGEAAIADNASVVATNPALMSLFKTAQFSTGGVYVDPRINMNGDVLSSITSASMKTTKYGSASERNVVPGAFVPNLYFVAPVNDKFALGAGMNVNFGLKSEYDDDYDAGVFGGKTDLSAINLNLSGAYRVTEGLSLGLGVNAVYAKAQVERNAGIIVRSVKDSQAQTALKTVVPGTLIPDLLTSKDKSVVSLQDRAAWGLGWNASVMYQFNEANRIGLAYHSKVDIDFTDRTATSLGQKSIEAGKTDNLTLTLPDYLELSGFHQLTDKFAVHYSYKYTHWSRLTRLYASYEDGKKVFDKELQYSNNSRVALGASYNLDEKLTLRAGIAYDQAASRHHRSAAIPDTDRTWYSLGATYKFTPNLSVDLGYAYLKGKKVHFKEVQKVADGLITTNANYTSQAHANLYGLNLNYSF

SEQ ID NO: 22124 - protein, 451 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVKSSTKNLQMLAAKYGSASQRNVVPGAFVPNLYFVAPVNDKFALGAGMNVNFGLKSEYDDSYDAGVFGGKTDLSAINLNLSGAYRVTEGLSLGLGVNAVYAKAQVERNAGIIKESVELAKTAFTVAQDDEKAIPTYLTSKNTSVVSLQDRAAWGFGWNAGVMYQFNEANRIGLAYHSKVDIDFVDRTATSLEAGVIGAGKKGDLTLTLPDYLELSGFHQLTDKLAVHYSYKYTHWSRLTKLNASFEDGKKAFDKELQYSNNSRVALGASYDLYEKLTLRAGIAYDQAASRHQRSAAIPDTDRTWYSLGATYKFTPNLSVDLGYAYLKGKKVHFKEVKTTGKTVILNATADYTSQAHANLYGLNLNYSF

SEQ ID NO: 22125 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTRMNSAKYGSASERNVVPGAFVPNLYFVAPVNDKFALGAGMNVNFGLKSEYDDSYDAGIFGGKTDLTAINLNLSGAYRVTEGLSLGLGVNAVYAKAQVERNAGIIANSVNDTQVQTALSVLAPPLKGLDQNLPSKDKSVVSLQDRAAWGFGWNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVKTIGDKRALTLNTTANYTSQAHANLYGLNLNYSF

SEQ ID NO: 22126 - protein, 450 aa, Haemophilus influenzae
MKKFNQSLLATAMLLAAGGANAAAFQLAEVSTSGLGRAYAGEAAIADNASVVATNPALMSLFKTAQFSTGGVYIDSRINMSGDVDASIKATAMARTKYGSASQRNVVPGAFVPNLYFVAPVNDKFALGAGMNVNFGLKSEYGDSYDAGIFGGKTDLSAINLNLSGAYRVTEGLSLGLGVNAVYANAQIERNAGIIADSIQDNQIQQALKAVDPQTKIHEYLTSKDKSVVSLQDRAAWGFGWNAGVMYQFNEANRIGLAYHSKVDIDFTDRTATSLGKKDIVAGKTGDLTLTLPDYLELSGFHQLTDKLAVHYSYKYTHWSRLTKLYASYENGEKAFDKELQYSNNSRIALGASYNLYEKLTLRAGIAYDQAASRHQRSAAIPDTDRTWYSLGATYKFTPNLSVDLGYAYLKGKKVHFKEVKTIGAHIITNANYTSQAHANLYGLNLNYSF

SEQ ID NO: 22127 - protein, 449 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVAASIKGATMNTTKDGSASERNVVPGAFVPNLYFVAPVNDKLAVGAGMNVNFGLKSKYDDSYDAGVFGGKTDLTAINLNLSGAYRVTEGLSVGLGVNAVYAKAQVERNAGIITESVKIAQNALKTVVPGTPIPDYLTSKNKSVVSLQDRAAWGFGWNAGVMYQFNEGNRIGLAYHSKVDIDFTDRTATSLYANVIKEGKKGNLTLKLPDYLELSGFHQLTDKFAVHYSYKYTHWSRLTKLHASFEDGKKAFDKELQYSNNSRIALGASYNLDEKLTLRAGIAYDQAASRHHRSAAIPDTNRTWYSLGATYKFTPNLSVDLGYAYLKGKKVHFKEAQQAAGGFITTTANYTSQAHANLYGLNLNYSF

SEQ ID NO: 22128 - protein, 449 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVDSSITATTMRTTKYGSASARNVIPGAFVPNLYFVAPVNDKFALGAGMNVNFGLKSKYDDSYDAGVFGGKTDLTAINLNLSGAYRVTEGLSLGLGVNAVYAKAQVERNAGIIAESVKIAQNAIKTVNPKDKATDYLTSKDKSVVSLQDRAAWGFGWNAGVMYQFNEANRIGLAYHSKVDIDFTDRTATSLEAEVIEAGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVQKAVGGFITTTANYTSQAHANLYGLNLNYSF

SEQ ID NO: 22129 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVKCYASITGISVKTTKNGSASARNVIPGAFVPNLYFVAPVNDKLAVGAGMNVNFGLKSKYDDSYNAGVFGGKTDLTAINLNLSGAYRVTEGLSLGLGVNAVYAKAQVERNAGLIVDSVEIARNGQAFTVLGEPLKTIGQYLTSKDKSVVSLQDRAAWGFGWNAGVMYQFNESNRIGLAYHSKVDIDFTDRTATSLGAGVIKAGKKGDLTLTLPDYLELSGFHQLTDKFAVHYSYKYTHWSRLTKLYASYENGKKAFDKELQYSNNSRIALGASYNLDEKLTLRAGIAYDQAASRHHRSAAIPDTDRTWYSLGATYKFTPNLSVDLGYAYLKGKKVHFKEVETISQAQLTLNTTANYTSQAHANLYGLNLNYSF

SEQ ID NO: 22130 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVASSVIISNMVKATQDGSASARNVVPWCFCTKSLFRCARNDKFALGAGMNVNFGLKSEYDDSYDAGIFGGKTDLSAINLNLSGAYRVTEGLSLGLGVNAVYAKAQVERNAGTISDSVNDSQLTGVLSTLAKPFKELNKHLPSKDKSVVSLQDRAAWGFGWNAGVMYQFNEANRIGLAYHSKVDIDFTDRTATSLEAGVIGAGKTGNLTLTLPDYLELSGFHQLTDKLAVHYSYKYTHWSRLTKLHASFEDGKKAFDKELQYSNNSRVALGASYNLYEKLTLRAGIAYDQAASRHQRSAAIPDTDRTWYSLGATYKFTPNLSVDLGYAYLKGKKVHFKEGKTIADKSGLPLTSTANYTSQAHANLYGLNLNYSF

SEQ ID NO: 22131 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVDVRASITGVSVKTTKNGSASQRNVVPGAFVPNLYFVAPVNDKFALGAGMNVSFGLKSEYDDSYDAGVFGGKTDLTAINLNLSGAYRVTQGLSLGLGVNAVYAKAQVKRNAGIIANTVNDNQVKLPLSTQPETLRDLHKHLPSKDKSVVSLQDRAAWGFGWNAGVMYQFNEANRIGLAYHSKVDIDFADRTATSLEAEAIKAGKKGDLTLTLPDYLELSGFHQLTDKLAVHYSYKYTHWSRLTRLYASSENGKKAFDKELQYSNNSRVALGASYNLDEKLTLRAGIAYDQAASRHQRSAAIPDTNRTWYSLGATYKFTPNLSVDLGYAYLKGKKVHFKEVKAITKSVLTLDTTANYTSQAHANLYGLNLNYSF

SEQ ID NO: 22132 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVGVGASITGASVKITRNGSASQRNVVPGGFVPNLYFVAPVNDKFALGAGMNVNFGLKSEYGDSYDAGIFGGKTDLTAINLNLSGAYRVTEGLSLGLGVNAVYAKAQVERNAGLIADTVNDNQIKQALSTQQTTLRDLPKHLTSKDKSVVSLQDRAAWGFGWNAGVMYQFNEGNRIGLAYHSKVDIDFTDRTATSLEAEAIKAGKKGDLTLTLPDYLELSGFHQLTDKLAVHYSYKYTHWSRLTKLHASSENGKKAFDKELQYSNNSRVALGASYNLDEKLTLRAGIAYDQAASRHQRSAAIPDTNRTWYSLGATYKFTPNLSVDLGYAYLKGKKVHFKEVKAISQATLTLDTTANYTSQAHANLYGLNLNYSF

SEQ ID NO: 22133 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVDSYAIISNSIKVTNDGSASARNVVPGAFVPNLYFVAPVNDKFALGAGMNVNFGLKSEYDDSYDAGVFGGKTDLTAINLNLSGAYRVTEGLSLGLGVNAVYAKAQVERNAGLIADTVKDSQVKTTLIVQQEPLKSIDKYLPSKDTSVVSLQDRAAWGFGWNAGVMYQFNEANRIGLAYHSKVDIDFTDRTATSLEAEAIKAGKKGBLTLTLPDYLELSGFHQLTDKLAVHYSYKYTHWSRLTRLYASSENGKKAFDKELQYSNNSRVALGASYNLYEKLTLRAGMAYDQAASRHQRSAAIPDTDRTWYSLGATYKFTPNLSVDLGYAYLKGKKVHFKEVKTIGDARSLALNTTANYTSQAHANLYGLNLNYSF

SEQ ID NO: 22134 - protein, 458 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVNSYATITSASSGVRTIKHGSASQRNVVPGAFVPNLYFVAPVNDKFALGAGMNVNFGLKSEYDDSYDAGVFGGKTDLSAINLNLSGAYRVTEGLSLGLGVNAVYANAQVERNAGIIVETIDNQVNTALSALQEPFRDLKKHLPSKDKSVVSLQDRAAWGFGWNAGVMYQFNEANRIGLAYHSKVDIDFTDRTATSLEANVIKAGKKGDLTFTLPDYLELSGFHQLTDKLAVHYSYKYTHWSRLTKLHASFEDGKKAFEKELQYSNNSRVALGASYNLYEKLTLRAGIAYDQAASRHQRSAAIPDTDRTWYSLGATYKFTPNLSVDLGYAYLKGKKVHFKEVKTIGEPRALTFNTTANYTSQAHANLYGLNLNYSF

SEQ ID NO: 22135 - protein, 456 aa, Haemophilus influenzae
MKKFNQSLLATAMLLAAGGANAAAFQLAEVSTSGLGRAYAGEAAIADNASVVATNPALMSLFKTNQFSVGGVYVDSRINMNGDVDSYAIISDSMKVTNDGSASARNVVPGAFVPNLYFVAPVNDKFALGAGMNVNFGLKSEYDDSYDAGVFGGKTDLTAINLNLSGAYRVTEGLSLGLGVNAVYAKAQVERNAGLIADTVKDNQVKNTLTVQQEPLKFIDKYLPSKDTSVVSLQDRAAWGFGWNAGVMYQFNEANRIGLAYHSKVDIDFTDRTATSLEANVIKASKTGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWDSLGATYKFTPNLSVDLGYAYLKGKKVHFKEVKTIGDKRSLALSTTANYTSQAHANLYGLNLNYSF

SEQ ID NO: 22136 - protein, 451 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGNVDASITGAEMKTTKYGSASERNVVPGAFVPNLYFVAPVNDKFALGAGMNVNFGLKSKYDDSYDAGVFGGKTDLTAINLNLSGAYRVTEGLSLGLGVNAVYAKAQVERNAGIIADSVNDQQAKTALNAVVPQTKIPDHLASKDKSVVSLQDRAAWGFGWNAGVMYQFNEGNRIGLAYHSKVDIDFTDRTATSLGKKGIEVGKTDNLTLTLPDYLELSGFHQLTDKLAVHYSYKYTHWSRLTKLHASFEDGKKAFDKELQYSNNSRVALGASYDLYEKLTLRAGIAYDQAASRHQRSAAIPDTDRTWYSLGATYKFTPNLSVDLGYAYLKGKKVHFKEVQKIADGFITTNANYTSQAHANLYGLNLNYSF

SEQ ID NO: 22137 - protein, 450 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVAASIKATAMGRTKYGSASARNVVPGAFVPNLYFVAPVNDKFALGAGMNVNFGLKSEYDDSYDAGIFGGKTDLSAINLNLSGAYRVTEGLSLGLGVNAVYAKAQVERNAGIIADSIQDNQIQQALKAVDPQTKLHNYLTSKDKSVVSLQDRAAWGFGWNAGVMYQFNEANRIGLAYHSKVDIDFSDRTATSLGAKDIVAGKTGDLTFTLPDYLELSGFHQLTDKLAVHYSYKYTHWSRLTKLHASYENGEKAFDKELQYSNNSRVALGASYNLYEKLTLRAGIAYDQAASRHQRSAAIPDTDRTWYSLGATYKFTPNLSVDLGYAYLKGKKVHFKEEQQAGGHIITTANYTSQAHANLYGLNLNYSF

SEQ ID NO: 22138 - protein, 457 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVASSAIVSQKMKSTKDGSASARNVVPGAFVPNLYFVAPVNDKFALGAGMNVNFGLKSEYDDSYDAGIFGGKTDLSAINLNLSGAYRVTEGLSLGLGVNAVYAKAQVERNAGIIKDTVNDSQITSALTTQPEPLRDIGKNLTSKDKSVVSLQDRAAWGFGWNAGVMYQFNEANRIGLAYHSKVDIDFTDRTATSLEANVIKASKTGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGATYKFTPNLSVDLGYAYLKGKKVHFKEVKEIGAERGTLTVNTTANYTSQAHANLYGLNLNYSF

SEQ ID NO: 22139 - protein, 457 aa, Haemophilus influenzae
MKKFNQSLLATAMLLAAGGANAAAFQLAEVSTSGLGRAYAGEAAIADNASVVATNPALMSLSKTAQFSTGGVYIDSRINMNGDVTSSATPANSVMTAIRYGSASARNVVPGAFVPNLYFVAPVNDKFALGAGMNVNFGLKSEYDDSYNAGIFGGKTDLSAINLNLSGAYRVTEGLSLGLGVNAVYAKAQVERNAGIIEGTVNDDQIKRALTTQPKPYKDFPQHLSSKDKSVVSLQDSAAWGHGWNAGVMYQFNEANRIGLAYHSKVDIDFTDRTATSLEAGVIGAGKKGDLTLTLPDYLELSGFHQLTDKLAVHYSYKYTHWSRLTKLNANFEDGKKAFDKELQYSNNSRVALGASYNLYEKLTLRAGIAYDQAASRHQRSAAIPDTDRTWYSLGATYKFTPNLSVDLGYAYLKGKKVHFKEVKAIGEKRSLTFDTTANYTSQAHANLYGLNLNYSF

SEQ ID NO: 22140 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTKMNSAKYGSASERNVVPGAFVPNLYFVAPVNDKFALGAGMNVNFGLKSEYDDSYDAGIFGGKTDLTAINLNLSGAYRVTEGLSLGLGVNAVYAKAQVERNAGIIANSVNDTQVKTALSVLAPPLRGLDQNLPSKDKSVVSLQDRAAWGFGWNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVKTIGDKRTLTLNTTANYTSQAHANLYGLNLNYSF

SEQ ID NO: 22141 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTKMNSAKYGSASERNVVPGAFVPNLYFVAPVNDKFALGAGMNVNFGLKSEYDDSYDAGVFGGKTDLTAINLNLSGAYRVTEGLSLGLGVNAVYAKAQVERNAGIIANSVKDTQVKTALSVLAPPRTALPQNLPSKDKSVVSLQDRAAWGFGWNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVKTIGDKRALTLNTTANYTSQAHANLYGLNLNYSF

SEQ ID NO: 22142 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTKMNSAKYGSASERNVVPGAFVPNLYFVAPVNDKFALGAGMNVNFGLKSEYDDSYDAGIFGGKTDLTAINLNLSGAYRVTEGLSLGLGVNAVYAKAQVERNAGIIANSVNDTQVKTALSVLAPPLKGLDQNLPSKDKSVVSLQDRAAWGFGWNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVKTIGDKRTLTLNTTANYTSQAHANLYGLNLNYSF

SEQ ID NO: 22143 - protein, 455 aa, Haemophilus influenzae
MKKFNQSILATAMLLAAGGANAAAFQLAEVSTSGLGRAYAGEAAIADNASVVATNPALMSLFKTAQFSTGGVYVDSRINMNGDVTASIATTKMNSAKYGSASERNVVPGAFVPNLYFVAPVNDKFALGAGMNVNFGLKSEYDDSYDAGIFGGKTDLTAIHLNLSGAYRVTEGLSLGLGVNAVYAKAQVERNAGIIANSVNDTQVKTALSVLAPPLKGLDQNLPSKDKSVVSLQDRAAWGFGWNAGVMYQFNEANRIGLAYHSKVDIDFTDRTATSVEANVIKEGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLEGKKVHFKEVKTIGDKRTLTLNTTANYTSQAHANLYGLNLNYSF

SEQ ID NO: 22144 - protein, 449 aa, Haemophilus influenzae
  misc_feature (427)..(427): Xaa can be any naturally occurring amino acid
MKKFNQSILATAMLLAAGGANAAAFQLAEVSTSGLGRAYAGEAAIADNASVVATNPALMSLFKTAQFSTGGVYVDSRINMNGDVNSSITATTMRTTKYGSASARNVIPGAFVPNLYFVAPVNDKFALGAGMNVNFGLKSKYDDSYDAGVFGGKTDLTAINLNLSGAYRVTEGLSLGLGVNAVYAKAQVERNAGIIAESVKIAQNAIKTVNPKDKATDYLTSKDKSVVSLQDRAAWGFGWNAGVMYQFNEANRIGLAYHSKVDIDFTDRTATSLEAEVIEAGKKGNLTLTLPDYLELSGFHQLTDKFAVHYSYKYTHWSRLTKLHASFEDGKKAFDKELQYSNNSRVALGASYNLDEKLTLRAGIAYDQAASRHHRSAAIPDTDRTWYSLGATYKFTPNLSVDLGYAYLKGKKVHFKEVQKAVGGFIXTTANYTSQAHANLYGLNLNYSF

SEQ ID NO: 22145 - protein, 857 aa, Haemophilus influenzae
MKKFNQFLCIAVLTLFSTAIYAQSTVKGKVIDGDMNAPLPGANILEKGTSNGASTNFDGDFSFTTNSSSGEVVISYVGYISQTVAFSGDTDLGTITLKSSDVGLDEIMIVASVAVDRKTPVAVSTVRAADIQLKLGTQEFPEVLKSTPGVYATKSGGGFGDGRINLRGFSSENVAVMINGVPVNDMENGRVFWSNWAGLGDVTSSMQVQRGLGAARVAVPSIGGTINILSKTTDIEQGGNIMTTLGNDGYKKFGVTYSTGLMDSGWAATVSAAKTDGDGYVRGTPFNAVSYFFNVSKEINDQHKISFTAFGAKQRHGQRQNRHTIDTYRRSEDGIKYNSDWGYKNGQLTSIEDNFYHKPQISLNHYWDLNDKTSISTAAYVSFGSGGGGGTLGSDNEAPGFEGDARFKFTSDDYRIGEFGPLDFDRIVDENIANGSNGSSAALRASRNDHNWYGVLSTLKTDLTDNIVLLAGLDYRNYTGIHFREVTDLLGGQFIINEDDVNNPTGVARVGDKVSYHNDGKVGWLGFFTQIEYDINENFNTFVALNASNTSYKRIDYFGYTPDDSLRETDKYNFFGYGAKGGANYRITGNHNVFANLGYFEKAADFDAVFPRFNNEDINEDAENQKIISFELGYGYRGERLSANVNLYRTAWRDRTETIGFQLSEDETGFANILGVNAVHQGIEIDFVYKATDKLNITGMASLGDWRWEDDVTDVQILNEEQEVVDTVNLFIGDTPVGDAAQTTLAIGANYRFGANTRFSVDYNYFDRLYADFDPSDRGLDGAPDPWEVPAYGVFDTAISHSFPFGKFEASLIARMNNVFNTHYIADALDGPGSNAESALVYYGFGRTFSVGATLKF

SEQ ID NO: 22146 - protein, 451 aa, Haemophilus influenzae
MKKFNQSLLATAMLLAAGGANAAAFQLAEVSTSGLGRAYAGEAAIADNASVVATNPALMSLFKTAQFSTGGVYIDSRINMNGDVDAYLQSGSMKFTKYGSASQRNVVPGAFVPNLYFVAPVNDKFALGAGMNVNFGLKSEYDDSYDAGIFGGKTDLSAINLNLSGAYRVTEGLSLGLGVNAVYANAQVERNAGIIADSVQDSQVKPALQAVDPQNKATGYLTSKDKSVVSLQDSAAWGFGWNAGVMYQFNEANRIGLAYHSKVDIDFTDRTATSLEAGAIKAGKKGDLTLTLPDYLELSGFHQLTDKLAVHYSYKYTHWSRLTKLNASFEDGKKAFDKELQYSNNSRVALGASYNLAEKLTLRAGIAYDQAASRHQRSAAIPDTDRTWYSLGATYKFTPNLSVDLGYAYLKGKKVHFKEVQKAAGGHIITTANYTSQAHANLYGLNLNYSF

SEQ ID NO: 22147 - protein, 460 aa, Haemophilus influenzae
MKKFNQSLLATAMLLAAGSANAAAFQLAEVSTSGLGRAYAGEAAIADNASVVATNPALMSLFKTAQFSTGGVYVDSRINMNGDVTSHATIVTSSSGVRAIKDGSASARNVVPGAFVPNLYFVAPVNDKFALGAGMNVNFGLKSEYDDSYDAGIFGGKTDLSAINLNLSGAYRVTEGLSLGLGVNAVYAKAQVERNAGILAESVNDDDQVKGALLTLSEPFKNLNTHLPSKDKSVVSLQDRAAWGFGWNAGVMYQFNEANRIGLAYHSKVDIDFADRTATSLEANVIKAGKKADLTFTLPDYLELSGFHQLTDKLAVHYSYKYTHWSRLTKLHASFEDGKKAFDKELQYSNNSRVALGASYNLYEKLTLRAGIAYDQAASRHQRSAAIPDTDRTWYSLGATYKFTPNLSVDLGYAYLKGKKVHFKEVKTIGEQRSLTFDTTANYTSQAHANLYGLNLNYSF

SEQ ID NO: 22148 - protein, 454 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVDSYAIISNSIKVTNDGSASARNVVPGAFVPNLYFVAPVNDKFALGAGMNVNFGLKSEYDDSYDAGVFGGKTDLSAINLNLSGAYRVTEGLSLGLGVNAVYAKAQVERNAGIIKESVELAKTAFTVAQDDEKAIPTYLTSKNTSVVSLQDRAAWGFGWNAGVMYQFNEANRIGLAYHSKVDIDFTDRTATSLEAEAIKAGKKGDLTLTLPDYLELSGFHQLTDKLAVHYSYKYTHWSRLTRLYASSENGKKAFDKELQYSNNSRVALGASYNLYEKLTLRAGIAYDQAASRHQRSAAIPDTDRTWYSLGATYKFTPNLSVDLGYAYLKGKKVHFKEVKTIGDARSLALNTTANYTSQAHANLYGLNLNYSF

SEQ ID NO: 22149 - protein, 449 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVNASIKATMNMTKYGSASQRNVVPGAFVPNLYFVAPVNDKFALGAGMNVNFGLKSEYDDSYNAGVFGGKTDLSAINLNLSGAYRVTEGLSLGLGVNAVYANAQVERNAGLIADTVQDQQIQKALKAVDSKTVIPDYVTSKDKSVVSLQDRAAWGFGWNAGVMYQFNEANRIGLAYHSKVDIDFADRTATSLEAGVIGAGKKGDLTLTLPDYLELSGFHQLTDKLAVHYSYKYTHWSRLTKLNANFEDGKKAFDKELQYSNNSRVALGASYNLYEKLTLRAGIAYDQAASCHHRSAAIPDTDRTWYSLGATYKFTPNLCVDLGYAYLKGNKVHFKEVQQVGGHIITNANYTSQAHANLYGLNLNYSF

SEQ ID NO: 22150 - protein, 456 aa, Haemophilus influenzae
  misc_feature (280)..(280): Xaa can be any naturally occurring amino acid
MKKFNQSLLATAMLLAAGGANAAAFQLAEVSTSGLGRAYAGEAAIADNASVVATNPALMSLFKTAQFSTGGVYVDSRINMNGDVDSYAIISNSIKVTNDGSASARNVVPGAFVPNLYFVAPVNDKFALGAGMNVNFGLKSEYDDSYDAGVFGGKTDLTAINLNLSGAYRVTEGLSLGLGVNAVYAKAKVERNAGLIADTVKDSQVKNALIVQQEPLKSIDKYLPSKDTSVVSLQDRAAWGFGWNAGVMYQFNEANRIGLAYHSKVDIDFTDRTATSLEAXAIKAGKKGDLTLTLPDYLELSGFHQLTDKLAVHYSYKYTHWSRLTRLYASSENGKKAFDKELQYSNNSRVALGASYNLYEKLTLRAGIAYDQAASRHQRSAAIPDTDRTWYSLGATYKFTPNLSVDLGYAYLKGKKVHFIEVKTIGDARSLALNTTANYTSQAHANLYGLNLNYSF

SEQ ID NO: 22151 - protein, 456 aa, Haemophilus influenzae
MKKFNQSLLATAMLLAAGGANAAAFQLAEVSTSGLGRAYAGEAAIADNASVVATNPALMSLFKTNQFSVGGVYVDSRINMNGDVDSYAIISDSIKVTNDGSASARNVVPGAFVPNLYFVAPVNDKFALGAGMNVNFGLKSEYDDSYDAGVFGGKTDLTAINLNLSGAYRVTEGLSLGLGVNAVYAKAQVERNAGLIADTVKDNQVKNTLTVQQEPLKFIDKYLPSKDTSVVSLQDRAAWGFGWNAGVMYQFNEANRIGLAYHSKVDIDFTDRTATSLEANVIKASKTGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGATYKFTPNLSVDLGYAYLKGKKVHFKEVKTIGDKRSLALSTTANYTSQAHANLYGLNLNYSF

SEQ ID NO: 22152 - protein, 456 aa, Haemophilus influenzae
MKKFNQSLLATAMLLAAGGANAAAFQLAEVSTSGLGRAYAGEAAIADNASVVATNPALMSLFKTNQFSVGGVYVDSRINMNGDVDSYAIISDSIKVTNDGSASARNVVPGAFVPNLYFVAPVNDKFALGAGMNVNFGLKSEYDDSYDAGVFGGKTDLTAINLNLSGAYRVTEGLSLGLGVNAVYAKAQVERNAGLIADTVKDNQVKNTLTVQQEPLKYINKYLPSKDTSVVSLQDRAAWGFGWNAGVMYQFNEANRIGLAYHSKVDIDFTDRTATSLEANVINASKTGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGATYKFTPNLSVDLGYAYLKGKKVHFKEVKTIGDKRSLALSTTANYTSQAHANLYGLNLNYSF

SEQ ID NO: 22153 - protein, 453 aa, Pseudomonas putida
MRVMKWSMIALAVAAASTQVATAAPFVSDQAEAKGFVEDAKFNVLLRNYYFNRDRKDRANDQKDWTQGIWGNLSSGYTQGTVGVGVDAFGYLAIKLDGGDGTGGTGNMSRDSDGDVNKSQGKAGAAVKFRVSKTELKVGDMQPSTSPVFAIGGSRILPQTASGLQLQSSEIKDLDLEGGHFYSGTSQDSNARNGNLYANYAGVASNSIDYLGGKYGITDNLSASLYGAKLEDIWNQYYANLNYTIPMGGDQSLNLDGNIYRTTDTGKAKAGDISNTTFSLAAAFSFLKAHTITVGFQKVNGDTPFDYIGIGGHDSSKRGANRGGDSIFLANSIQYSDFNGPNEKSAQIRYDLKMAEYGIPGLSFMTRYVKGWDIDGTGLAENSRYRDNEGNPLYGKDGKHHETNFEAKYVVQSGPAKDLSFRVRQAWHYANADEGEGDTKEFRLIVDYPLSLL

SEQ ID NO: 22154 - protein, 914 aa, Neisseria gonorrhoeae
MQQQHLFRFNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLAPVDDSSDYAHFIVEGECKNGGYETCKTRPKKDVAGEDKRQTVSTRDYTGPNRFLADPLSYESRSWLFRPGFRFENKRHYIGGILERTQQTFDTRDMTVPAFLTKAVFDENKKYGLIRGYGKYAGDHRYGGLITNSENGAQVGAEYGTGVFYDETHTKSRYGLEYVYTNADKDTWADYARLSYDRQGIGLDNHFQQTHCSADGSDKYCRPSADKPSSYYKSDRVIYGESHRLLQAAFKKSFDTAKIRHNLSVNLGYDRFGSDLRHQDYYYQHANRAYSPKTPPQNGDKKTIPNGGKDKPYWVSIGGGNVVTGQICLFGNNTYTDCTPRSINGKSYYAAVRDNVRLGRWADVGAGLRYDYRSTHSDDGSVSTGTHRTLSWNAGIVLKPADWLDLTYRTSTGFRLPSFAEMYGWRSGDKIKAVKIDPEKSFNKEAGIVFKGDFGNLEASWFNNAYRDLIVRGYEVQIKDGKEQVKGDPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRDTKATARRTRPWYIVDVSGYYTVKKHFTLRAGVYNLLNHRYVTWENVRQTAAGAVNQHKNVGVYNRYAAPGRNYTFSLEMKF

SEQ ID NO: 22155 - protein, 915 aa, Neisseria gonorrhoeae
MQQQHLFRFNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVALTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLAPVDDASTWAYFIVEEECKNRDYETCKAKPKKDVDGKDERQTVSTRDYTGPNRFLADPLSYESRSWLFRPGFRFENKRHYIGGILERTQQTFDTRDMTVPAFLTKAVFDENKKYGSIRGYGKYAGDHRYGGLITNSENGAQVGAEYGTGVFYDETHTKSRYGLEYVYTNADKDTWADYARLSYDRQGIGLDNHFQQTHCSADGSDKYCRPSADKPSSYYKSDRVIYGESHRLLQAAFKKSFDTAKIRHNLSVNLGYDRFGSDLRHQDYYYQHANRAYSLKTPPQNGDKKTIPPNGGKDKPYWVSIGGGNVVTGQICFFGNNTYTDCTPRSINGKSYYAAVRDNVRLGRWADVGAGLRYDYRSTHSDDGSVSTGTHRTLSWNTGIVLKPADWLDLTYRTSTGFRLPSFAEMYGWRSGDKIKAVKIDPEKSFNKEAGIVFKGDFGNLEASWFNNAYRDLIVRGYEVEITDGKEQAKGDPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRNTKATARRTRPWYIVDVSGYYTVKKHFTLRAGVYNLLNHRYVTWENVRQTAAGAVNQHKNVGVYNRYAAPGRNYTFSLEMKF

SEQ ID NO: 22156 - protein, 179 aa, Wolbachia sp. wPrn
SYYVRLQYNGEILPLYTKVDGITHTSGKSPLKASFLAGGGAFGYKMDDIRVDVEGLYSQLAKDTAVVSTSETNVADSLTAFSGLVNVYYDIAIEDMPITPYVGIGVGAAYISNPSEASAVKDQKGFGFAYQAKAGVSYDVTPEIKLYAGARYFGSYGASFDKAAKNDAGITNVLYSTVG

SEQ ID NO: 22157 - protein, 757 aa, Porphyromonas gingivalis
MRTKTIFFAIISFIALLSSSLSAQSKAVLTGSVSDAETGEPLAGARIEVKHTNIVAGADAGGHFEIKNLPAGQHTIICSLGGYGQKEEVVAIEAGQTKMISFALRLRTNNLEEVVVTGTGTRYRLVDAPVATEVLTAKDIASFSAPTSEALLQGLSPSFDFGPNLMGSFMQLNGLSSKYILILIDGKRVYGDVGGQADLSRISPDQIERIELVKGASSSLYGSDAIAGVINVITKKNTNRLSAYTSHRISKYNDRQTNTSLDINIGKFSSNTNYFFYHTDGWQNSPFEIKKKKGSGEPILEETYKKTFRAQENQGVSQSLSYYATNNLSFSGNVQYNKRQIFTPTFSEKKAYDMDYRALTASLGTNYLFPNGLHTLSFDAVYDRFRFGYLYHDKDSSESLINNQGQTEQPTFFPGQLRNKNDQIRYTAEARGVFTLPYAQKLTGGLEYFREELISPYNLITDKADASTLSAYVQDEWKPLDWFNMTAGFRLVHHQEFGTRMTPKVSILAKYGPLNFRATYANGYKTPTLKELFARNELTTMGSHNLYLGNADLKPQMSDYYALGLEYNKGPISFSATVYDNELRNLISFIDIPTSPEHEAQGIKKTKQYANKGKARSRGLDVLCDASIGWGIKLGAGYSLVEAKNLQTDEWLEGAARHRANVHADWAHYWGQYRLGVSLFGRIQSERYYKDGNAPDYTLWRLATSHRFAHFRHIILDGTLGIDNLFDYVDDRPMGVNYATVTPGRTFFAQIAIRFNN

SEQ ID NO: 22158 - protein, 1120 aa, Porphyromonas gingivalis
MRKRIIFAAALCLTVIYPAYNANAATEVAQEVQQARTIRGKVVDNNGEPVIGANVMVKGTTNGVITDIDGNFVLNNAKGTLVISYIGYKTVELPIGDKTNFNVKLVEDSELLSEVVVTGYGVAKKASLTSAISQVKGDDVFKNRGIANTTLALQGEVPGLVVTRSSTRPGSEGAAIKIRGDVSMNGNDPLIIIDGVAGSLSELNSMDGNDIENISVLKDASAAIYGARSASGVILVTTKRGRKGKAQVSYSGTISRTIDGIQAPLTNNQEWLDMFFEAQYYDTAASNPKLTDPREIYQNLNWWIFNSFGGQSVAKNSKGKWAPNYKDIDPDTGAPMMYKGDKLFNALRAGRSIFAQNGNKIESWMPSNYMLDAFYGQATSQKHSVSISGADEKFAYRASLSYSDANSQLKVAEDGERKYGARLNADYQPIDILKFETGMSYEKKDKRTPSTDVGGGYFDPWFWALLNENGDAYDTFSGNRNPYGGLLQGGQNTTSLTTFRATGKVTLDLNKWVKGFDLSATGAYKMVREDYTEQINKVQYYDWAGTETGNKQGPGSLKEQNKKWENVTLGAFANYDRMFMNVHHVKAMLGMTAEQETYKQIGAKRSMGPLYPGSDLVDLDVWISGTNNEAYGGQYSWGFVSYLTRLNYDYAGKYLVEFLGRRDGSSKLVKEQRWKNFYSVSGGWIISNEDFMKSFTWLSNLKLRYNYGKMGSVNGIGNYESYALIKTGGTVLGVSPSSHTSFKLDGMRSGERSWETIESHNAGIDIAFLDHRLNGSFDYFVKTNTGMFIGVTYPSILGAGAPKSNDGKFRTKGWEATVNWRDQIGGVKYNLGFSLADYKSKVLQFTDMTNVPFPGNLGRGDRIENWNGNAKNYYLVGKSLSPVYVFQTDGIFQTQEEVDAYYEMYYWNADHTAPKAGNIIPAPADSGTGRLRPGARKVVDLDGDGVITKDDIYYAGDRDPHLTFTIKAGLEWKGIDVSAFFQGVGNQVVLRQGQIPYLWRTNYVMQNKTYMGKTWTPENTGAEYTIASRDQNFNAWNYQYKDVSLQKNRYIRLKSLVVGYTLPKQWTAKAGLNKVRLYFSGDDLWEWTKVKDGYDPEFGEETNNSFPFSRLLSFGVDVTF

SEQ ID NO: 22159 - protein, 887 aa, Porphyromonas gingivalis
MKQLLLVLFLTLTPAAYLTAATVKGWVKDAQTGEELIGAAVYVKENPAMGTTAGLDGTFVLKDVPEGKNITLVCSYISYETQEQNVNTLSGRDVLFNMKPSAMNLEGVTIIAANPGRTEAGARGIEKQAMNVVNVMSAKAIELSPDITVANVIQRMSGVTVERNSSGEGQYAILRGMDKRYNYTLVNGVKIPSPDNKNRFVPLDIFPSEMLDRLEVTKSLTANMEGDGIGGAVNLIMKDAPSERQFTANLSTGYNAMYFGRDFQSFNRGGIVKKSPYEALGKPEDYKVTMEDFTTSNLRMKWKKPLPDLTAGLSYGDRFFDDKLGVMLAGSFLSTSRGKESRLYYQPGTSHNGIEYRNYSSEQTRIGVHAKLDYSLNDNHKLTWYNGYMDMSEAEVREGEDEKERAVRMRWNHQYIINSTLKGEHLFLSGGALRLNWSAVLSKAFSETPDNAEIYLLGSHVSTTDAAKRRWEHNSDKDKAGYVDLAYKLKLDGGAILDFSAGGMYRDKKRDSFFNEYTFNSATGSKNPQYINKDWFNFDEIQFVPRPYGNIGDPLNYDATEKIGAGYGMVKYTLKEWELIAGVRVEHTNQGYVLKFPRDVDPEGNQDYTDVLPSFHAKYGIHRNANLRFSYARAINRPSFFEIVPYSIINEDYKEKGNPDLKHTVADNIDLRYEFFPKSSEQFMVGLFYKNIQDPIEYGLLNEGQDTYYKPMNFGDAKNLGMEVDVMKYFNWFGIKANYTYTHSKVTTDKRIMEGSEVKSVRQSRPLFGQAAHVANLSLLFKETRHGWEGQVSASYTGKRLSDISNWYEDDIWEDGYAQLDASIEKSFKNGISIFGKASNLLDIPLLRYIQKGPRTESVDSDRHNGNVIERKEWHGQSFMLGIRYKL

SEQ ID NO: 22160 - protein, 848 aa, Porphyromonas gingivalis
MIGKKFFFILLALIAFSGLNAATDAEFKYPTDANIIGHVKDSKTGEHLVGITIAIKGTTFGTSTDATGHYYLRNLRPGEITLIMRGMGYKSQERVVRVEKDKTIEVNFEAEEDAINLDEVVISANRELTLRRLAPTLVNVLNEKVFSQVNASNLAQGLSFQPGVRVENNCQNCGFNQVRINGLDGRYAQILIDSRPIMSALAGVYGLEQIPANMIERVEVVRGGGSALYGSSAIAGVVNIITKEPSHNSFTFNESLSFTGFSKLDNNTNFNASIVSDDNRAGAMVFGQARYRNHWDANNDGYSELGKIDARSLGAHSYLRLSDYSKLTGEFHTISEFRRGGDRIDLPPHVVGVAEQTDHSVFSGNLKYDLFSSNYKHHFQAYTSGQIVNRKSYYGGIGEIDVNGHPGGTEGYPIPQDQYGNNYGVTKGKTYMGGIQYSYDLDKFLLMPSQLLFGAEYTRDELNDVMPILSWQTGEDANGNTIPLYPELDQNINNYSLFGQNEWKNDKWSILVGARLDKHSEVKDIILSPRTTLRFNVNPDINLRATYAKGFRAPQVFDEDLHVGVVGGEAQKVFNDPNLKPEISHAFSLSADMYHRFGNVQTNFLVEGFYTRLLDVFTNEEQPDQHDGIKRYTRINGSGAKVFGLNLEGKVAYKSFQLQAGLTLASNKYDEAQEWGLNTVKDTNGAFVTEANANGQQEYKNESMTDTQITRTPSVYGYFTLAYNPAHSWSVALTGAYTGQMYVPHAIEYGVKSAELDIMQNNPEITDETGTAPRIDELKKTPAFFDLGLKVGYDFHVFQATEVQLYVGMNNIFNSFQKDFDRGAARDSGYIYGPTQPRTGYMGLVVKF

SEQ ID NO: 22161 - protein, 188 aa, Wolbachia sp. wTen-B1
YVRLQYNGEILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEAGVAF

SEQ ID NO: 22162 - protein, 179 aa, Wolbachia sp. wFus-B1
YVRLQYNGEILPFYTKVDGITNATGKEKGSPLTRSFIAGGGAFGYKMDDIRVDVEGLYSKLAKDTDVVNTSETNVADSLTAFSGLVNVYYDIAIEDMPITPYVGVGIGAAYISNPSKADVVKDQKGFGFAYQAKAGVSYDVTPEIKLFAGARYFGSYGASFDKAAKDDTGIKNVVYSTV

SEQ ID NO: 22163 - protein, 179 aa, Wolbachia sp. wXyl-B1
YVRLQYNGEILPFYTKVDGITNATGKEKDSPLTRSFIAGGGAFGYKMDDIRVDVEGLYSKLAKDTDVVNTSETNVADSLTAFSGLVNVYYDIAIEDMPITPYVGVGIGAAYISNPSKADVVKDQKGFGFAYQAKAGVSYDVTPEIKLFAGARYFGSYGASFDKAAKDDTGIKNVVYSTV

SEQ ID NO: 22164 - protein, 180 aa, Wolbachia sp. wInv-B1
YVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAV

SEQ ID NO: 22165 - protein, 179 aa, Wolbachia sp. wLen-B1
YVRLQYNGEILPFYTKVDGITNATGKEKDSPLTRSFIAGGGAFGYKMDDIRVDVEGLYSKLAKDTDVVNTSETNVADSLTAFSGLVNVYYDIAIEDMPITPYVGVGIGAAYISNPSKADVVKDQKGFGFAYQAKAGVSYDVTPEIKLFAGARYFGSYGASFDKAAKGDTGIKNVVYSTV

SEQ ID NO: 22166 - protein, 174 aa, Wolbachia sp. wUrt-B1
YVRLQYNGEILPLYTKVDGITHTSGQSPLKASFIAGGGAFGYKMDDIRVDVEGLYSQLAKDATVVSDNKAADSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAV

SEQ ID NO: 22167 - protein, 179 aa, Wolbachia sp. wPak-B1
YVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSA

SEQ ID NO: 22168 - protein, 180 aa, Wolbachia sp. wTab-B1
YVRLQYNGEVLPFKTRIDGIEYKKGNEVHDPLKASFVAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGARFNEDTVSATKEINVLYSAV

SEQ ID NO: 22169 - protein, 178 aa, Wolbachia sp. wNi-B1
YVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKVLYSTV

SEQ ID NO: 22170 - protein, 180 aa, Wolbachia sp. wAli-B1
YVRLQYNGEVLPFKTRIDGIEYKKGNEVHDPLKASFVAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLYAGARYFGSYGARFNKDTVSATKEIIVLYSAV

SEQ ID NO: 22171 - protein, 167 aa, Wolbachia sp. wIrr-A1
YHGEALPLFTKIDGITHKTGKDKDSPFKASFPTLAGSGAFGYKMDDIRVDIEGLYSQLSKDADVADATADKLSAISGLVNVYYDIAIEDMPITPYVGVGVGAAYLNNPSNVNDVKDQWKFGFAGQVKAGVSYDVTPEIKFYAGARYFGSYGASFDKAAKDDAGIKNV

SEQ ID NO: 22172 - protein, 190 aa, Wolbachia sp. wSus-A1
YVRLQYNGEFLPLFTKVDGITYKKDKSDYSPLKPSFIAGGGAFGYKMDDIRVDVEGVYSYLNKNDVKDVTFDPANTIADSVTAISGLANVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTV

SEQ ID NO: 22173 - protein, 432 aa, Pseudomonas fluorescens
MNKRILSVAVIAAIMGTTTQVQAAGFQLAEYSATGLGRAYAGEAAMADNAAAQFRNPAMLTYLQGTQMTTGAILVMPNIDVDGEVTYVDGKNPTSAKDIAGDAVVPNFYVSHQLNEQWFLGVALGSNFGMATELDDSFRGNQFGNEASVTTVELNPNIAYRINDQFSIGAGVRFVMGEGSFGAKSSVDVPLSASLIIPKGTTLKYMEGDDTSWGWQLGGAWQINANNRIGFNYRSEVEQNLEGEANGLGFSMLEGSMNASKIYAGAMELTLPATAEIASFHQLTDKLAVHASVNWTDWSSFEKLEAKIPELSNSAILVKEENWKDNYRFALGATYELSAKSSLRAGVAYDQAAVDDIHRTATIPEVNRLWLSAGYGYQYSENLAFDFGATYIFADESPMHEADTDSLPFGGAFEGQVSGNIMLVGVQASYRF

SEQ ID NO: 22174 - protein, 1298 aa, Helicobacter pylori
MELQQTHRKINRPLVSLALVGLLVSITPQKSHAAFFTTVIIPAIVGGIASGAAVGTVSGLLGWGLKQAEEANKTPDKPDKVWRIQAGRGFNEFPNKEYDLYKSLLSSKIDGGWDWGNAAGHYWVKGGQWNKLEVDMKDAVGTYKLSGLRNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYISTLDLWQSAGLNIIAPPEGGYKDKPNNTNSQSSAKNDKQESAKNDKQESVKNDKQDSNTQVINPPNSGQKTEIQPTQVIDGPFAGAKDTVVNINRINTNADGTIKVGGYTASLTTNAANLNIGKAVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFVNNQGTINYLVRGGNIETLNVGNAAVMSFNNDIDSTTGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNSTPTDNGGNTTNLPTNTTNNARFARYALIKNAPFAQTSATPNLVAINKHDFGTIESVFELANRSKDIDTLYANSGVQGRDLLQTLLIDSHDAGYARTMIDATSANEITKQLNTATDALNNIASLEHKTSGLQTLSLSNAMILNSRLVNLSRRHTNNIDSFAKRLQALKGQRFASLESAAEVLYQFAPKYEKPTNVWANAIGGASLNSGGNTSLYGTSAGVDAYLNEKVEAIVGGFGSYGYSSFSNQANSLNSGANNANFGVYSRIFANQHEFDFEAQGAVGSDQSSLNFKGALLRDLNQSYNYLAYGTSARASYGYDFAFFRNALVLKPSVGVNYNHLGSTNFESNSTHKAALKNGASSQHLFNASANVEARYYYGDTSYFYMNAGVLQEFANFGSSNAVSLNTFKVNAARNPLNTHARVMMGGELKLAKEVFLNLGFIYLHNLISNIGHFASNLGMRYSF

SEQ ID NO: 22175 - protein, 340 aa, Vibrio furnissii
MDKMFKRTLLGAAVASLAATGSANAAVQLAGDAVQFYGQAAGYITVADSGDTTVVATTIESRIGFRGVVEFEDFSPKFVWQIEGGNADNGGFNPNEGWNHVNNGQLGARDTYLGFDFGKGGRFTYGRQLVAAYNYVDWPHSNPGLGNVFDWNNDIGAGYQDRASNNLRYDSANFGGFSFQATLSGMESDIDGLVSSVGASYGNDVFNIHGGVYSRGEYGTGADLKYANSYGILGGSLYLGSLTLTAAYKAMEADSATGTLKQNALSTTAQYVIDGKWVLKAGYAATDDATGDSKSSDTAVTARLGYILPSAYLYLDSRNYKMNEASDWTKAILAGVEYYF

SEQ ID NO: 22176 - protein, 915 aa, Neisseria gonorrhoeae
MQQQHLFRFNILCLSLMTALPAYAENVQAGQAQEKQLDTIQVKAKKQKTRRDNEVTGLGKLVKSSDTLSKEQVLNIRDLTRYDPGIAVVEQGRGASSGYSIRGMDKNRVSLTVDGVSQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRRAGEIRAHEDAGRGVQSFNRLVPVEDSSNYAYFIVKEECKNGSYETCKANPKKDVVGKDERQTVSTRDYTGPNRFLADPLSYESRSWLFRPGFRFENKRHYIGGILEHTQQTFDTRDMTVPAFLTKAVFDANKKQAGSLPGNGKYAGNHKYGGLFTNGENGALVGAEYGTGVFYDETHTKSRYGLEYVYTNADKDTWADYARLSYDRQGVGLDNHFQQTHCSADGSDKYCRPSADKPFSYYKSDRVIYGESHRLLQAAFKKSFDTAKIRHNLSVNLGFDRFGSNLRHQDYYYQHANRAYSSNTPPQNNGKKISPNGSETSPYWVTIGRGNVVTGQICRLGNNTYTDCTPRSINGKSYYAAVRDNVRLGRWADVGAGLRYDYRSTHSDDGSVSTGTHRTLSWNAGIVLKPTDWLDLTYRTSTGFRLPSFAEMYGWRAGVQSKAVKIDPEKSFNKEAGIVFKGDFGNLEASWFNNAYRDLIVRGYEAQIKDGKEEAKGDPAYLNAQSARITGINILGKIDWNGVWDKLPEGWYSTFAYNRVRVRDIKKRADRTDIQSHLFDAIQPSRYVVGLGYDQPEGKWGVNGMLTYSKAKEITELLGSRALLNGNSRNTKATARRTRPWYIVDVSGYYTVKKHFTLRAGVYNLLNYRYVTWENVRQTAGGAVNQHKNVGVYNRYAAPGRNYTFSLEMKF

SEQ ID NO: 22177 - protein, 1605 aa, Rickettsia helvetica
MGAANRDINANVNLDVVGIPGIVTGDSLTYVVQAGGPCTATATGGNDNGGNATVLFGSINMLQNGVFAVNGADIAIGSVSGTAGQLLTVNIAGNTLTLNGAPGVAAFPVNTYTNLGPVNFVDAAAVFKVSLAANGADGTKTAIFGNTATFNGTAAGKGIINIDNGNIAIFNGTIGNNNGIQGLTLTGNAQATLNANTKFDGTVGAGSVSLDNGSILNVADGVNITGITAVNNISIDGKAANDGTVNFLGDSAVSTDIGANNAIAAVNVAGELTFQGGNNGGGGTFTAQAINLTSAGSLIKFTTQDHAVTGNILNTSGTNNQGGFSVNGGDVTVTGNIGADGNSLATINFETDDSLIVHKAAINATNALFIQNVNTATANTGILKLHGTNYAINGNIGANNALKLVDLADDDNGAATNFTLKQGSSIKAQNISLADIQDNTLTLEEGTTITGDIINTKGNGNGTIVLTGNATINGGIGVDIAAGGNLGKTIKNINLGGKDLSYGGNTVKVQSAPNNGINFAANETLSLTNTTDPILIASDIITTDKQGIIDGSALTNDQTLTIAGKIGIVDIINNPAQNVALGQLKIGSSKTALNSGNVAINELVIGNNGSVQFAHNTYLITKTTNAAGQGKITFNPVVANNTTLADGTNLGSAANPLSEINFGSKGANADTLLNVGKGVNLYATNITTTDANTGSFGFNAGGTYLVNGTVGGQQGNKFNTVELDNGTTAYFLGNAIFNGETTIKANSTLQIGGNYTTDFVTSADNTGIVKFVNADLITVTLNKQAAPVNAVEQITVSGPGNIVINEIGNAGNEHGMATDTISFENASLGAALFLPSGIPFNDAGNAVPLTIKSTVGNNGPEGDFNVPVVIVSDVDSVIADDQVIGDQNNIVGLSLGSDNGIAVNTTTLYAGIGTIKNNQGTVILSGGIPNTPGTIYGLGIENGTPKLKQVTFTTDYNNLGSIIATNATINDGVTVTTGGIAGTDFDGKITLGSANGNANVRFADGTFSDPTSMIVTTKANNGTVTYLGDAYVGNIGASGTPVASVKFTGNDNGAGLQGNIYSQVTDFGTYGLDVLNSNVILGGGTIAINGEIDLDTNILTFASGTSTWGSNTSIETTLTVANGNIGHIVIAEGAQVNATTTGTTTINVQDNANTNFSGTKYYTLIEGGARFNGTLRDPNFAVTGDNRFIKYGLIRDANQDYVITRTNNAANVVTNDIAGSQFGGAPGIGQNITTFVNATNTAAYNNLLLAKNSADSANFVGAIVTDTSAAVTNVQLNVVKDIQAQLSNRLGALRYLGTPETAEMAGPEAGAVPAAVAAGDGAVDNVAYGIWAKPFYTDAHQSKKGGLAGYKAKTTAVLIGLDTLANDNLMIGAAIGITKTDIKHQDYKKGDKTNVNGFSFSLYGAQQLVENFFAQGSAIFNLNQVKNKSQRYFFDANGNMSKQIAAGNYDNMTFGGNLTVGYDYNAMQGVLVNPMAGLSYLKSSDENYKETGTTVANKQVNSKFSDRTDLIVGAKVAGGTMNITDLAVYPEAHAFVVHKVNGKLSKTRSVLDGQVTPFISQPDRTAKTSYNLGLSASIRPDAKMEYGIGYDAQIASKYTAYQGTL

SEQ ID NO: 22178 - protein, 1616 aa, Rickettsia honei
MGAAIQQNRITNRAATTVDGVGFDQNAAPADVAVALNAVITANANNGITLNTPAGSFNGLLLNTANNLVVTVGEDTTLGFITRAVNNVNSFNLTLNAGKTLTITGQGITNAQAAATQNAKNVVVQFNNGAAIDNNDLKGVGRIDFHAAASTLVFNLANPTTQEAPLILGDNTEIVNGGNGTLNVTKGFIQVSNKSFATVKAINIADGQGIMFNTDANNANALNLQAGGTTINFNGTDGTGRLVLLSKNAAATNFNVTGSLGDNLKGIIEFNTVAVDGQLIANAGPANAVIGTNNGAGRAAGFVVSVDNGKVATIDGQVYAKDMVIQSVNAAGQVNFRHIVDVGTDGTTAFKTAASKVTITENSNFGTTDFGNLAAQIEVPNNMTLTGNFTGDASNPGNTAGVITFNANGILASASADANVAVTNNITAIEASGAGVVELSGTHAAELRLGNAGSVFKLADGTVINGKVNQTAPVGGALAAGAITLDGSATITGDIGNAGGAAALQGITLANDATKTLTLGGANIIGANGGTIAFQANGGTIKLTSTQNNIVVAFDLAITTDQTGVVDASSLTNAQTLTINGKIGTIGVNNKTLGQFNIGSSKTVLSDGNVAINELVIGNNGAVQFAHNTYLITRTTNAAGQGKIIFNPIVNNSTILAAGTNLGSATNPLAEINFGSKGANVDTVLNVGKGVNLYATNITTTDANVGSFVFNAGGTNIVSGTVGGQQGNKFNTVELGNGTTVKFLGNATFNGNTTIAANSTLQIGGNYTADFVASADGTGIVEFVNTSPINVTLNKQVAPVNALKQITVSGPGNVVINEIGNAGNYHGAVTDTIAFENSSLDAVVFLPRGIPFNDAGNTMPLTIKSTVGNKTAKGFAVPSVIVLGVDSVIADGQVIGDQDNIVGLGLGSDNGIIVNATTLYAGIGTVNNNQGTVTLSGGVPNTPGTVYGLGTGIGHSKFKQVTFTTDYNNLGNIIATNATINDGVTVTTGGIAGTGFDGKITLGSVNGNGNVRFVDGMLSNSTSMIGTTKANNGTVTYLGNAFVGNIGDSDTPVASVRFTGSDSGAGLQGNIYSQVIDFGTYSLGILNSNVILGGGTTAINGKISLLTNTLTFASGTSTWGNNTSIETTLTLANDNIGHIVILEGAQVNATTTGTTTIKVQDNANANFSGTQTYTLIQGGARFNGTLGGPNFAVTGSNRFVNYGLIRAANQDYVITRTNNAENVVTNDIANSPFGVAPGVGQNVTTFVNATNTAAYNNLLLAKNSANAANFVGAIVTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQIASKYTAHQGTL

SEQ ID NO: 22179 - protein, 1614 aa, Rickettsia slovaca
MGAAIQQNRTTNAVATTVDGAGFDQTAILGNVAVPINAVITANVHQGINLNTPAGSFNGLFLNTANNLDVTVSEDTTLGFITHAVNHNANHFSLTLNAGKTLTITGQGITNVQAAATKNAQNVVVQVNNGAAIDNNDLQGVGRIDFGAAASTLVFNLANPTTQKAPLILGDNAVIANGANGTLNVTNGFITVSSKSFATVNAINIGDGQGIMFNTDANNANALNLQANGATINFNGTDGTGRLVLLSKNAAATDFNVTGSLGGNLKGIIEFNTVAVNGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNVGSVFKLADGTVINGKVNQTALVAGALAAGTITLDGSATITGDIGNAGGAAALQGITLANDATKTLTLGGANIIGANGGTIDFQANGGTIKLTSTQNNIVVDFDLAITTDQTGVVDASSLTNAQTLTINGKIGTIGANNKTLGQFNIGSSKTVLSDGDVAINELVIGNNGAVQFAHNTYLITRTTNAAGQGKIIFNPVVNNNTTLATGTNLGSATNPLAEINFGSKGVNVDTVLNVGKGVNLYATNITTTDANVGSFIFNAGGTNIVSGTVGGQQGNKFNNVALNNGTTVKFLGNATFNGNTTITANSTLQIGGNYTADFVASADGTGIVEFVNTGPITVTLNKQAAPVNALKQITVSGPGNVVINEIGNAGNYHGAVTDTIAFENSSLGAVVFLPRGIPFNDAGNIIPLTIKSTVGNKTATGFDVPSVIVLGVDSVIADGQVIGDQNNIVGLGLGSDNDIIVNATTLYAGIGTINDNQGTVTLSGGIPNTPGTVYGLGAGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSNTPVASVRFTGSDGGAGLQGNIYSQVIDFGTYNLGILNSNVILGGGTTAINGKINLRTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKDIQAQLGNRLGALRYLGTAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 22180 - protein, 1615 aa, Rickettsia sibirica
MGAAIQQNRTTNADATTVDGVGFDQTAVLANVAVPLNAVITASVHKGINLNTPAGSFNGLFLNTANNLAVTVSEDTTLGFITRAVNNVNFFNLTLNAGKTLTITGQGITNVQAAATKNAQNVVVQVNNGAAIENNDLQGVETIDFGAAASTLVFNLANPTTQKAPLTLGDNAVIVNGANGTLNVTNGFIKVSSKSFATVNAINIGDGQGIIFNTDADNANALNLQAGGTTINFNGTDGTGRLVLLSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPDNTAGVITFDANGTLASASADANVAVTNNITAIEASGAGVVELSGTHAAELRLGNAGSVFKLADGTVINGKVNQTALVAGALAAGTITLDGSATITGDIGNAGGAALQGITLANDATKTLTLGGANIIGANGGTIDFQANGGTIKFTSTQNNIVVDFDLAITTDQTGVVDASSLTNAQTLTINGKIGTIGANNKTLGQFNIGSSKTALSNGDVAINELVIGNNGAVQFAHNTYLITRTTNAAGQGKIIFNPVANNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIVANSTLQIGGNYTADFVASADGTGIVEFVNTDPITVTLNKQAAPVNALKQITVSGPSNVVINEIGNAGNYHGAVTDTIAFENSSLGAVVFLPRGIPFNDAGNIMPLTIKSTVGNKTATGFDVPSVVVLGVDSVIADGQVIGDQNNIVGLGLGSDNDIIVNATTLYAGIGTVNNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGSAFVGNIGDSNTPVASVRFTGSDGSAGLQGNIYSQVIDFGTYNLGILNSNVILGGGTTAINGKINLSTNTLTFASGTSTWGNNTSIETTLTLANGNIGNIVILEGAQVNATTTGTTTIAVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKDIQAQLGNRLGALRYLGTPETAEMAGPEAGAIPAAVAAGDEAVDNVAYGIWAKPFYTDTHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 22181 - protein, 1616 aa, Rickettsia sp. S
MGAAIQQNRTTNADATTVDGAGFDQTAVPANVAVPLNAVITASVHKGINLNTPAGSFNGLFLNTANNLAVTVSEDTTLGFITRAVNNANFFNLTLNAGKTLTITGQGITNVQAAATKNAQNVVVQVNNGAAIENNDLQGVGTIDFGAAASTLVFNLANPTTQKAPLILGDNAVIVNGANGTLNVTNGFIKVSSKSFATVNAINIGDGQGIIFNTDADNANALNLQAGGTTINFNGTDGTGRLVLLSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGMIDFQANGGTIKFTSTQNNIIVDFDLAITTDQTGVVDASSLTNAQTLTINGKIGTIGANNKTLGQFNIGSSKTALSGGDVAINELVIGNNGAVQFAHNTYLITRTTNAAGQGKIIFNPVVNNNTTLAAGTNLGSATNPLAEINFGSKGVNVDTVLNVGEGVNLYATNITTTDANVGSFIFNAGGINIVSGTVGGQQGNKFNTVALDNGTTVKFLGNATFNGNTTIAANSTLQIGGNYTADFVASADGTGIVEFVNTDPITVTLNKQAAPVNALKHITVSGPGNVVINEIGNAGNYHGAVTDTIAFENSSLGAVVFLPRGIPFNDAGNIIPLTIKSTVGNKTAAGFDVPSVIVSGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGGSDTPVASVRFTGSDGGAGLQGNIYSQVIDFGTYNLGILNSNVILGGGTTAINGKINLLTNTLTFASGTSTWGNNTSIETTLTLANVNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKDIQAHLGNRLGALRYLGTPETAEMAGPEAGAIPAAVAAGDEAVDNVAYGIWAKPFYTDTHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 22182 - protein, 1618 aa, Rickettsia rhipicephali
MGAATQQNRTTNGAATTVDGAGFDQTVAPANVAVALNAVITANANNGINLNTPASSFNGLFLDTANNVAVTVSADTTLGFITNAANNGNFFDLTLGAGKTLTITGQGITNAQAAVTKNAQNVVTPFNGGAAIANNDLSGVGTIDWGAADSTLVFNLANPTTQKAPLVLGNNAVIANGVNGTLNVTNGFIQVSDKSFATVKAINIGDGQGFIFNTDATVGNALNLQAGGATINFNGTDGTGRLVLLSKNGAATDFNVTGSLGGNLKGIIAFNTVAVAGQLIANAGPANAVIGTNNGAGRAAGFVVSVDNGNAATIAGQVYAKDMVIQSANAGGQVNFGHIVDVGTDGTTAFKTAASKVAITQNSNFGTTDFGNLAAQITVPNTMTLTGNFTGDASNPGNTAGVITFAANGTLASASADANVAVTNNITAIEASGVGVVQLSGTHTAELRLGNAGSVFKLADGTVINGKVNQTAVVGGALAAGAITLDGSATITGDIGNGGGAAALQGITLANDATKTLTLGGANIIGANVGGTIDFQANGGTIKLTSTQNNILVDFDLDITTDQTGVVDASSLTNAQTLTISGTIGTIGANNKTLGQFNIGSSKTALNGGNVAINELVIGNNGSVQFAHNTYLITSTTNAADQGKIIFNPVVNNNTTLAAGTNLGSAANPLAEINFGSKGAHADTILNVGEGVNLYATNITTTDANVGSFVFNAGGTNIVSGTVGGQQGNKFNTVALDNGTTVKFLGNATFNGETTIEANSTLQIGSNYTADFVASADGTGIVEFVNTGPITVTLNKQAAPVGYLKQVTVSGTGNVVVNGIGNAGNNPGAATDTIAFENSSLGAALFLPSGIPFNDAGNTMPLTIKSTVGNRTATGFDVPKVIVLGVDSVIADGQVIGDQNNIVGLGLGSDNGIIVNATTLYAGIGTINNNQGTVTLSGGVPNAPGTVYGLGTGIGASQLKQVTFTTDYNNLGNIIAANATINDGVTVTTGGIAGTDFDGKITLGSVNGNANVRFADGIFSNSTSMIVTTKANNGTVTYLGNACVGNIGDSGTPVASVRFTGSDDSAAGLQGNIYSQVIDFGTYDLNILNSNVILGGGTTAINGAINLLTNTLTFASGTSTWGNNTSIKTTLTVANGNIGHIVIAEGAQVNATTTGTTTINVQDNANANFSGIQTYTLIQGGARFNGTLGGPNFAVTGSNRFVNYGLIRAANQDYVITRTNNAENVVTNDVANSSFGGTPGVGQNVTTFVNATNTAAYNNLLLAKNSADSANFVGAIVTDTSAAVTNAQLNVAKDIQAQLGNRLGTLRYLGTPETAEMAGPEAGAIPAAVAAGDEAVDNVAYGIWTKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVHSKFSDRTDLIVGAKVAGGTINITDLAVYPEAHAFVVHKVNGRLSKTQSVLDGQVTPCISQPDRTAKTSYNLGLSASIRPDAKMEYGIGYDAQIASKYTAHQGTL

SEQ ID NO: 22183 - protein, 387 aa, Rickettsia prowazekii
MGAAMGAAPAHAQDQAQDQARAADPDWTLSAEYTADVSGVVSGGAQRAGRYLDNLSVELDGDLEQAWGWRGARLHMSGLYNGGGEPNALAGTLQGVDNIEVAAQGARLFEAWIEQDLGGSATLLAGLYDLNSEFYATEASGLLISPPFGIGSELASTGPNGPAIFPSSSLAARLRVGDPDRTYVQAAVVNADARTFGDHGGVDTDLDHGVLAIAEVGSHAPFRYAFGVWRYNQRQDDIRDLTPDGDPAHSIAQGAYALAEGQIWGAAAPDGPQVDAFARLGLSDGDTTDFQGGWQAGVLVRQVFAARPDSQLSFGLHQGWLSSKARANLTDTPADPARYEEGLELTYADRIGRFTIQPDIQLIRDPGGLKDVDDVVVVSLRVITPLF

SEQ ID NO: 22184 - protein, 1616 aa, Rickettsia parkeri
MGAAIQQNRITNRAATTVDGVGFDQNATPADVAVALNAVITANANNGITLNTPAGSFNGLLLNTANNLVVTVGEDTTLGFITRAVNNVNSFNLTLNAGKTLTITGQGITNAQAAATQNAKNVVVQFNNGAAIDNNDLKGVGRIDFHAAPSTLVFNLANPTTQEAPLILGDNTEIVNGGNGTLNVTKGFIQVSNKSFATVKAINIADGQGIMFNTDANNANALNLQAGGTTINFNGTDGTGRLVLLSKNAAATNFNVTGSLGDNLKGIIEFNTVAVDGQLIANAGPANAVIGTNNGAGRAAGFVVSVDNGKVATIDGQVYAKDMVIQSVNAAGQVNFRHIVDVGTDGTTAFKTAASKVTITENSNFGTTDFGNLAAQIEVPNNMTLTGNFTGDARNPGNTAGVITFNANGILASASADANVAVTNNITAIEASGAGVVELSGTHAAELRLGNAGSVFKLADGTVINGKVNQTAPVGGALAAGAITLDGSATITGDIGNAGGAAALQGITLANDATKTLTLGGANIIGANGGTIAFQANGGTIKLTSTQNNIVVAFDLAITTDQTGVVDASSLTNAQTLTINGKIGTIGVNNKTLGQFNIGSSKTVLSDGNVAINELVIGNNGAVQFAHNTYLITRTTNAAGQGKIIFNPIVNNSTILAAGTNLGSATNPLAEINFGSKGANVDTVLNVGKGVNLYATNITTTDANVGSFVFNAGGTNIVSGTVGGQQGNKFNTVELGNGTTVKFLGNATFNGNTTIAANSTLQIGGNYTADFVASADGTGIVEFVNTSPINVTLNKQVAPVNALKQITVSGPGNVVINEIGNAGNYHGAVTDTIAFENSSLDAVVFLPRGIPFNDAGNTMPLTIKSTVGNKTAKGFAVPSVVVLGVDSVIADGQVIGDQDNIVGLGLGSDNGIIVNATTLYAGIGTVNNNQGTVTLSGGVPNTPGTVYGLGTGIGHSKFKQVTFTTDYNNLGNIIATNATINDGVTVTTGGIAGTGFDGKITLGSVNGNGNVRFVDGMLSNSTSMIGTTKANNGTVTYLGNAFVGNIGDSDTPVASVRFTGSDSGAGLQGNIYSQVIDFGTYSLGILNSNVILGGGTTAINGKISLLTNTLTFASGTSTWGNNTSIETTLTLANDNIGHIVILEGAQVNATTTGTTTIKVQDNANANFSGTQTYTLIQGGARFNGTLGGPNFAVTGSNRFVNYGLIRAANQDYVITRTNNAENVVTNDIANSPFGVAPGVGQNVTTFVNATNTAAYNNLLLAKNSANAANFVGAIVTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQIASKYTAHQGTL

SEQ ID NO: 22185 - protein, 1617 aa, Rickettsia montana
MGAATQQNRTTNGAATTVDGAGFDQTAAPANVAVALNAVITANANNGINLNTPDGSFNGLFLDTANNLAVTVSADTTLGFITNAANNANSFDLRVDAGKTLTITGQGITNAQAAVTKNAQNVVAQFNGGAAIANNDLSGVGTIDLGAAASTLVFNLANPTTQKAPLVLGNNAVIANGVNGTLNVTNGFIQVSDKSFATVKTINIGDGQGFIFNTDATVGNALNLQAGGATINFNGTDGTGRLVLLSKHGAANDFNVTGSLGGNLKGVIAFNTVAVAGQLIANAGPANAVIGTNNGAGRAAGFVVSVDNGNAATIAGQVYAKDMVIQSANAGGEVNFGHIVDVGTDGTTAFKTAASKVAITQNSNFGTTDFGNLAAQITVPDTMTLTGNFTGDASNHGNTAGVITFAANGTLASASADANVAVTNNITAIEASGIGVVQLSGTHTAELRLGNAGSIFKLADGTVINGKVNQTAVVGGALAAGAITLDGSATITGDIGNGGGVAALQGITLANDATKTLTLGGANIIGANVGGTIDFQANGGTIKLTNTQNNILVDFDLAIATDQTGVVDASSLTNAQTLTISGTIGAIGANNKTLGQFNIGSSKTALNGGNVAINELVIGNNGSVQFAHNTYLITSTTNAVGQGKIIFNPVVNNNTTLAAGTNLGSAANPLAEINFGSKGAHADTILNVGKGVNLYATNITTTDANVGSFVFNAGGTNIVSGTVGGQQGNKFNTVALDNGTTVKFLDNATFNGETIIEANSTLQIGGNYTADFVASADGTGIVEFVNTGPITVTLNKQAAPVDYLKQITVSGPGNVVINGIGNAGNNHGVATDTIAFENSSLGATLFLPSGIPFNDAGNAIPLTIKSTVGNETAKGFDVPRVIVLGVDSVIADGQVIGDQNNIVGLGLGSDNGIIVNATTLYAGIGTINNNQGTVTLSGGIPNTPGTVYGLGTGIGSSQLKQVTFTTDYNNLGNIIATNATINDGVTVTTGGIAGTDFDGKITLGSVNGNANVRFADGIFSNSTSMIVTTKANNGTVTYLGNAFVGNIGDSGTPVASVRFTGSDDGAGLQGNIYSQVIDFGTYDLGILNSNVILGGGTTAINGAVNLLTNTLTFASGTSTWGNNTSIKTTLTLANGNIGHIVIAEGAQVNATTTGTTTINVQDNANANFSGTQTYTLIEGGARFNGTLGVPNFAVTGSNRFVNYGLIRAANQDYIITRTNNAENVVTNDIANSSFGGAPGVGQNVTTFVNATNTAAYNNLLLAKNSADSANFVGAIVTDTSASVTNAQLDVAKDIQAQLGNRLGALRYLGTPETAEMAGPEAGVIPAVVAAGDEAVDNVAYGIWTKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNVMQGVLVTPMAGLSYLKSSDENYKETGTTVANKQVNSKFSDRTDLIVGAKVVGGTMNITDLAVYPEAHAFVVHKVNGRLSKTQSVLDGQVTPCISQPDRTAKTSYNLGLSASIRPDAKMEYGIGYDAQIASKYTAHQGTL

SEQ ID NO: 22186 - protein, 1616 aa, Rickettsia mongolotimonae
MGAAIQQNRTTNADATTVDGAGFDQTAVPANVAVPLNAVITAAAHKGINLNTPAGSFNGLFLNTANNLAVTVSEDTTLGFITRAVNNANFFNLTLNAGKTLTITGQGITNVQAAATKNAQNVVVQVNNGAAIENNDLQGVGEIDFGAAASTLVFNLANPTTQKAPLILGDNATILNGANGTLNVTNGFIKVSSKSFATVNAINIGDGQGIIFNTDANNANALNLQAGGTTINFNGTDGTGRLVLLSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPDAMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGTIDFQANGGTIKFTSTQNNIVVDFDLAIITDQTGVVDASSLTNAQTLTINGKIGTIGANNKTLGQFNIGSSKTALRDGDVAINELVIGNNGAVQFAHNTYLITRTTNAAGQGKIIFNPVVNNNTTLAAGTNLGSATNPLAEINFGSKGVNVDTVLNVGEGVNLYATNITTTDANVGSFIFNAGGINIVSGTVGGQQGNKFNTVALDNGTTVKFLGNATFNGNTTIAANSTLQIGGNYTADFVASADGTGILEFVNTGPITVTLNKQAAPVNALKQITVSGPGNVVINEIGNAGNYHGAVTDTVAFENSSLGAVVFLPRGIPFNDAGNIMPLTIKSTVGNKTATGFNVPSVIVSGVDSVIADGQVIGDQNNIVGLGLGSDNDIIVNATTLYAGIGTINNNQGTVTLSGGIPNIPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSGTPVASVRFTGSDGGAGLQGNIYSQVIDFGTYNLGILNSNVILGGGTTAINGKINLLTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKDIQAQLGNRLGALRYLGTPETAEMAGPEAGAIPAAVAAGDEAVDNVAYGIWAKPFYTDTHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 22187 - protein, 1615 aa, Rickettsia massiliae
MGAATQQNRTTNGAATTVDGAGFDQTAAQVNAAVAPNAVITANANNGINFNTPAGSFNGLFLGTANNLAVTVSADTTLGFVTNVANNGNSFNLTLGAGKTLTITGQGITNAQAAVTNNAQNVVAQFNGGVAVANNDLSGVGAIDFGAAASTLVFNLAEPTTQKAPLILGGNAVIANGVNGTLNVTNGFIQVSDKSFATVKAINIGDGQGFIFNTNVAAGGNALNLQVGGATINFNGTDGTGRLVLLSKNGAATDFNVTGSLGGNLKGIIEFNTVAVAGQLIANAGPANAVIGTNNDAGRAAGFVVSVGNGNAATITGQVYAKDMVIQSANAGGQVNFGHIVDVGTDGTTAFKTAASKVAITQNSNFGTTDFGNLAAQITVPDTMTLTGNFTGNASNPENTAGVITFAANGTLASASADANVAVTNNITAIEASGVGVVQLSGTHTAELRLGNAGSVFKLADGTVINGKVNQTAVVGGALAAGAITLDGSATITGDIGNGGGAAALQGITLANDATKTLTLGGANIIGANGGTINFQANGGTIKLTSTQNNILVDFDLAINTDQTGVVDASSLTNAQTLTISGTIGTVGANNKTLGQFNVGSSKTALNGGNVAINELVIGNNGSVQFAHDTYLITKTTNAAGQGKIIFNPVVNNNTTLAAGTNLGSAANPLAEINFGSKGAHADTILNVGKGVNLYATNITTTDANVGSFVFNAGGTNIVSGTVGGQQGSKFNTVELDNGTTVKFLGNAMFNGGTKIEAKSTLQIGGNYTADFVASADGTGIVEFVNTGPITVTLNKQAAPVGVLKQITVSGPGNVVVNEIGNAGNAHGAVTGTIAFENSSLGATLFLPSGIPFNDVTIKSTVGNETAKGFDAPKVIVSGVDSVIADGQVIGDQNNIVGLGLGSDNGIIVNATKLYAGIGTTNNNQGTVILSGGVPNTPGTVYGLGKDASASQLKQVTFTTDYNNLGNIIATNTTINDGVTVTTGGIAGTVFNGKITLGSVNGNANVRFADGILSNSTSMIVTTKANNGTVTYLGGAYVGSIGASNTPVASVRFTGSGTGSDNGAVLQGNIYSQVIDFGTYDLDIVNSNVILGGGTTAINGAIDLCTNTLTFASGTSTLGNNTSIETTLTLADGNIGHIVIAEGARVNATTTGTTTINVQDKANANFSGTQTYTLIQGGARFNGTLGDPDFAVTGSNRFVNYGLIRAANQDYVITRTNNVENVVTNDIASSTFGGALGVGQNVTTFVNATNTAAYNNLLLAKNSADSANFVGSIVTDTSAAVTNVQLDVAKNIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDLVVYPEAHAFVVHKVNGRLSKTQSVLDGQVTPCISQSDRTAKTSYNLGLSASIRPDAKMEYGIGYDAQIASKYTAHQGTL

SEQ ID NO: 22188 - protein, 1613 aa, Rickettsia japonica
MGAAIQQNRTTNGVATTVDGVGFDQTVALANVAVAPNAVITANANNGINLNTPAGSFNGLFLNNANNLAVTVSEDTTLGFINNVANNANHFNLTLGAGKTLTITGQGITNVQAAATHNAQNIVAQFNGGAAIANNDLSGLGTIDFGAAASTLVFDLANPTTQKAPLILADNALIVNGANGTLNVTNGFIQVSDKSFATVKAINIGDGQGFMFNTNATNANALNLQAGGTTINFNGTDGTGRLVLLSKNGAATDFNVTGSLGGNLKGIIELNTVAINGQLIANAGPANAVIGTNNGAGRAAGFVVSVDNGKAATIDGQVYAKDMVIQSANANGQVNFRHIVDVGIDGTTAFKTAASKVAITQNSNFGTTDFGNLAAQITVPDTMTLTGNFTGDANNPGNTAGVITFDANGTLASASADANVAVTNNITAIEASGVGVVQLSGTHTAELRLGNAGSVFKLADGTVINGKVNQTVLVGGVLAAGAITLDGSATITGDIGNGGGGAALQSITLANDATKTLTLGGANIIGANGGTINFQANGGTIKLTSTQNNIVVDCDLAIATDQTGVVDASSLTNAQTLTISGTIGTIGANNKTLEQFNIGSSKTALNGGNVAINELVIGNNGSVQFAHNSYLITRTTNAAGQGKIIFHPVVHNNTTLAAGTNLGSAANPLAEINFGSKGGHADTVLNVGEGVNLYATNITTTDANVGSFVFNAGGKNIVSGTVGGQQGNKFNTVALDNGTTVKFLGNATFNGNTTIAANSTLQISGNYTADFIASADGTGIVEFVNTGPINVTLNKQAVPVNALKQITVSGPGNVVVNEIGNAGNYHGAMTDTIAFENSSLGAVLFLPSGIPFNDAGNIIPLTIKSTVGNETAEGFNVPSVIVSGVDSVIADGQVIGDQNNIVGLGLGSDNGIIVNATTLYAGIGTINNNQGTVTLSGGVPNTPGTVYGLGTGIGASQFKQVTFTTDYNNLGNIIATNTTINDGVTVTTGGIAGTDFDGKITLGSVNGNANVRFADGIFSNSTSMIVTTKANNGTVTYLGNAFVGNIGDSDTPVASVRFTGSNNGAGLKGNIYSQVIDFGTYNLGIVNSNVILGGSTTAINGKIDLLTNTLTFAGGTSTWGNNTAIETTLTLANGNIGHIVIAEGAQVNATTTGTTTINVQDNANANFSGTQTYTLIQGGARFNGTLGGPNFTVTGSNRFVNYGLIRAANQDYVITRTNNAENVVTNDIANSPFGGAPGIGQNVTTFVNATNTAAYNNLLLAKNSADSANFVGTIVTDTSAAITNAQLDVAKDIQAQLGNRLGALRYLGTPEMVGSEAGAIPAAVAAGDEAVDNVAYGIWAKPFYTDAHQSKKGGLAGYKAKTTGIVIGLDTLANNNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDFAVYPEVHAFVVHKVTGRLSKTQSVLDGQVTPCISQPDRTAKTSYNLGLSASIRSDAKMEYGIGYDAQIASKYTAHQGTL

SEQ ID NO: 22189 - protein, 1616 aa, Israeli tick typhus rickettsia
MGAAIQQNRTTNANATTVDGAGFDQTAVPANVAVPLNAVITANVHKGINLNTPAGSFNGLFLNTANNLAVTVSEDTTLGFITHVVNNANFFNLTLNAGKTLTITGQGITNVQAAATKNAQNVVVQVNNGAAIENNDLQGVGTIDFGAAASTLVFNLANPTTQKAPLILGDNAVIVNGANGTLNVTNGFIKVSSKSFATVNAINIGDGQGIIFNTDANNANALNLQAGGTTINFNGTDGTGRLVLVSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGTIDFQANGGTIKFTSTQDNIVVHFDLDIITDQTGVVDASSLTNAQTLTMNGKIGTIGANNKTLGQFNIGSSKTALSDGDVAINELVIGNNGAVQFAHNTYLITRITNAAGQGKIIFNPVVNNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIAANSTLQIGGNYTADFVASADGTGIVEFVNTDPITVTLNKQAAPVNALKQITVSGPGNVVINEIGNAGNYHGAVTDTIAFENSSLGTVVFLPRGIPFNDAGNIIPLTIKSTVGNKTATGFDVPSVIVLGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSDTPVASVRFTGSDGGAGLQGNIYSQVIDFGTYNLGILNSNVILGGGTTAINGKINLLTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAANFVGAIVTDTSAAITNAQLDVAKGIQDQLGNRLGALRYLGTPETAEMAGPEAGAIPAAVAAGDEAVDNVAYGIWAKPFYTDAHQSKQGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 22190 - protein, 844 aa, Rickettsia honei
MGAAAPLQAAGQQAVAATGAVAADAVDLDRIEVRAQLESQIRAVDLKRSSNAIEDAVSSDALGQYPDKNAAESLQRLPGISVTRDQGEGRYVVVRGLDANLNSVSVDGIAIGTPDNSSRAAPMDVIPSDSTERLRVVKSPTPDMPGDAIGGAILVETASAFDREGRSLRGKIEGSHQQLSGETSPKAAFNYSEVFNDTFGIAAGVNYQKRTFESDNSEVEYGDVSGNKDPTTTRPGEITALNLQNRKYEIERKRIGANLNFDWRPNEDSRYYLRTLYSQFDDAETRQRVIFNFNSADMIATGTDQYRLAGMPKDSIDKRMRYRTKEENTFAASLGGENKLTDAVLDYKIGYTRTEERVDDEIESRFKLNGKAFNGTLDQRSRLPTYTFDNDQWLDNANYKFDRVVAKPKRVDDEERSAQVNIRFDGDNSSYKFGLLGRWRDRDVNVDEASLRVGPAIKLSDWTTASPEHRHGPMGQGMDSPAMRSYWSQHGGEYSARPQDVGGNAATSLEGDYTAREDVFASYAMGTWDIGALRVIGGVRVENTRFSATGNRVDVAKDGRSYTATRVTASKSYNNVLPGLHLRYDASDDWVFRFAANKTVARPGFGDASPRIGLARNDNEVRLGNPELDPYESTNIDLSVEKYIGDSGILSLGVFHKSIDGYIVQVRQAGADGIYDGLPVVTSVNGDKAKVRGAEFNWQQQLSFLPAGWDGLLVGASGTWLDTDFDPGLAKRAGEDFTLPRASKNVYSAHIGYEKYGLSTRVAAVHRSEYLDTLGAGRAFDIYVAPNTQLDFSLDYRFTPRVSMYFEAQNLLDKPLELYQGTRSRTLQMEEYGRTYALGLKVAL

SEQ ID NO: 22191 - protein, 1611 aa, Rickettsia sp. Bar29
  misc_feature (501)..(501): Xaa can be any naturally occurring amino acid
MGAATQQNRTTNGAATTVDGAGFDQTVAPANVAVALNAVITANANNGINLNTPAGSFNGLFLDTANNLAVTVSADTTLGFITNAANNGNSFDLTLGAGKTLTITGQGITNAQAAVTKNAQNVVAQFNGGAAIANNDLSGVGTIDWGAADSTLVFNLANPTTQKAPLVLGNNAVIVNGVNGTLNVTNGFIQVSDKSFATVKAINIGDGQGFIFNTDATVGNALNLQAGGATINFNGTDGTGRLVLLSKNGAATDFNVTGSLGGNLKGIIAFNTVAVAGQLIANAGPANAVIGTNNGAGRAAGFVVSVDNGNAATIAGQVYAKDMVIQSANAGGQVNFRHIVDVGTDGTTAFKTAASKVAITQNSNFGTTDFGNLAAQITVPDTMTLTGNFTGDASNPGNTAGVITFAANGTLASASADANVAVTNNITAIEASGIGVVQLLGTHTAELRLGNAGSVFKLADGTVINGKVNQTAVVGGALAAGAITLDGSATITGDIGNGGGXAALQDITLANDATKTLTLGGANIIGANVGGTIGFQANGGTIKLTSTQNNILVDFDLDITTDQTGVVDASSLTNAQTLTISGTIGTIGANNKTLGQFNIGSSKTALNGGNVAINELVIGNNGSVQFAHNTYLITSTTNAADQGKIIFNPVVNNNTTLAAGTNLGSAANPLAEINFGSKGAYADTILNVGEGVNLYATNITTTDANVGSFVFNAGGANIVSGTVGGQQGNKFNTVALDNGTTVKFLDNATFNGETTIEANSTLQIGGNYTADFVASADGTGIVEFVNTGPITVTLNKQAAPVGYLKQITVSGPGNVVVNGIGNAGNNPGAATDTIAFENSSLGAALFLPSGIPFNDVTIKSTVGNKTATGFDVPKVIVLGVDSVIADGQVIGDQNNIVGLGLGSDNGIIVNATTLYAGIGTINNNQGTVTLSGGIPNTPGTVYGLGTGIGASQLKQVTFTTDYNNLGNIIATNATINDGVTVTTGGIAGTDFDGKITLGSVNGNANVRFADGIFSNSTSMIVTTKANNGTVTYLGNACVGNIGDSDAPVASVRFTGSDDGAGLQGNIYSQVIDFGTYDLNILNSNVILGGGTTAINNGAINLLTNTLTFASGTSTWGNNTSIKTTLTVANGNIGHIVIAEGAQVNATTTGTTTINVQDNANANFSGTQTYTLIQGGARFNGTLGGPNFAVTGSNRFVNYGLIRAANQDYVITRTNNAENVVTNDIANSSFGGAPGVGQNVTTFVNATNTAAYNNLLLAKNSADSANFVGAIVTDTSAAVTNAQLDVAKDIQSQLGNRLGTLRYLGTPETAEMAGPEAGAIPAAVAAGDEAVDNVAYGIWTKPFYTDAHQSKKGGLAGYKAKTTGVVIGLDTLANDNLMIGAAIGITKTDIKHQDYKKGDKTNVNGFSFSLYGAQQLVENFFAQGSAIFSLNQVKNKSQRYFFDANGNMSKQIAAGNYDNMTFGGNLTVGYDYNAMQGVLVTPMVGLSYLKSSDENYKETGTTVANKQVNNKFSDRTDLIVGAKVAGGTMNITNLAVYPEAHAFVVHKVNGRLSKTQSVLDGQVTPCISQPDRTAKTSYNLGLSASIRPDAKMEYGIGYDAQIASKYTAHQGT

SEQ ID NO: 22192 - protein, 1615 aa, Rickettsia australis
MGAATQQNRTTVGAATTVDGAGFDQTAAPANLAVAPNAVITANANNGINFNTPAGSFNGLFLDTANNLAATVSEDTTLGFITNAANNGNFFNFTLGAGKTLTITGQGITAGQAAATKNAQNAVAQVNGGNAIANNDLSGVGTIDFGAAPSTLVFNLTNPTTQRAPLILGDNAVIANGANGTLNVTNGFIQVSDETFATIKTINIGDGQGFIFNTDATAGNALNLQVGGATINFNGTDGTGRLVLLSNAAGGGATDFNVTGSLGGNLKGIIEFNTTAVAGQLIANAGPANAVIGTNNGAGRAAGFVVSVANGNAATVAGQVYAKDMVIQSTNAGGQVNFGHIVDVGTDGTTAFKTAATTVAITQNSNFGAVDFGNTASQITVPDTKVLTGNFTGDASNNGNTAGVITFAANGTLASGNADANVAVTNKITAIEAAGVGVVQLSGTHTAELRLGNAGSQFKLADGTIINGNVNQTVLVGNAALANGAIQLDGSATITGDIGNGAGNAAPIQGITLANDASKTLTLGGANIIGANAGGTIDFQANGGTVKLTSTQNNILVDFDLAITTDKTGVVDASSLINAQTLTISGNIGTIAANNKTLGQFNIGSSKTALNSGDVAINELVIGNNGSVQLAHNTYLITKTTNAANQGKIIFNPVVNDNTTLAAGTNLGSEANPLAEINFGSKGVNGDTILNVGQGVNLYATNITTTDANVGSFSFTVGGTNIVSGTVGGQQGNKFNTVELDNGTTAKFLGNAIFNGETTIEANSILQIGGNYTADKVESADGTGIVEFVNTTPITVTLNKQAGPVDDLKQITVSGRGNVVINEIGNAGNDHGAATDTISFENVSLGAALFLPNGIPLDGLTIKSTVGNETATGNFDVPRLIVSGVDSVIADGQAIGDQDNIVGLGLGSDNSITVNATKLYAGIGSVNNNQGTVTLSGGIPNTPGTIYGLGIENGSPKLKQVTFTTDYNNLGSIIATNATINDGVTVTTGGVAGTDFDGKITLGSVNGNANVRFVDGTFSDSTSMIVTTKANNGTVTYLGSALVGNIGSSDTPVASVKFIGSDDGAGLQGNIYSQVTDFGTYDLSVLNSNVILGGGTTAINGEIDLLTNTLTFASGTSTWGSNTSIETTLTVANGNIGHIVIAENAQVNATTTGTTTINVQDNANANFSDTQTYTLIQGGARFNGTLGGPNFAVTGSNRFVNYGLIRAANQDYVITRTNNAANVVTNDIANSPFASAPGVGQNVTTFVNSTNTAAYNNLLLAKNSADSANFVGAITTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFTFSLYGAQQLVENFFAQGSAIFSLNQVKNKSQRYFFDANGKMNKQIAAGNYDNMTFGGNLMVGYDYNAMQGVLVTPMAGLSYLKSSDENYKETGTTVANKQVNSKFSDRTDLIVGVKVAGGTMNITDLAVYPEAHAFVVHKVNGRLSKTQSQLDGQVTPFISQPDRTAKTSYNIGLSASIRPDAKMEYGIGYDFNAASKYTAHQGT

SEQ ID NO: 22193 - protein, 1612 aa, Astrakhan rickettsia
MGAAIQQNRTTNAVATTVDGAGFDQTAILANVAVPINAVITANVNQGINLNTPAGSFNGLFLNTANNLDVTVSEDTTLGFITHAVNNANHFKLMLNAGKTLTITGQGITNVQAAATKNAQNVVVQVNNGAAIDNNDLQGVGKIDFGAAASTLVFNLANPTTQKVPLILGDNAVIVNGANGTLNVTNGFIKVSSKSFATVNAINIGDGQGIMFNTDANNANALNLQANGATINFNGTDGTGRLVLLSKNAAATDFNVTGSLGGNLKGIIEFNTVAVNGQLKANAGPANAVIGTNNGAGRAAGFVVSVDNGKVATIDGQVYAKDMVIQSANAGGQVNFGHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNVGSVFKLADGTVINGKVNQTALVAGVLAAGTITLDGSATITGDIGNAGGAAALQGITLANDATKTLTLGGANIIGANGGTIDFQANGGTIKLTSTQNNIVVDFDLAITTDQTGVVDASSLTNAQTLTINGKIGTIGAHNKTLGQFNIGSSKTVLSDGDVAINELVIGNNGAVQFAHNTYLITRTTNAAGQGKIIFNPVVNNNTILATGTNLGSAANPLAEINFGSKGVNVDTVLNVGEGVNLYATNITTTDANVGSFIFNAGGTNIVSGTVGGQQGNKFNNVALNNGTTVKFLGNATFNGNTTIAANSTLQIGGNYTADFVASADGTGIVEFVNTGPITVTLNKQAAPVNALKQITVSGPGNVVINEVGNAGNYHGAVTDTIAFENSSLGAVVFLPRGIPFNDAGNIIPLTIKSTVGNKTATGFDVPSVIVLGVDSVIADGQVIGDQNNIVGLGLGSDNDIIVNATTLYAGIGTINDNQGTVTLSGGIPNTPGTVYGLGAGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSNTPVASVRFTGSAGGAGLQGNIYSQVIDFGTYNLGINSNVILGGGTTAINGKINLHTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANSANFVGAIVTDTSAAITNAQLDVAKDIQAQLGNRLGVLRSLGTAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLAKTQSVLDGQVTPCISQPDRTAKTSYNLGLSASISTDAKMEYGIGYDAQISSKYTAHQGTL

SEQ ID NO: 22194 - protein, 646 aa, Rickettsia akari
MVYTRYLRQTPWLPLYHDANSIQFVDTATYPNVQIGDYAIQRHFDNYDLFGDGSVLQDISNTSNTNPAAKVLERDRNDYKFKLAGLFYGEYKIIDGLRFRATLGGDYQNTFRNRWQGVRSNRNGASAASYFESNENRIHTLSEGYFTYDKAFGEHTFNVVLGASAEKWEWQGDSALGSGYTSDLVQTLSAATVLNEITSYKYEEGFSSFFARVNYSYEDKYLASLSFRRDGSSIFGVDNKYGNFPSASVGWVVSQEDFLSESELLSSLKLRASFGVTGNKDIDTGSNLTDLYPSISLLGTDNYNSQAAFVALNIANPELQWERLIEFNPGIDFGFFNNKITGSVDYYTRTSDQLLLFNPVASSTGFSAALENLGEVRNSGIELEVTSRNVSTEDFRWGTTLIASHNKNELLDFADSNGQIQNVDSKRAAEWINLVGNPISSYYGWVVDRDIPLEFINDPYHPAGGQAQDVYVKDLNGDGLIDDDDKTILGNPYPDLVWSITNNFRYKDFDLSFMFQGSHGAEIRNMGDQYLFNHFNSGQDFNTATTPDQGFIKEKIFTDAIIQDASYIALRNLTIGYNLPEDIANRFGASSFRLYATGQNLLYFTASDYTGFNPESINDTSATTYGYQRAGSPIFSTISLGLNLQF

SEQ ID NO: 22195 - protein, 1616 aa, Rickettsia africae
MGAAIQQNRTTNADATTVDGAGFDQTAVPANVAVPLNAVITANVHKGINLNTPAGSFNGLFLNTANNLAVTVSEDTTLGFITHVVNNANFFNLTLNAGKTLTITGQGITNVQAAATKNAQNVVVQVNNGAAIENNDLQGVGTIDFGAAASTLVFNLTNPTTQKAPLILGDNAVIVNGANGTLNVTNGFIKVSSKSFATVNAINIGDGQGIIFNTDANNANALNLQAGGTAINFNGTDGTGRLVLVSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGTIDFQANGGTIKFTSTQDNIVVHFDLAIITDQTGVVDASSLTNAQTLTINGKIGTIGANNKTLGQFNIGSSKTALSDGDVAINELVIGNNGAVQFAHNTYLITSTTNAAGQGKIIFNPVVNNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIAANSTLQIGGNYTADFVASADGTGIVEFVNTDPITVTLNKQAAPINALKQITVSGPGNVVINEIGNAGNYHGAVTDTIAFENSSLGTVVFLPRGIPFNDAGNIMPLTIKSTVGNKTATGFDVPSVIVLGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSDTPVASVRFTGSDGGAGLQGNIYSQVIDFGTYNLGILNSNVILGGGTTAINGKINLLTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSANAASFVGAIVTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIASGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTL

SEQ ID NO: 22196 - protein, 902 aa, Rickettsia aeschlimannii
MGAAPAQQAATLTGTVEDANGAPLPGANVVLLDSDYGTAAGADGSYSITGIDPGTYALRVTFVGYETIEGEIRFEPGEEATRTFALERAPLQGEGVTVTVGSRARDMAAEDMAVPVDVYGTEEIQTSGAFETGRILQQSAPSVNFPQNTLSDGMDALRSFTLRGLSPDQTLVLVNGKRRHKSALVNRLGAGVSGGSSPIDLNAIPANAIERIEVLRDGASSQYGSDAIAGVANLRLKDEPLDPTIETRIGGYATEPYPNDGTTYSVRPSFGVELGDDGGFLNFFGEYRLRTPTNRAGPANFNLGPAGQAGDEIADPDGDGLFDIVDKNNSVEQPAFHWGDGRSENLLFWANGAYPVANVNAEQPTEVYAFGGYSYRKGKGQGFYREGTDDGNWPQVHPEGFLPNFENPINDGSVVVGLRGMLDEWNYDLSAQTGFNYFQYNITNSLNASYGPSQEGNQTDFYAGAVQLQQTVVQLDVDRGLEVGLASPLNVAAGALFRADNYQLKAGEEASWAGFENPPWGINQNGGTPAPGAQVFPGFRPEQEVDETRTNIGTYVDLQADLIDPLQVNIAGRFENYSDFGSTVNGKVALRFEPVSQLAFRGTAQTGYRAPNQAQKFFSKVSTTFIDNQPVQTGIFRINSDVGNALGIPDLEEERSVNFSGGVIIEPVERFQVSVDYFNIQIDDRITLSGDLGEPGSPGEEAIKDVLSANNTGASTASFFSNAIDTKTEGVDVTSKFSALLADGIQLQLRGAFNWTDTEITGGPRNPTTLDEDFSTVILAPDDQRSLTEGALPETTTKLTASLTAGPVDLTLRGARYGELLNADNDADDQFTLDPEYVFGGELGYSMFDDQVNLAVGARNLFDNYPDLDPNKGTFDIILPYNRAHPMGFNGRFVYSRLTISL

SEQ ID NO: 22197 - protein, 185 aa, Wolbachia sp. wDry
SYYVRLQYNGEILPFYTKVDGITNATGKEKDSPLTRSFIAGGGAFGYKMDDIRVDVEGLYSQLAKDTDVVNTSEINVADSLTAISGLVNVYYDIAIEDMPITPYVGVGVGAAYISNPSKANEVKDQKGFGFAYQAKAGVSYDVTPEIKLFAGARYFGSYGASFDKATKDDTGIKNVVYSTFGAEV

SEQ ID NO: 22198 - protein, 187 aa, Wolbachia sp. wVes
SYYVRLQYNGEILPLYTKLDGIQNVEGKEKDSPLTRSFIAGSGAFGYKMDDIRVDVEGLYSQLAKDTAVLANSEINVNVADSLTAFSGLVNVYYDIAIEDMPITPYVGVGVGAAYISSPSKADAVKDQKGFGFAYQAKAGVSYDVTPEIKLFAGARYFGSYGASFNMLSESSVPIINVVYSTVGAEA

SEQ ID NO: 22199 - protein, 190 aa, Salmonella typhimurium
FLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAEAGVAFN

SEQ ID NO: 22200 - protein, 1081 aa, Bordetella bronchiseptica
MQVRGIGELRSRATDRAGRARRRILLSSLLASTALVAITMPASAQQVWVGTGQDYNTASNWSGPAAVPDTGSTAVFTNNGASTSVVLSVTRSPDGFTFDTGAPSYTIGVASGGQLNMSGAGIVNNSSNAQNFLIGPGSQIDFLGSSTAGNATITTLSGATLLFSRSSSGGTASIANDGTMVLRTDSGAISIGSLSGTGTVAATTVSGVPVQTLTVGSLNTSTEFSGTFVDNGAQFALGKTGTGTLTLTGDNFYTGGTTISSGTLQLGNGGISGSITGDITNNATLTVNRSNGTSLGGVISGSGQLVKLGGGILALLGNNTYTGGTTISAGTLRVGNGATSGSIVGDVVNNGVLQFNRFDSIGFNGVITGTGSVTKLGNNAMILGGDNTYTGGTTISGGYLQVGNGGTGGSIVGDVLNNGTLEFARSDAHTFSGAISGTGNLISFGGSAGSGVFTMTGTNTYTGGTTVSRGTLQIGDGGTSGSIVGDVTNNATLAFNRSDATSFGGAISGGGNLIKRGAGNLSLTGVSSYTGATTVEAGTLSVNGSIASSSLTTVNAGAALGGNGTVGTTLINGGALAPGNSIGTLNVSGNLTLTAASSYMLELSPSSADRVNVSGTATLGGATVKASFASGGYVERQYTLVNATGGVVGTFGTLVNTNLPSGFRSNLGYDSNNAYLNLVLDYTPGPSPDINSGLNRNQTEVANALSGYFARTGSIPIVFGALNPSGLSAVSGETATGAQQSTFSAMTQFLGVLTDPSSNGRGARDAAPGPLGFADRTPRGSASDAYAMITKSAAERFVPHWNVWGAGFGGSQTTDGNASLGSATATSRLAGIAAGADYWLSPQTVAGFAMAGGATQFGLAGGLGSGTSDLLQVGGFIRHSFGASYLTAAAAYGWQDITTERTVAIGGLNQLRANFNANAYSARVEAGHRWIAPAIGGVGLSPYAAAQVTAFDLPAYAEQAVGGTGVFALGYAAKTVTATRSELGVRTDKSFALDGALLTLRGRAAWAHDFDVDRSVAATFQALPGASFVVNGARPARDAALTTVSAEVSWLNGFSVAASFEGEFSDVTRSYAGKGLLRYAW

SEQ ID NO: 22201 - protein, 922 aa, Bordetella bronchiseptica
MNMSLSRIVKAAPLRRTTLAMALGALGAAPAAYADWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVFVFGANELTVDGGHITGGRAAGVAAMDGAIVHLQRATIRRGDAPAGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASGNTMLLVQTPRGSAATFTLANKDGKVDIGTYRYRLAANGNGQWSLVGAKAPPAPKPAPQPGPQPGPQPPQPPQPPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIANSGFYLDATLRASRLENDFKVAGSDGYAVKGKYRTHGVGVSLEAGRRFAHADGWFLEPQAELAVFRVGGGAYRAANGLRVRDEGGSSVLGRLGLEVGKRIELAGGRQVQPYIKASVLQEFDGAGTVRTNGIAHRTELRGTRAELGLGMAAALGRGHSLYASYEYSKGPKLAMPWTFHAGYRYSW

SEQ ID NO: 22202 - protein, 219 aa, Pseudomonas putida
MNPPFDKLGAGINTGAIRTAGGYLRYSDNGVSAGLGYLTAKLPAGTKMDALTVGGSYRSGPLYLNLGYGYNKRKDNFPAATAGGLTDAGLVNAYWATGANGGFSPGVFDMTNIPATAMGLADQANKRQMFKVGFGYQITPQVNAGLHYYHAKQSGSASGTYNGKANFFVAAVDYAFSKRTDAYFAVDYTKTSGGSGVVVDGSNLATKRTGITAGLRHRF

SEQ ID NO: 22203 - protein, 178 aa, Wolbachia endosymbiont
TSYYVRLQYNGEILPFYTKVDGIKNVTSKGEDSPLKRSFIAGGVAFGYKMDDIRVDVEGLYSRLAKNKAVIDASEANVADSLTAFSGLVNVYYDIVIEDMPITPYVGVGVGAAYISNPSNAADVKDQRRFGFAYQAKAGVSYDVAPEIKLFAGARYFGSYGASFDKAAKGDDGIKNVL

SEQ ID NO: 22204 - protein, 186 aa, Wolbachia endosymbiont
TSYYVRLQYNGEILPFRTKVDGIKNKSGREKDSPLTRSFIAGSGAFGYKMDDIRVDIEGLYSRLAKDTAVIDASEASLADSLTAFSGLVNVYYDIAIEDMPVTPYVGIGVGAAYISNLSSSADVKNQKRFGFAYQAKAGVSYDVTPEIKLFAGARYFGSYGAGFDKEGRNDNIIKNVLYSTVGAEA

SEQ ID NO: 22205 - protein, 186 aa, Wolbachia endosymbiont
TSYYVRLQYNGEILPFYTKVDGIKNATSKEKDSPLKRSFIAGGVAFGYKMDDIRVDVEGLYSRLAKNKAVIDASEANVADSLTAFSGLVNVYYDIVIEDMPITPYVGVGVGAAYISNPSNAADVKDQRRFGFAYQAKAGVSYDVAPEIKLFAGARYFGSYGASFDKAAKGDDGIKNILYNTFGAQA

SEQ ID NO: 22206 - protein, 188 aa, Wolbachia endosymbiont
TSYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 22207 - protein, 187 aa, Wolbachia sp. wrichteriA
SYYIRLQYNGEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPAVKLYAGARYFGSYGANFDKSGGEDKGGHTVLYSTVGAEA

SEQ ID NO: 22208 - protein, 963 aa, Pasteurella multocida
MRTTTIKFSAITLALLSYCGAILADSHQEATELDTITVSSQQDEMNIKEKKVGETVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYIQRSRGHDRSYSLQPQSNYFTYDEKESRHANDLTKRKNVSFTYENYSITPFWDTLKLSYSQQKIRTRARTEDYCDGNEKCDSYKNPLGLQLKDGKIVDPAGNQITLKGTGFNTEIVDKDGKPFPTTSGTNNAAFSNNLQLSPTGFWLDCTIFDCTKPFTVYNYKQNKYEPREVMLSEEITIDGKLYKTAKEESGVRNYLILPNSKGYLPYDYKERDLDSNTKQINLDLTKTFSTFNIENELLYGAIYSRTEKKMVNKAGYDGRNPTWWADRILGKSTNCNYNGLKCPRHEPLTSFLIPVEATTKSLYFSDNIKLHNMLSVDLGYRYDDIKYQPEYIPGVTPKIADDMVKGIFIPLPKGEKIKIGNYETTKPLTPEQIRKNAEENIAYIAQEKRFKKHSYSLGATFDPLNFLRVQVKYSKGFRAPTSDELYFTFKHPDFTILPNPVLKPEEAKNQEIALTVHDNWGFVSTSVFQTKYRHFIDLAYLGSRNLSNSVGGKAQARDFQVYQNVNVDNAKVKGVEINARLNLGYFWHVLDGFNTSYKFTYQRGRLDGDRPMNAIQPKASVFGLGYDHKENKFGADLYITRVSEKKAKDTYNMFYKEQGYKDSAIRWRSDDYTLIDAVGYIKPIKNLTLQFGVYNLTDRKYLTWESARSIKPFGTSNLINQKTGAGINRFYSPGRNFKLSAEITF

SEQ ID NO: 22209 - protein, 346 aa, Shigella flexneri
MKKTAIAIAVALAGFATVAQAAPKDNTWYTGAKLGWSQYHDTGFINNNGPTHENQLGAGAFGGYQVNPYVGFEMGYDWLGRMPYKGSVKNGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 22210 - protein, 355 aa, Salmonella typhimurium
MKKTAIAIAVALAGFATVAQAAPKDDTWYTGGKLGWSQYHDTGYYGNGYQNNNGPTHESQLGAGAFLGYQANQYLGFELGYDWLGRMPNKGSVTNGAFKAQGVQLAAKLSYPIADDLDVYTRLGGMVWRADSTQTNPTYGRISNHDTGVSPLAAVGVEYALTKNWATRLDYQWVNNIGDAGTVGTRPDNSMLSVGVSYRFGQDEAAPVVAPAPAPAPVVETKRFTLKSDVLFTFNKASLKPEGQQALDQLYTQLSNLDPKDGSVVVLGYTDRIGSEQYNQKLSEKRAQSVVDYLVSKGIPSSKISARGEGKSNPVTGNTCDSVKARKALIDCLGPDRRVEIEVKGIKDVVTQPQA

SEQ ID NO: 22211 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNFDGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 22212 - protein, 1040 aa, Escherichia coli
MKRHLNTCYRLVWNHITGAFVVASELARAQGKRGGVAVALSLAAVTSLPVLAADIVVHPGETVNGGTLVNHDNQFVSGTADGVTVSTGLSLGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKGKLQVNAGGKASDVTQNTGGALVTSTAATVTGTNRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGALTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFIQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRVRGWGWLGSLETGLPFSITDNLMLEPQLQYTWQGLSLDDGQDNASYVKFGHGSAQHVRAGFRLGSHHDMNFGKGTSSRDTLRGSAKHSVRELPVNWWVQPSVIRTFSSRGDMSMGTAAAGSNMTFSPSQNGTSLDLQAGLEARVRENITLGVQASYAHSINGSSAEGYNSQATLNVTF

SEQ ID NO: 22213 - protein, 270 aa, Escherichia coli
MTDINGNQVWGRYIHNEYRVDNGVNNPYKLKQNGFEYGIGKTFDINTDSLNTGISFGMTKNEIKEKSGSKSDVDSYSLGLYASYIKDNGFYLDALVKGNYFDSESSVRFNMNNIANTSFKQKGIGSAFEIGKQTNFNHSFITPYARIEYFSAKNNELKMTNGMKVKLGNDKSLKAEAGVKAGYTFDIGEKSTLTPYIKASFENEFINDNTVLINDTVKLKNDYSGSMGNYRVGLDARINKNTSLYTEVSYSKGSMIESPLNINAGVRVFF

SEQ ID NO: 22214 - protein, 293 aa, Ehrlichia chaffeensis
MNKKNKFFTISTAMVCLLLLPGISFSETINNSAKKQPGLYISGQYKPSVSVFSNFSVKETNVPTKQLIALKKDINSVAVGSNATTGISNPGNFTIPYTAEFQDNVANFNGAVGYSFPDSLRIEIEGFHEKFDVKNPGGYTQVKDAYRYFALARDLKDGFFEPKAEDTGVYHTVMKNDGLSILSTMVNVCYDFSVDELPVLPYICAGMGINAIEFFDALHVKFAYQGKLGISYQLFTKVNLFLDGYYHQVIGNQFKNLNVNHVYTLKESPKVTSAVATLDIAYFGGEVGIRFTF

SEQ ID NO: 22215 - protein, 279 aa, Ehrlichia chaffeensis
MSKKKFITIGTVLASLLSFLSIESFSAINHNHTGNNTSGIYITGQYRPGVSHFSNFSVKETNVDTIQLVGYKKSASSIDPNTYSNFQGPYTVTFQDNAASFSGAIGYSYPESLRLELEGSYEKFDVKDPKDYSAKDAFRFFALARNTSTTVPDAQKYTVMKNNGLSVASIMINGCYDLSFNNLVVSPYICAGIGEDFIEFFDTLHIKLAYQGKLGISYYFFPKINVFAGGYYHRVIGNKFKNLNVNHVVTLDEFPKATSAVATLNVAYFGGEAGVKFTF

SEQ ID NO: 22216 - protein, 351 aa, Ehrlichia chaffeensis
MSYAEGVKRFSVSAGWLHVMPQGKANPFNINTSVKNGTVAKVGSISPTSFLNSVDPNATEVDVGGEPFNQKEFLELALNDDFLKGLLLDEEGNIKPEVAGEATIQGLEQWHQNDAGLEVDDTDTLGLMFNYYLNDNVSLQFIGGIPPKVDIKGQGEILAPLSGVALSPHELVKILFPNGITLGQAVPITNLGNKPKAASVRAWTPAIEAQYQFGKSGVNKFRPYLGVGLMYAHFNDIKLNDEIRSDLISAGHMIQNVLDGKAGAALDRKESSGNMVVKVDADDAIAPIFTAGFTYDFNDSWYTVASVSYAKLNNRTKIDVINQNTGARLIHGSTKVDIDPIITYLGVGYRF

SEQ ID NO: 22217 - protein, 326 aa, Pseudomonas putida
MNNTKILIAICPLLPFFLQAAENNTNNFYIGAKAGWSKYQDACLYGYTKCEEDSLGYGLFVGYDFTDWFAIEGGVTNHNEVNSSYQNYDVEALAISSDLSTKFGYRLTDNVQLYTKVGISYQHINKTMSDLGDFSGSSFGGLVAMGIDYKLDNNWSLRGEYQFIDGIGDDTSLKADLHFTSVGIKYRFSSSKQKDIIPITQPKETVVSEIKKQPKLPKNIILFFDFDSSEILPTPLLHQITDQLAKFPKINISIIAHTDSEGSDLYNDKLAAKRALEVSKYFLHKNINKNRINVLSHGERLPTHDNETKKGRAKNRRVEITFSHNA

SEQ ID NO: 22218 - protein, 1144 aa, Pseudomonas stutzeri
MGRGGRDPPTGSLGRVRGCGMVTLGYETGRARGLARMKRLLMIGVSFAGLPVLAGAAYAQSVVPGFDANQLARNDDGSTGEVALPFTANFFGTTYSSLYVNNNGNVTFGTPLSTFTPVGLGANYRGAPIIAPFFSDVDTRNPASGITSYGTGTYAGQTAFGVTWPSVGYFSNHADKTNTFQLVLASRADTGGGNFDIYFNYQRIQFETGDASGGTNGLGGTSASAGYSAGTGAAGSYFELPGSLVNGALIDGGPNSLVAGSNNGVPGQFLFPVRNGVVMLANVCQPGDNASTTQIANCGPNRAYTGGIFYTPLDKFTLNVLDNTTIAGPQNAAAVLVMPTAATTGASPAGSVAINVNASATITAPGGAGIQIDSGSGTGAGSVTSAGTITAATAGIQADTNRGALTVANSGTITAPLGISGSSRTTTALSNSGTLNASYAGLVGGGFTGTVTLTNTGTVNYGQFGILGGSAVAPLVISNAGALTQSATASGPPATGLPTLIAGFLQTNANPSAIFARAGGAISIENGANGTIAGANGIDAAVLSSVPGLPATGAATGPLTITNLGTIDVQGAAITTAASAVASQVTNAGTLTGSLALSSGSTFTNTASGRVNVTGASSFGGGTITNAGGISLASTSLQNLSGFQNQGSGLLIATGTSSIGSQTQGTSFVNAGTISLVNGRAGDTLTINGNYVGQNGRLLAEFNTQTSTGDRLIINGNASGTTGVTVTNLTGAVPFTTGSPIVTVTGTSAANAFTLAGAQNFGTLEAILVATTGQGGTSVALGTVPTAVGLSASTAVIAARTIAFQGGSAVLDRLTQVRDSLKAAPGQTAIPQAMQYNGLSAYSALVTKDPIAPKLAEPAPQTTTRPAIWARAYGDIESRSGFSNFSFGGLNFTRDLGYSQVSGGFLGGTDVVISGLTKPDDGLILGVMGGYTLAGVDLNRNAGRQDYEGGTVGVYGTYLNGPWFWDALFKVDLLGLDIRAPGVVQRTGLQNYNFTTNVGYRVPLEHNIYVEPTAGLEYVSTVFDRTPALAVGAVPLRDGEALRGRIGARIGTEMVEDNIRIEPSITGYVYSVLTETGTVGAFNGITGVTGLREEGKVRGEVQASINFFNLKTGLSGFIRGDYRIGGDLVGGGGRAGIRYQFSTF

SEQ ID NO: 22219 - protein, 687 aa, Vibrio vulnificus
MAALRPARTSVAEKKIFKLHALSAVVMGLCASGQAYAQTENTNSNKKEEMPVVVVIGEKTERTIYDTSSSVQVFDQETIDNTPGATEIDDLLQLIPNMVDSGQGNSMPTVRGIDGSGPSIGGLASFAGTSPRLNMSIDGRSLTYSEIAFGPRSLWDMQQVEVYLGPQSYIQGRNASAGAIVMKTNDPTHHFESAVKAGVGERNYSQTAAMISAPIIQDELAFRLSFDQQKRDSFVDLASYEPAGDAKKIEMNSVRGKLLYEPSALAGFKTTLGVSHMDSRGPQSESTNVVGNEAFRPVYETKSLSTAWDISWQLNEVLTFENNLVYSKFAFERYTNPLQKGDYTAEGKEFHVEPLLRYLSLGGRVNALVGARYYKSSQDDEYVDATSANPMSGSTKTQSAFAELTYALTQSIDVTVAGRYEKERVKRKVSDPRFKLDHDDTLSVFLPKFDIAFKPDMAQTFGFKVAKGYNSGGAGLAFNPILGGGFSPYQFEEEYIWNYEFYTRHRLGNSVELMTNTFYNDFDNMQMTQTLSNGDVLIANLDNAKTYGAEIGTRWYATDSLELFANLGLLKTEYKEVNGTSKELERAPNMTGNLGGQYSFFDGFELSANAAYTGDYFSDRSNTEIVKIDAYWVANAQLAYVFENGRAALFATNLFDSDKTTLYARGSLNEPLKQQPRMIGASLQLNF

SEQ ID NO: 22220 - protein, 1335 aa, Enterobacteria phage P-EibC
MNRIYSLRMNDRKELVAVAETAGGRKKSSGIPGAGMLSRLLLASGAVAGVLFSYPSLASVVGNTLPWQTYRDFAENKGAFHAGATNIPLYGRNGAVGGRLDKAPMMDFSVVDQILGVATLISPQYVAGVKHNGSYNTVRFGYADDTTYRLVDRNEHWRDFHTPRLNKLVTEVAPVSVTDAGTGKGVYQNRSRYPVFYRMGSGTQYTGAASGALTRIAGAYAWKTGGTVGSPLISDWSLVSNPGYLYQSVNGPLASYGTPGDSGSPLFAWDAVKKQWVLVAVLNGYAGEKGKTNWFTVIPAGDVNNTIKQDSSGTVVPAVAGGDIVWNYSKGSGEGTLSQDGKVWKMNGFRGGSLNDGKDITFGGKGTVVLKDDVVQGAGSLTFNGDYTVRPEGNQTWVGGGIIVNDGHRVDWMVNGLAGDALHKTGKGTLVVAGSGENPGTLNTGDGTVILAQKADAAGRVRAFSEVRIVSGRPVVVLQDSHQIEGDRIRWGYRGGTLDINGNDMTFHRLAAADEGAVLTSRAGSATVRLDFSPSGQKAVMWHGHFTGNLSVLNNTSSAVDFIMDGGADMSGSFTQQGGGLYIQGHPVVHAVSSEAVAAALRKQGDNSVLTRPVSFTQKDWESRTFSIGQLKLKEASFSLSRNATLTGDIDADNATMVLGSDSLYLDMKDGTGSSSAPVKGTSAAGGASGTSTFRGNVNMRHSSLTVRDHFTGSITASDSRIAVSSENVRLEGDSRLTSSALTVSDGGRLHVKGGLETDGGVTLDGGTLLVDGGSVRNDVYERLLAWSEERGGLNGSGEYDFMTGAAGLLRGYVRGSAGNVNLQNAAWMMTGNSSVKHLESSGSALYFSRPGGEFHTLTAGSMDISDSVLVMRTDLHHSDQLRVTESLRGKNNLLLVDFTERSDGQKALNIPLVTAPAGTGADVFSVKTRDTGFSHITPVVRAEQGTGGTAWQLNVVQPETVAEPVVDEVSRPSLPVVMRQDVKTPNPVEAVSPVPSPAPAASVTDVPTGENTGESGEYRDETRWLLTGYRSTVNASAVRDAGMLMSMGHRNFINEVNNLNKRMGDLRDINGEAGAWARIMSGTGSAGGGFSDNYTHVQVGADKKHELDGLDLFTGVTMTYTDSNAGSDTFSGKTKSVGAGLYASALFDSGAYIDLIGKYVHHDNEYTATFAGLGTKDYSSHSWYAGAEVGYRYHVTEDAWIEPQAELVYGAVSGKQFSWKDQGMSLSMKDKDYNPLIGRTGVDVGKSFSGKDWKVTARAGLGYQFDLLANGETVLRDASGEKRIKGEKDGRMLMSVGLNAEVRDNIRFGLEFEKSAFGKYNVDNAVNAGFRYSF

SEQ ID NO: 22221 - protein, 1626 aa, Enterobacterial phage P-EibA
MNRIYRVIWNCTLQVFQACSELTRRVGKTSTVNLRKSSGLTTKFSRLTLGVLLALSGSASGASLEVDNGQITNINTDVAYDAYLVGWYGTGVLNILAGGNASLTTITTSVIGGNEDSEGTVNVLGGTWRLYDSGNNARPLNVGQSGTGTLNIKQKGHVDGGYLRIGSSTGGVGTVNVEGEDSVLTTELFEIGSYGTGSLNITDKGYVTSSIVATVGYQANSNGKVVVEKGGEWLIKNNDSSIEFQIGNQGTGEATIREGGLITAENTIIGGNATGIGTLNVQDQDSVITVRRLYNGYFGNGKVNISNNGLINNKEYSLVGVQDGSHGVVNVTDKGHWNFLGTGEAFRYIYIGDAGDGELNVSSEGKVDSGIITAGMKETGTGNITVKDKNSVITNLGTNLGYDGHGEMNISNEGLVVSNGGSSLGYGETGIGKVSITTGGMWEVNKNVYTTIGVAGVGNLNISDGGKFVSQNITFLGDKASGIGTLNLMDATSSFDTVGINVGNFGSGIVNVSNGATLNSTGYGFIGGNASGKGIVNISTDSLWNLKTSSTNAQLLQVGVLGTGELNITTGGIVKARDTQIALNDKSKGDVRVDGQNSLLETFNMNVGTTGTGTLTLTNNGTLNVEGGEVYLGVFEPAVGTLNIGAAHGEVAADAGFITNATKVEFGLGEGVFVFNHTNNSDAGYQVDMLITGDDKDGKVMHDAGHTVFNAGNTYSGKTLVNDGLLTIASHTADGVTGMGSSEVTIASPGTLDILASTNSAGDYTLTNALKGDGLMRVQLSSSDKMFGFTHATGTEFAGVAQLKDSTFTLERDNTAALTHAMLQSDIENTTSVNVGEQSIGGLAMNGGTLIFDTDIPAATLAEGYISVDTLVVGASDYTWKGRNYQVNGTGDVLIDVPKPWNDPMANNPLTTLNLLEHDDNHVGVQLVKAQTVIGSGGSLTLRDLQGDEVEADKTLHIAQNGTVVAEGDYGFRLTTAPGDGLYVNYGLKALNIHGGQKLTLAEHGGAYGATADMSAKIGGEGDLAINTVRQVSLSNGQNDYQGATYVQMGTLRTDADGALGNTRELNISNAAIVDLNGSTQTVETFTGQMGSTVLFKEGSLTVNKGGISQGELTGGGNLNVTGGTLAIEGLNARYNALTSVSPNAEVSLDNTQGLGRGNIANDGLLTLKNVTGELRNSISGKGIVSATARTDVELDGDNSRFVGQFNIDTGSALSVNEQKNLGDASVINNGLLTIATERSWAMTHSISGSGDVTKLGTGILTLNKDSAAYQGTTDIVGGEIAFGSDSAINMASQHINIHNSGVMSGNVTTAGDVNVMPGGTLRVAKTTVGGNLENGGTVQMNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPADTPDPINNPPVVDPEGPSVYRPEAGSYISNIAAANSLFSHRLHDRLGEPQYTDSLRVQDSATSMWMRHVGGHERFRTGDGQLNTQANRYVLQLGGDLAQWSSTQDRWHLGVMAGYANQHSNTQSNHVGYKSDGRISGYSAGLYATWYQNDANITTLACGGMSVCN

SEQ ID NO: 22222 - protein, 166 aa, Enterobacterial phage P-EibA
MRKLCAVILSAVVWLVAAGTPASAAEHQSTLSAGYLQTHTDMPGSDDLKGINVKYRYEFTDTLGLVTSFSYTNAKDEQKTHYSDTRWHEDSVRNRWFSMMAGPSVRVNEWFSAYAMAGVAYSRVSTFSGDYLRVTDNKGKTHDVLTGSDGGRHSNTVSGVGGWRAV

SEQ ID NO: 22223 - protein, 339 aa, Aeromonas hydrophila
MMKMAPSLIAIAMAAMGATAAHAADDIYFGAGAGAAHFNGLNKIEGVKNGEENAAAANAFVGYNFNENFGSELGYLYTGRGNTDGNRYENQGATLSGIARLPLGGDFSAFAEGGAYWAHTDGMGTSDTKVSPLAGLGVTYQVNDALDLQARYRYMWDVADLHADNVRYKSNQSVATLEAVYHPFRSSYVAPAPAPVVVEEAPAPAPIVEKNFALNSDVLFAFGKDSLKAEGVEALNSLYQQIVDFQPKDGSAVVVGYTDRIGSDAYNQKLSEARARTVANFLVSKGMAASKVAVEGRGEANPVTGNKCDGVKAKAQLISCLAPDRRVEIRVSGVQVVQQ

SEQ ID NO: 22224 - protein, 892 aa, Azospirillum irakense
MRKSNPDFHHIRSYILMCVVSLTFSTIYAQTPEPKLTLKLQNTSLSEVIRQIEQDTGFSFIYGEEVKLDHKVSLNVQKKPLREVLNLLFANKPISYKITGKHILLQKTSPKPVSRKFTVSGYVTDGASAETLIGANILESRHHQGTTTNPYGFYSITLPEGEARLSFSYLGYTGQQHVLNLTADTLLNIRMKDNNMLQEVVIVSDKAESGVMATQMGASEIPMTQIKNTPSILGEADVMKAIQLMPGVQAGMEGSAGLYVRGGGPDQNLILLDGVPVYNVDHLLGFFSVFTPEAVKKVTLFKSSFPARFGGRLSSVIDVRTNDGDMKNYHGVVSVGLLTSKINFEGPIIKNRTSFNISARRSYIDLLAKPFMPKDEKYSYYFFDVNAKINHKFSDRSRLFLSAYNGKDHFMTKYDDTYYDDEDKYRDGGKMNWGNTIVSGRWNYIFNNKLFSNTTVAFNNYKFDVSTFTKNEIHTNNQITWNRYKADYKSGIRDWSAQIDFDYNPIPTHHVKFGVQYLHHSFRPEVSTSKIFDKTGETIERDTTYYTTSNSEILAHEASAYLEDNFNLSSRLHMNLGLHFSTFQVQKKNYFSVQPRISARYQLSKDVVLKASYTKMSQYVHLISSMPFAMPTDLWVPVTSKIKPMQAHQVSLGGYYTGIDGWEFSIEGYYKGMKNVLEYKDGVSFLGSSTGWEDKVEMGHGRSMGVEFMAQKTIGKTTGWLAYTLAKSDRKFATGGINNGERFPYKYDRRHNIDLTLNHRFNERIDVSASWIFTTGGTTTIPTELTGIIRPGDNDSSIEEGDYVKHRNNYRLPATHRLNVGVNFSKKTKHGMRIWNVSIYNVYNAMNPTLIYRTYKKTEYTQGEQAQGNRIPVIRKFTLLPCIPSFSYTYKF

SEQ ID NO: 22225 - protein, 1060 aa, Rickettsia sp. IRS 4
ITLKAGGSLAANNIDFGARSTLEFNGPLDGGGNTIPYYFKGAIANGNNAILNVNTKSLTAYHSTIGTVAEINIGAGNLFAIDASAGDVTILNAQNINFGALDSALVLSNLTGVGAKNILLAADLVAPGADEGNVVFDGGVNGLNIGSNVAGAARNIGDGGGNKFNTLFIYNAVTITDDVNLEGIQNVRIENNADFTSSTAFNAGIIQINDATYTIDANNGNLNIPAGNIQFAHADAQLILQNSSGNDRTITLGANIDPDNDNEGVVILNSVTAGKKLTIAGGKTFGGAHKLQTIVFKGAGDCSAAGTTFNTTNIELDITGKLELGATKANVVLFNDAVQLTQTGHIGGFLDFNAKNGTVTLNNNVSVAGAVQNTGGTNNGTLIVLGASNLNRVNGIAMLKVGAGNVTIAKGGNVKIGEIQGTGTNTLTLPANFNLTGSINKTGGQALKLNFTNGGSVKGVVGTAANSVGDITTAGATSFASSVNAKGTATLGGTTSFANTFTNTGAVTLAKGSITSFAKNVTATSFVANSATINFGNSLAFNSNITGSGTTITLGANHVTYTGTGSFTDTLTLNTTFDGAAKSGGNILIKSGSTLDLSGVSTLALVVTATNFDMNNISPDTKYTVISAETAGDLKPTPKENVKITINNDNRFVDFTFDASTLTLFAEDIAADVIDEDFAPGGPLANIPNAANIKKSLELMEDAPNGSDARQAFNNFGLMTPLQEADATTHLIQDVVKPSDTIAAVNNQVVASNISSNITALNARMDKVQVVNKGPVPSGDEDMDAKFGAWISPFVGNAKQKMCNNISGYKSDTTGGTIGFDGFVSDDLALGLAYTRSDTDIKLKNNKTGDKNKVESNIYSLYGLYNVPYENLFVEAIASYSDNKIRSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 22226 - protein, 1055 aa, Rickettsia sp. IRS3
ITLQAGGNLITNNINFGAGSTLEFNGPLDGGGNIITYGFKGAIVNGNNATLNVNTKLLIAYDATAGTIATINIKADNNFAFDASAGDVTILNGQAIVFEDANSILTLSNLTGGGVNNILLAADLAAPGANEGQLIFDGGVNGLNIGSNVAGTVRNIGNAGGNKFENLFINHVVTITDDVNLGIHDLVINDNADFTSSTAFNADAIQINNATYRIDANGGDLNVPAANIEFAHADAELVLQNSSNANDRTITLGADIDPNNDDEGIVTLNSVNAGRKLTIDGGVTFGRAKRLQAIKFQGAGNLGTVGITFNTANIELDTTGVLELGATTANVTLINDAVQLTQTGNIGGFLDFNAKNGTVTLNNNVNVAGAVQNTGGTNGTLIALGASNLNSVNGIAMLKVGAGAVSIIKGGNTSITEIQGNGTALLTLPANFNLTGSINKTGGQALKLNFTNGGSVSGVVGTAANSVGDITTAGATSFASSVNAKGTATLSGTTSFADTFTNTGAVTLAKGSITNFAKNVTATSFAANGATINFGNSLAFNSNITGSGTTLTLGANQVTYTGTGSFTDMLTLNTTFDGAAKSGGNILIKSGSTLDLSGVSTLALVVTATNFDINNIDPNTKYTVISAETAGGLKPTPADNVKVTVNNDNRFVNFTFDASTLTLFAKDVSQEVIDNNFKPGGPLTNIPNAANVKKSLELMEQAQIGSDARLAFGNWGKLTPIQEADAVTHLMQDVVKPSDTITAINNQVILSNISSSLINLNARMDAIQPVAVAAGDEDRDAKFGAWISPFVGNATQKMRNNISGYKSDTTGGTIGFDGLVNDDLALGLAYTRADTDIKLKNNKTGDNKVESNIYSVYGLYNVPYENLFVEAIASYSDNKIRSKSRRVIATALATTAYQTANGKYKSESYTGQLMAGYTYAMPENINLTPLAGLRYSTIKDKGYKETGTTYQNLTVKGKNYNTFDGLLGAKVSSNINVGEVVLTPELYAMVDYAFKNKVPAIDARLQGMTAPFPTNSFKQSKTSFNVGVGITAKHKMMEYGINYDTNIGSKYFAQQ

SEQ ID NO: 22227 - protein, 1060 aa, Rickettsia sp. DnS28
ITLQAGGSLAANNIDFGVGSTLEFNGPLDGGGNTIPYYFKGAIANGNNAILNVNTKSLTAYHSTIGTVAEINIGAGNLFAIDASAGDVTILNAQDINFGAPDSTLALSNLTGVGVKNILLAADLVAPGANAGDVVFDGGVNGLNIGSNVAGTARNIGDGGGNKFNTLLIYNAVTITDDVNLEGIQNVLINNNADFTSSTAFNAGAIQINDATYTIDANNGNLNVPAGNIQFAHADAKLILQNSSGNDRTITLGANIDPDNDYEGIVTLNSVTAGKKLTIAGGKTLGGAHKLQAIVFKGAGDFSAAGTTFNTTNVVLDTTGQLELGATTANVVLLNDAVQLTQTGNIGGFLDFNAKNGTVTLNNNVNVAGAVQNTGGTNSGTLIVLGASNLNSVNGIAMLKVGAGNVTIAKGGDVKIGEIQGTGINTLTLSANFNLTGSINKTGGQALKLNFTNGGSVSGVVGTAANSVGDITTAGATSFASSVNAKGTATLGGTTSFADTFTNTGAVTLAKGSITNFAKNVTATSFVANSATINFGNSLAFNSNITGSGTTLTLGANQVKYTGTGSFTDMLTLNTTFDGAVKSGGNILIKSGNTLDLSGVSTLALVVTATNFDINNISPDTKYTVISAETAGGLKPTTEENVKITINNDNRFVDFTFDASTLTLFAEDIATDVIDEDFEPGGPLANIPNAANIKKSLELMEDAPNGSDARQAFNNFGLMTPLQEADATTHLMQDVVKPSDTIAAVNNQVVASNISSNITALNARMDKVQAANKGPVSSGDEDMDAKFGAWISPFVGNATQKMCNNISGYKSDTTGGTIGFDGLVSDDLVLGLAYTRADTDIKLKNNKTGDKNKVESNIYSLYGLYNVPYENLFVEAIAFYSDNKIRSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVPAIDARLQGMTAPLPTNSFKQSKTSFDVGVGVTAKHKMMEYGINYDTNIGSKYFAQQ

SEQ ID NO: 22228 - protein, 1291 aa, Helicobacter pylori
MELQQTHRKINRPLVSLALVGLLVSITPQKSHAAFFTTVIIPAIVGGIATGAAAGTVSGFLAGGLKQAEEANKTPDKPDKVWRIQAGRGFNEFPNKEYDLYKSLLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKAGSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLNVGNAAVMSFNNDIDSATGFYKPLIKINSAQDLIKNKEHVLLKAKIIGYDNVSLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFARYALIKNAPFAQTNATPNLVAINKHNFGTIESVFELANRSKDIDTLYAHSGTQGRDLLQTLLIDSHNAGYARTMIDATSANEITKQLNEANSALNNIASLEHKTSGLQTLSLSNAMILNSRLVNLSRRHTNNIDSFAQRLQALKDQRFASLESAAEVLYQFAPKYEKPTNVWANAIGGASLNGGGNTSLYGTSAGVDAYLNGEVEAIVGGFGSYGYSSFNNQANSLNSGANNANFGVYSRIFANRHEFDFEAQGALGSDQSSLNFKSALLRDLNQSYNYLAYGASTRASYGYDFAFFRNALVLKPSVGVSYNHLGSTNFESNSTHKTALKNGASSQHLFNASANVEARYYYGDTSYFYMNAGVLQEFAHVGSNNAASLNTFKVNATHNPLNTHARVMMGGELKLAKEVFLNLGFIYLHNLISNAGYFASNLGMRYSF

SEQ ID NO: 22229 - protein, 1313 aa, Helicobacter pylori
MELQQTHRKINRPIISLALVGALMGTELGANTPNDPIHSESRAFFMTVIIPAIVGGIATGTAVGTVSGLLEWGLKQAEQANKTPDKPDKVWRIQAGRGRGFNNFPNKQYDLYKSLLSSKIDGGWDWGNAARHYWVKDGQWNKLEVDMQDAVGTYNLSGLINFTGGDLDVNMQKATLRLGQFNGNSFTSYKDSADRTTRVNFDAKNILIDNFVEINNRVGSGAGRKASSTVLTLKSSEKITSRENAEISLYDGATLNLVSSSNQSVDLWGKVWMGRLQYVGAYLAPSYSTINTSKVQGEMNFRHLAVGDQNAAQAGIIASNKTNIGTLDLWQSAGLSIIAPPEGGYKDKPNNTPSQSNPKNDTQKTETEPTQVVDGPFAGGKDTVVNIFHLNTKADGTLKVGGFKASLSTNAAHLNIGEGGINLSNQASGRSLLVENLTGNITVEGTLRVNNQVGGAAIAGSSANFEFKAGEDTNNATATFNNDIHLGKAVNLRVDAHTGNFNGNIYLGKSTNLRVNGHTAHFKNIDASKSDNGLNTSSLDFSGVTDKVNINKLTTSATNVNIKNFDIKELVVTTRVQSFGQYTIFGENIGDKSRIGVVSLQTGYSPAYSGGVTFKSGKKLVIDEIYHAPWNYFDARNITDVEVNKRILFGAPGNIAGKTGLMFNNLTLNSNASMDYGKDLDLTIQGHFTNNQGTMNLFVQDGRVATLNAGHQASMMFNNVVDSATGFYKPLIKINDAQNLTKNKEHVLVRARNIDYNLVGVQGTSYDSISSSNTNLQESFKERLALYNNNNRMDICVVRKDNLNDIKACGMAIGNQSMVNNPESYKYLEGKAWKNTGINKTANNTTIAVNLGNNSTPTSSESNTTNLPTNTTNNARFASYALIKNAPFAHSATPNLVAINQHDFGTIESVFELADRSKDIDTLYTHSGVQGRDLLQTLLIDSHDAGYARTMIDATNTSEIAQSLNAATDALNNVASLEHKTSGLQTLSLSNAMILNSRLVNLSRKHTNHINSFAQRLQALKGQRFASLESAAEVLYQFAPKYEKPTNVWANAIGGASLNSGGNASLYGTSAGVDAYLNGEVEAIVGGFGSYGYSSFSNQANSLNSGANNANFGVYSRIFANQHEFDFEAQGALGSDQSSLNFKSALLQDLNQSYNYLAYSAATRASYGYDFAFFRNALVLKPSVGVSYNHLGSTNFKSNSQLVALKNGASSQHLFNANANVEARYYYGDTSYFYMNAGVLQEFARFGSNNAASLNTFKINAARNPLNTHARVMMGGELELAKEVFLNLGVVYLHNLISNASHFASNLGMRYSF

SEQ ID NO: 22230 - protein, 1324 aa, Helicobacter pylori
MELQQTHRKINRPLVSLALVGALVSITPQQSHAAFFTTVIIPAIVGGIATGAAVGTVSGLLGWGLKQAEEANKTPDKPDKVWCIQAGRGFNEFPNKEYDLYKSLLSIKIDGGWDWGNAARHYWVKGGQWNKLEVDMKDAVGTYKLSGLKNFTGGDLDVNMQKATLRLGQFNGNSFTSFKDSADRTTRVDFNAKNISIDNFLESNNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAANLNIGKGGINLSNQASGRSLLVENLTGNITVDGALMVNKEAGGAALPGSSANFEFKAGVDTKNGTATFNNDIHLGKAVNLKVDAHTINFNGNMYLGRFTHLKVNGHTANFKDIDASKGRNGIDTTILDFSGVTNKVNINKLTTAATNAAIKNFDIKELVVTTNVLSVGKYTDFTEDIGDQSHIGIVRLQMGYSPAYSGGVNFKSGKKLVIDEIYHAPWNYFDARNITDVEINKKILFGAPGYIAGKTGLMFNNLTLNSNASMDYGKDLDLTIQGHFTNNQGTMNLFVQDGRVATLNAGHQASMMFNNLVDSATGFYKPLIKINNAQNLTKNKEHVLVRARNIDYNLVGVQGASYDNIFASNTNLQEQFKERLALYNNNNRMDICVVRNTNDIKACGMAIGNQSMVNNPENYKYLEGKAWKNTGINKTADNTTIAVNLGNNSAPTENGGNTTNLPTNTTNNARFARFARYALIKNAPFAHYSATPNLVAINKHDFGTIESVFELANRSKDIDTLYAHSGAQGRDLLQTLLIDSHNAGYARTMIDATSANEITKQLNEANSALNNIASLEHKTSGLQTLSLSNAMILNSRLVNLSRRHTNNIDSFAQRLQALKDQRFASLESAAQVLYQFAPKYEKPTNVWANAIGGASLNSGGNTSLYGTSAGVDAYLNEKVEAIVGGFGSYGYSSFNNQANSLNFGANNANFGVYSRIFANRHEFDFEAQGAVGSDQSSLNFKSALLRDLNQSYNYLAYGATTRASYGYDFAFFRNAIVLKPSVGVRYNHLGSTNFESNSTHKTALKNGASSQHLFNASANVEARYYYGDTSYFYMNAGVLQEFANFGSSNAVSLNTFKVNAARNPLNTHARVMMGGELQLAKEVFLNLGFIYLHNLISNAGYFASNLGMRYSF

SEQ ID NO: 22231 - protein, 1324 aa, Helicobacter pylori
MELQQTHRKINRPLVSLALVGALVSITPQQSHAAFFTTVIIPAIVGGIATGAAVGTVSGLLGWGLKQAEEANKTPDKPDKVWCIQAGRGFNEFPNKEYDLYKSLLSIKFDGGWDWGNAARHYWVKGGQWNKLEVDMKDAVGTYKLSGLKNFTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTHIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIRVGGYTASLTTNAAHLNIGKGGINLSNQASGRSLLVENLTGNITVDGALMVNKEAGGAALPGSSANFEFKAGVDTKNGTATFNNDIHLGKAVNLKVDAHTINFNGNMYLGRFTHLKVNGHTANFKDIDASKGRNGIDTTILDFSGVTNKVNINKLTTAATNAAIKNFDIKELVVTTNVLSVGKYTDFTEDIGDQSHIGIVSLQTGYSPAYSGGVNFLKSGKKLVIDEIYHAPWNYFDARNVTDVEINKKILFGAPGYIAGKTGLMFNNLTLNSNASMDYGKDLDLTIQGHFTNNQGTMNLFVQDGRVATLNAGHQASMMFNNMIDNTTGFYKPLIKINNAQNLTKNKEHVLVRARNIDYNLVGVQGASYDNIFASNTNLQEQFKERLALYNNNNRMDICVVRKNNTDDIKACGMAIGNQSMVNNPDNYKYLEGKAWKNTGINKTANNTTIAVNVGNNSTPTSSESNTTNLPTNATKNARFARYALIKNAPFAHYSATPNLVAINKHDFGTIESVFELANRSKVIDTLYAHSGAQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTHKTALKNGASSQHLFNASANVEARYYYGDTSYFYMNAGVLQEFANFGSSNAVSLNTFKVNVARNPLNTHARVMMGGELKLAKEVFLNLGFIYLHNLISNAGHFASNLGMRYSF

SEQ ID NO: 22232 - protein, 1291 aa, Helicobacter pylori
MELQQTHRKINRPLVSLALVGALVSITPQQSHAAFFTTVIIPASVGGIATGAAVGTVSGLLGWGLKQAEEANKTPDKPDKVWRIQAGRGFNEFPNKEYDLYQALLSSKIDGGWDWGNAARHYWVKGGQWNKLEVDMKDAVGTYKLSGLRNFTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVVGEVNFNHLTVGDRNAAQAGIIASKKTYIGTLDLWQSAGLNIIAPPEGGYKDKPNNTNSQSGAKSDKNESAKNDKQDSNTQVINPPNSGQKTEIQPTQVIDGPFAGAKDTVVNINRINTNADGTIRVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLNVGNAAVMSFNNEIDSATGFYKPLIKINSAQDLIKNKEHVLLKAKIIGYENASLGTNSISNAKLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFARYALIKNAPFAQASATPNLVAINKHDFGTIESVFELANRSEDIDTLYAHSGAKGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSCGNTSLYGTSAGVDAYLNEKVEAIVGGFGSYGYSSFNNQANSLNSGANNANFGVYSRIFANRHEFDFEAQGALGSDQSSLNFKGALLRDLNQSYNYLAYGASARASYGYDFAFFRNALVLKPSVGVSYNHLGSTNFESNSTNKTALKNGASSQHLFNASANVEARYYYGDTSYFYMNAGVLQEFANFGSSNAVSLNTFKVNTARNPLNTHARVMMGGELQLAKEVFLNLGFVYLHNLISNIGHFASNLGMRYSF

SEQ ID NO: 22233 - protein, 158 aa, Wolbachia sp. wDryA
SYYIRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYVGVGVGAAHISTPLKTAVDSQTYKFGFAGQVKAGVSYDVTPEIKLYAGARYFGSYGA

SEQ ID NO: 22234 - protein, 191 aa, Wolbachia sp. wForm
SYYVRLQYNGEFLPLFAKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKLGFAGQVKAGVSYDVTPEVKLYAGARYFGSYGANFDGKKTDPKDSTRQVTDAGAYKVLYSTVGAGA

SEQ ID NO: 22235 - protein, 327 aa, Wolbachia sp. wMic
VYNQDGTKVELGGSMRIFLGKLGKNQRGDLVNDGSRIKIKASQELDNGLSAFVSYELRFEREALKNKQKASNNFGDPTTRKLFVGLGFKDVGELSFGRQSTNADDVLGDSLYYGSSDLSDLTTRSDKSVRFRSADFNGFSFGVDYLFGNAEKYKGTANANRYKNGYGVAAFYNYDFAENHKIDFGATYAVDQYDTLTSSSTNRKEHKWLLATHYQLDALKLGVAYGQYHSKTKGVEAVKTRYIFLEGKYDLNELTGIPTTFGLQWERKSAKQTSAAPSHIENHYIVNVDYEFNKHVIPYVSYIRATDKDDKIRKNENIYGAGLRVFF

SEQ ID NO: 22236 - protein, 193 aa, Wolbachia sp. wNaw
SYYVRLQYNGEILPLFTKIDGIQKTKGKEKDSPLKASFVAGGGAFGYKMDDIRVDVEGLYSWLNKDADVVGDTVADNLTAISGLVNVYYDVAIEDMPITPYIGVGIGAAYISTPLKTAVNEQNSKFGFAGQVKAGVSYDVTPEIKLYAGARYFGSYGAHFDKSEEVDKAVGGKETKVTKDAYKVLYSTVGAEA

SEQ ID NO: 22237 - protein, 868 aa, Xylella fastidiosa
MYNHTIKLAFCISSVLYCSTSATAAPNTEAITKLDTVTVTGYRASLEKTQSIKRAANSIVDAISAEDIGKFPDSNAAESLSHLPGISVDRQFGEGEKISINGTDPALNRVLLNGQTIASGDWGGNPTDTSGRTFNYSLLSPEIIGLMEVYKTPEARIDEGSIGGTVIVHTRQPLDLPKNTIRGSIGYSYNDRSKKSNPRGSILWSWKNDSENFGALISATHDKQDIARAGIEFFGYTTGANIPPEATITGDGSTPTTAKVPAGINSAFFQQTRERNGLQGALQWKPNEQNEFNLTGIYIKGKYNNFSESRYICPTCNNDLNKVSAANVQNGYITTATVSDGTAGQPYAQLDANYRISTVTTNSLNLHHQWSGDKWVLTTQTGTTKATGGKDPEYLMKFLLQEGGYRFNYDGTHTGVTYDNNNASNWALKSGEQAGGLEYTRTNDQENYFQFDATRDLHWGPFNKLQFGYKYIGHKNGQTSRGNALFANQDVLLTAFNPGMTPTGLYNGLGASGDLINWPTADLRSVLSYLKALPEAAFETKYNQQFSVTETTNNLYTQLDFDSGKWRGNLGIRYVDTKDNILYWQSTTVNNTVNYQPVKDSKRYYKPLPSLNIAYDLTNNSVLRFSAARVIARPRYGDLAGSFSLNSTSGDLTASGGNPNLKPYQSSNYDLAAEWYFAPSSMLSAEAFYRDISSYIVTTTTTETLSDPSNNIFNKPYTVTRPMNATGAKVTGLSLNYQHAFAYGFGLATNYTYAQSNSNDGLNLPYLSKNTYNVIPYWEQGPWAVRLNYSYRSKYFTQIGRLDSQVFTDAYKELDLTTSYKFNDWVTLNISATNLLNSTYYWYNEVKYAPIGMYKNGRSYQAQLNFKF

SEQ ID NO: 22238 - protein, 538 aa, Xylella fastidiosa
MIDMPVRSDDASLLALSGPPNPSELGSDRRRAASRSPFFRPRLAALALGPVLALLWPGAQAHASGLDVPHIGTTFSSPTTQDAAAVYWNPAMLGFADSNEVLLGVGIAAGSLRYQRDRLGAYQYADGLDFAEPIDPASIDPNKPGAYPEVRSPIFSPNAGGFAAFPLIQDRLALGLGVYVPYAAPLSFDEEGAQRFALQSAFIAVSRISAALSVKVHERVSLGASVSYVLGFAQLRRIQDFGAVDLFGDALARPPINQPNDFGEDAPSTVRELDVLARPFALNDAFSHGASFSVALAANPIDPLWLGLTYDHGSRANFRGTFQLDMNDEFFTQDLASQGLSFPPLVEGDAALSFRLPKRLMFGAAYDISKTLRVDTNLAYVFWQDVDTFDITLDSEQLAQPALEIPRRTTVGLRRDWVGAIHVEASARAVVDKKEKVRVSGTLGYHSPASPDATIDVASPDGQRLLGALGVAYQINPRVAVLADGELQGILPRTVTASDYDLGNGRYNLLLGTFMLHLQARFGSKAKPAKPPVRPIES

SEQ ID NO: 22239 - protein, 958 aa, Xylella fastidiosa
MKFKPDIPHRLLVVSLAIAIATFATPSIVFAQEKDTSAAAVLDAVNVTGTRLKSQSMTASSPVAEINAEEFQYSGATKVEDLVNQYPQLSLNFDGFTNNGSDGYATVDLRGLGAKRTLTLVNGRRIPKGIIETPDITIIPTAIVKRVDLLTGGASAVYGSDAIAGVVNFVLDDAFHGISVNAGYSAYQHNNDNTYMRGLMDKAGYPYPKGGSGFDGVSRNIDLAIGGNFGESGHATTWVTWRQNDGLLQGQRDYSSCALKPNGTGCGGSLTANPPNFNIVAPTAGTFFVLPSANGTWSKTDTPNLYNYAPVNYYQRPDTRYTAGTNIQYEINSHFKPYVEALFVNHRSSTQIAPSGTFFNELKVNCSTAVIGSLCNDVGITDSAFSVYVAKRNIEGGPRSTNTDTSSGSITAGTGGNLIGNWSYDASFTYNRSATKSESFNDFITTRVHDALLGCPTGSFDGCIPYNVWTNNISAAAAQSLQGVGIVNYTTSMKVFNAYVTGDFGYALPWANNKPINLVAGYEWRTEGYTRTADSNTQAGNFAGSGGPTSNVDNSISVKELFLESAVPLLANTGILKELDLQFGYRRSKYDVSGSTNTYKAGFGASFAEGQYLLRGGWNRAIRAPSITELYEPNTIALWDGSDPCAGTSPTFTQAQCANTGVTAARYGNITANPSGQYNEISGGNKNLKPEIADTWTLGFAATPIKNLDLSADYYSIKIKDTIRTIGASNILAACALTNDANLCSRIRRNSATGDLFLGSDPATSGLVLNSRGNFGALQFRGIDLTASYAWNVGPGRLTTNMIGNYVIKQDYQPVPGISDNNYSCAGIVNTACGNTNGTKGGTSKWRHMVNVRYGFDRYTMGLRWRYIGKMNYEDTDGTPGSTDKLVVNGGNRVSAYNYLDLTGSIQLDNDITWTMGLNNVFDREPPLVGSSLSYNGNALKGYDQAGRYFFTSIGLKF

SEQ ID NO: 22240 - protein, 718 aa, Xylella fastidiosa
MKNRSRRHTGAALAALALLFPPRPAPAEPSPLDEIVVTATRRPAALRDVPASVSTLDRAAFERQQTRFIGEELRGLPGVVLRTNDQGTYTDLVIRGVPNRVHNDTLVVMMDGVPFVTGDDEGDLEQLPFAAVGRVDLVRGPMSALYGRGAIAGTLNYITREVGTERLAETEAGFGSHGWRQVGALVQTPTLDRGALLLTGEVQRGDGWRDRTDRRQDSLFAKHRLDLAEWGRLSLTATWVDQAQRLAGELPVTADGALVPLPGGRKGNWNEDDAGFYKRMLTGTAILEAEAAPGLSLTTRLHARRSLTSALQGFFNRFEPGDTAVTFTGFRVDNTTRTAFAEQSFDWQHGPLRLLGGASAEQVDSRPVETWSGSFDFADLFYAQRRLILTGRPVDPEDWRSDILLNADARSRAYGAYLQGEWTLGPVTLAGGGRFDRFSRRVQYGPSGSGYGPDPVETVRDADQRVSPKASVTWAVGADLSVYAAYGAGFSPGFGPVWSFRGRDTALAPELADNIEAGIKGALLDGRLVATVTAYRLKRRDLLQLLPVNGTARTVNTGRQRSRGLEVEAQADLSDAVPGLGLDLAYGLTDAVWTENRYLEPDTGRPFDFSGKDVAGVPRHAGRVALTQAIAGLGLEARAWLDLSGDYPYDGANSVRSGGHALWNAALTWTPLPALDLTLTVRNLFDREVNLVVADNDGPYAAYPQPPREIFLSGKVRF

SEQ ID NO: 22241 - protein, 793 aa, Xylella fastidiosa
MNPFVSLTVASVTALFVASPAFGQEATQSTTLDTMIVTGTHLTERTVVESQSPIDIISAAHLAATGSSELATALSRMLPSLNFPRPALADGTSGIRPAQMRGLAPDQTLVLINGKRRHLSAQINVNGTIGRGSSAVDLNTIPITAIERIEVLRDGASAQYGSDAIAGVINIVLKGATQDGSLALEHGQYSTGDGATSKLSGDSGISFANGRGTLHLAMDISQQEQTNRAGPYQGSAPNTGNYPDIGRTAFIYGDPRVNAAAFSANGMFDVGEHVKGYANAMLSNRDITSFAFYRSRNHNGQSMLLAQRYPEGYVPEIEQNSKDRSLVAGLKGSTEHCLNWDMSYNYGSNHIGFHTNNSINYSLGVESPRDFYDGALEYTQHLLNTDFTKVLDWGLTYPVTLSFGTEYRYEQWNQSPGIPASYNGMTGGAQGFAGFSPLNTVHANRNNYALYAGLDGDLSEHLSAGVAGRFEHYSDFGNQTSGKFSARYALTDQAALRATIGNGFRAPSLAQQRYQVVTSTYSNGTFYESGTFPTTSPVAQALGATPLRAESSLSYSLGLVLQPFERLYLTLDTYQIDIAHRILLSSNLNDAAVLAALQQQGNSNVTSVRYFANAANTRTRGVDLVGTYTIPFAVGQLDLTTSYSGIGTRIRSAVTQPAALSAIGSTQTIVGRDEIGRLEESFPKDKLILSGTWKLTQWDLMLAATRYGTVTVRNPTSVSRDQTYGARWVVDASASYKPDMHWMLTLGANNLLNAYPDKTVNAINSIYGQMPYSNYAPFGFNGAYVYARIGYSW

SEQ ID NO: 22242 - protein, 1091 aa, Xylella fastidiosa
MQTHRHEIQGTTEPHVRNFHQPDLRHCNPSPAGIHICGYRLFIHPHSDKEMLMKRHLNTSYRLVWNHITGAFVVASELARARGKRAGVAVALSLAAATSLPALAADSVVPAGETVNGGTLINHDRQFVSGTADGMTVSTGLELGADSDNNTGGQQIARGGTARNTRVTANGLQDVMAGGSTSDTVISTGGGQNLRGKASGTVLNGGDQWIHAGGRASGTVINQDGYQTIKHGGLVTGTIVNTGAEGGPDSENVSTGQMVGGIAESTTINKNGRQVIWSSGIARDTLIYTGGDQTVHGEAHNTRLEGGNQYVHKYGLALNTVINEGGWQVVKAGGTAGNTTINQNGELRVHAGGEASDVTQNTGGALVTSTAATVTGTNRLGAFSVVEGKADNVVLENGGRLDVLSGHTATRTLVDDGGTLDVRNGGTATAVSMGNGGVLLADSGAAVSGTRSDGTAFRIGGGQADALMLEKGSSFTLNAGDTATDTTVNGGLFTARGGSLAGTTTLNNGATFTLAGKTVNNDTLTIREGDALLQGGALTGNGRVEKSGSGTLTVSNTTLTQKAVNLNEGTLTLNDSTVTTDIIAHRGTALKLTGSTVLNGAIDPTNVTLTSGATWNIPDNATVQSVVDDLSHAGQIHFTSARTGKFVPTTLQVKNLNGQNGTISLRVRPDMAQNNADRLVIDGGRATGKTILNLVNAGNSGTGLATTGKGIQVVEAINGATTEEGAFVQGNMLQAGAFNYTLNRDSDESWYLRSEERYRAEVPLYASMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYMNLTHTSSGLWADIVAQGTRHSMKASSDNNDFRARGRGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSINGSSAEGYNSQATLNVTF

SEQ ID NO: 22243 - protein, 683 aa, Xylella fastidiosa
MPSFRCFFSVSLFSLILCSVVFGVHATAVTTSTDHSLPLSLGKIQVDGTHDGATLVDSKLGSVDVLSDDLLQGQHVDYTWEVFMRAPGVQVTQFKMGTESGRISFRGFNGEGRINAIKLLIDGIPSNDNAGGMPYLDAISPLGMSAIEIVRGTNDPRYGLNAIAGHVDVITRSGGNDGLLSVTTGDFGTRKIQWVKGIERGAWSQNYVVSWLDSDGYRDHARAIKRAVSGKWGYADPRDAWRAGLSVRYFHNDAQEPGYLTYDAAVADPRTSPAYSGQDYCQRQTVQTALHLDGRMSEAFHWTAKAYINRYTNDRVVKFTAASARQERYTDETHRGVLTNAIWRPSVDWAYEFSIEGGVDAQWQSNVSRRYRMLDGQRGTVLRDWDFDLDTYGAYLQSMIRVNDSLKLVPAYRVDRIDGRFSDIASWLRYPVYRYGTIQQPKFSVSYDVSQDVTVYANWGRTFQIGSGNGAYRTQADDLAPSMNDGWETGLTFKPWSWANARLVYWQQRASGEVATLFGTNGAIAINEVGNVGKTLRNGWDAQLNLQPDEQWRVWLGYSRQKAEIAIPDPSAPATRGKQIENVPRWLTNVGAEWQVLPKLKFSAWGNGQGNYYVERTNTLGRYGRYFLSNLSATWLLSNKSELTLQLNNVTNRFYVYAWYDSGLSGYSPGDGRALYLTWNLTF

SEQ ID NO: 22244 - protein, 1804 aa, Xylella fastidiosa
MDLQNSHSKKYVLTFFMSICLLTSSFLSTSARAASFKDLVSKTPTWQKHNSKQQQNIWKDFTLNEKIKKWQEANLIPSLTQAQDDLGIKYKETDLSSFLDKTRHKARQARAEILLYIERIKQQYFDTKKQEYIKQGIVPTDMEAATNLGISYDPSKIDNNVEKDQKVRRAEKDKQALIDLYISSINRDIKYKHYIDNNIIPEIKEVKTALNMDQDDAESFVVSIRTEIMENAKGQYIADSHIPTEKELKNRFGISRDDNRDGYIKSIRLKVMDKEKPQYIAANSIPTEKELEQKFGANKGEATNYIASIATQMMLSKKSYYIDNNIIPNADELMNEFKIGPVKATSYINQIRAGIEANQFLNNNDTTKPSTGGSKKKSETKSDNWYMSNQGANTTGTSSGVPTGRKEKQSYFFDPISTFKAHFNNKESKGNLTQSQHNINRIIQQEENIGAFENLIKTDPIAALNLKVDSSYKKEAVTTILSDFNDDTIQRVLFSNDRGQLDFKTNIDVTNRPILKELLENSSSEEKTKFAERIKDYATRNISNSQFEEKARLDLIKLAASKDKSLVEKFLALQLELKNKMQSYIVKSEYILTPKIVAAINIELKNQGLIIDSLTKDDMIKLAKSVNKQALNSVIKVILSDNNALTNETNKILGLAVGNNANNLEQTQSGMPNPPPLPLNGGIPNPPPLPLNGSMQPPPPPLNSQGFISNSNNFDLNKLQAEYSHIHSLYTQFTRNTTVQPKVLLQPTASSATSTERSDPETIYAKLYAEYRTETGGKKADDLQDQLITRQADLTNVIRQILTESYANQGADEKTLVNLFSISTPEIAEKAKEVFNKLVQDPYIQDITVNGKKATTSEDIIQNLFNEDTDDAVKRILLSSCKISEELKKPIKHELNQLKLIRELESKPTLFEQLEFAYANAKNFDQDIFGNRVEELINNPKILTILQQATFLITEDTNLRKTINADQAQAKLDDLRTAILSTIKFEELITVNLPKNEFIAIVKEKEPELLKEFLKATTIKLEGNNNLDQLRLVLPSFTGMSNEQVRILASKLNMNIILKALKEYSQEKAKKHIHTGNMPPPPPPPPPSGSKDSELAYLTTLGITKDWISRITRLNVNTSTSTFKITPKIYNFSSDIAVRYKEFALSGQKSAGHKAKYSDADLFKKAIVESVAFEHSKNLSKVHQNNTYFAKIQEAVDTMHSSFIGPRTEIGQKIHNIYTSKLLELTKDKEFIKYVEDDIILSKKLTEAFTSADSDFIGPRTEIGQEVHNIYTQQLTKYPEETVKEAFNTANSDFIGPRTEIGQEVHNIYKSKLLELAKDKKLFLFVEQLLAESAELEQKYGSDVQSENNNQEKKVGRLDPKQLRLFQQENEYANDESSTKDNTQPEDSNKKSEESNSETAVSPRLLSSNDSKNDKSSDNKKSLLDLRSSDEEDKGYETDEELEESNYTTEGESKKDIALESEDEDIDVSFNTEAIVEQDEAAQRQQVSDDTSRKVAILVKATSTLHKPVHCNILSDRLKVAAIGAGDEEPTIARGVWISGLYGVNKQGTWKNIPKYQGRTTGVTIGADAEFINSHDVIGIAYSRLESQIKYNKKLGKTAMLTVTLLSIYGLKELIKGFSLQAITSYGHNYIKNKSKSINNIIGKYQNNNLSLRNVLLNYKYHTTYYLKHFIPNIGFKYDYSRASNYKEYNVDIENLMIQKKSNQSFESSIGGKIVFKPIATISNIVLTPSLYGNIERHFNNKNTKVNAKATFKGQTLQETNYYTWKQPKLGYNIGSNILMSRKNINVLLEYNYYTHKKYQSHQG

SEQ ID NO: 22245 - protein, 746 aa, Xylella fastidiosa
MIRHLQGRAGRAALLASGTILAGNMLAAGWPFSPAWAQGAASAPNPMVDSAPLPTLRVLGDSPLSLIEEPLDKTTVSQTMMNRNRLNSPDTAELFKGVAGVSFYQAGRVSALPVINGMNDDRVATEVDGVRISAACPNHMNPALSYVDPGMVKTASVIAGITPVSAGGDSIAGTVSVERADPIFSKDKSILATGHVTASYRSNGNTVGTSGAVTVANDTVSLRYEGSWSQAGNYEGGGDAGIVRSTKYQSFNHAVTLGLKRDNHRLTLTAGQQDIPYEGFPNQFMDMTNNRSTFVNGHYEGDYSWGELDVRGYWQRITHVMNMLDDKGGHSATTGMPMNSDSRLAGYAIKATIPLGSWNTLRLGSSFDHQGLNDWWPPLMGSMMMGPDTYHNINNGHRDRLGHFAEWESRWTNRFSSLLGFRNDIVMMNTGEVSPYSSGGMMMGTGGMMGGMSNPDAAAARAFNAMSRGRTDVNFDVTALGRYRVSDMISLEGGYARKTRSPNLYERYAWGRSAMTSQMIGWFGDGNGYIGNPDLKPEIAHTISTTVLFRDPEQERWKISIQPFYTYVEGFINANLLKSLSSDFNQLQFANHNAQLYGVNVSGSARLWHSARWGHGELGGTLSYVRGEDLETRHSLYHMMPINGLIGLYETRGNWSGRAEATFVNSKTIIDPTRNEPRTPGYALFGLGAGYNWKNVKVEGGIENIFDQKYYLPLGGLSLGDFDATGVLRALPGLGRSYNLSMTVSF

SEQ ID NO: 22246 - protein, 1008 aa, Xylella fastidiosa
MKKSCSSQLLQIRRLLCYALAVCLYLALPNAFAQSSNATLRGQVSRAQAGAVVLVTNTATGLVRRSTLLSDGTYAMTGLPPGQYTISVGGVSRTVTLSVASSVTVNLDAGVPISGDAKTLDAVQVTGQTIREVKTSEIGNTIALRQIQQLPQATRNFLEFADTVPGMAFNIDPQGRTTLRAGASNSSASNLYIDGVGQKSYVAKGGISGQNDSQGSPFPQLAIGEYKIITSNYKAEYGQIGGAAVTAATKSGTNEFHGETFYRYTNQNLRDRRPDEGETKVDSQTKEYGFALGGPIIRDRMHFFFAYEGKDNVVPRSVQADARAAPYVHFLPSYLSQQYGAVNLPFNEDLFFGKIDFEPSGDDRLELSVQYRDETQIDNIGGQNAADHGLNKTNKDKRGSLRWQHSADAWFNELIFTRENARNNPNPMSIGNGFNYVYLDETDPNIGEYTFLSIGPDGGSSMQRRHQDGWSLQNDLTFTSVKWHGDHTIKMGVSYKNITLQSQDAASLNPQFSYAVSSSGVATTPYRVDFYSPYATPGQKALVETRAKQYGLYLQDDWNVNEKLTLNLGMRWDYEDNPAYTNFVTSQAFVAALYADDPENPGHPWANRLLPSGINVADYISNGHNRHNFNKGWAPRFGFSYDIYGDEAAVMHGGAGRSYDRNLFEQMAYETSKAALSPVAVYFQDPATHTCYHSDRLCVPWDPKYLNGIDQLNAIAGVSGSGELFIFNNKLKTPYSDQYSIGISNKIGGWLTDVTFQRVLSNDGFVMSLVNRYPDGRYFDAEGNAPWDQSVPGHKNTILGMNGLKQRSSQVLLSVEKPYSKESGWGVNVAYTHTSARQNRTIDEPFAFDKATIYEYPFVKSDAVAAHRLVVSGSMDGLWGMTFGAKVVLATPTPINTIACYGQIDQDGANCQQVGVIPPSSGKFLVGGNIWGYRTVDFQASKEFTVFNDFKLSARVNLLNAFNFKNYASYVYNSFGSDGRLQPDITINRIGDINYVPRTVTFELGMKF

SEQ ID NO: 22247 - protein, 327 aa, Xylella fastidiosa
MPTKMRTTRNLLLMATLLGSALFARAAEKEMTIGAIYLDTQGYYAGVRQGVQDAAKDSSVQVQLIETNAQGDISKESTFVDTLVARNVDAIILSAVSENGSSRTVRRASEAGIPVICYNTCINQKGVDKYVSAYLVGDPLEFGKKLGNAAADYFIANKIDQPKIAVINCEAFEVCVQRRKGFEEVLKSRVPGAQIVANQEGTVLDKAISVGEKLIISTPDLNAIMGESGGATLGAVKAVRNQNQAGKIAVFGSDMTTEIAQELENNQVLKAVVDISGKKMGNAVFAQTLKVINKQADGEKVIQVPIDLYTKTEDGKQWLATHVDGLP

SEQ ID NO: 22248 - protein, 254 aa, Xylella fastidiosa
MRSIARRTAVGAALLLVMPVAVWISGWRWQPGEQSWLLKAAFWVTETVTQPWGVITHLILFGWFLWCLRFRIKAAFVLFAILAAAILVGQGVKSWIKDKVQEPRPFVIWLEKTHHIPVDEFYTLKRAERGNLVKEQLAEEKNIPQYLRSHWQKETGFAFPSGHTMFAASWALLAVGLLWPRRRTLTIAILLVWATGVMGSRLLLGMHWPRDLVVATLISWALVAVATWLAQRICGPLTPPAEENREIAQREQES

SEQ ID NO: 22249 - protein, 990 aa, Xylella fastidiosa
MVSGVVKDVTGEPIIGANVVEKGTTNGSITDIDGKFSFSISKPVVTLSVSYIGYQPQDYAYKGQGSVIIILKEDLQNLDEVVVVGYGVAKKRDLTGSVASVKGEKLQETASFSAAQALQGRAAGVTILSTSAKPGEDVQVRVRGNRSLKATNDPLYVVDGIPIVVALSELSPSDIESVEVLKDASATAIYGSRGANGVILVTTKKGKEGKVQVDYNGYVGVQQAARKIEMFDGGEWVEMVREANRATNKTTPYPLVPTLDWDRKIGYFNADPSIMNKIEQGYDENGVWHSDRVPYTDWTEEALRVAPIHNHEVSVRGGTEKLKMLASATYFGQDGVVKGQDYRRYSVRVNFDWTLNKYVKVGGSTSFSHLDRNNGGNLYDGVKLTYPLADIYDANGNIIEARPGNDPQLWNKFLNIEHEKKEIKKDRFLGSYYLDVTLPFDIKYRSNVGIDIGPWYGNEFYGALSSDRSGSPARAVNARDNRRMYTWENLLFYNKTFKKDHTLGLTFLQSIQQETYEKSEIKVKDLPYENQTWNNVGSAQTIESVSSDYQRWNLASFMGRVNYNYKDRYLLTVSARYDGSSRLAPGHKWVLFPSAALAWRVKEESFLKDVDCLSNLKLRLGWGITGNTAIDPYKTQGNLEYGRYSYGSNGVLAFYQKEMPNPNLSWEKTEQWNAGIDFGFLNGRIGGSVDLYLQNTNDLLMDRQLPIVSGFGNVTTNIGQIRNKGLEVTLNTVNIDTKDFKWTTDFMFSVNKEEIVELYNGKVDDEGNKWFIGQPVKVFYDYKADGIWQLEDAAELEKWGGVFKPGDIKIVDRNGDYKITSEDRFILGHENPNVTLSMSNYFNYKDFDFSFFLNGAFGQTKSFNRELRLSGRYSGAKVNYWRIIGEDENGNPISNRSNEAPRPNIDFENPNYISSLYKEDASFLRIGQVTLGYTLPKALLQNVGIQKLRVYATVQNAYVFTGYSGTDPESGGDFNEPMPRTYLFGVNLSF

SEQ ID NO: 22250 - protein, 597 aa, Xylella fastidiosa
MTSNFTRSLLAFAITLTTTQGIAKPAFQQTIFFGDSLSDSGYYRPLLPNEIQAITGKFTTNPGWVWSEYVASYYGSNASPNGNSQSGNNYAAGGAHINEPSISILGEAPSLTSQTNAYLSAHGGKADPSALYTLWGGANDLLDTLTTPEQIHTIIGNATTAEISLVSTLKNAGAHYILVAAIPDLGLAPRARNTGTTAQSTAAATAYNTTLFTALKSAGLQVIPIDTFHLLQELITSPATYGFSNTTDTACTLQLPLCNPTTLVDANAPNTYAFADDIHPTTAAHHMLGQYAISILEAPRLQQVLTRSAQGIARARAYQVAWHLDGTPQQDGLHWWGSMRSDSQRNDSNDLYKSVAPAGLFGFDWHSGQIVSGGFIGYGRMHADFSNGNGTFKQKDTTLGGFSGWYTGPVWVNAQISYTLLNYDIKREVQLGPATRIHRGSPNGSNLTVALNASYEMGEGRLRYGSVAGLTWQKTKLESYTEQNASSTALGYADQQLNSLLGRVGLQMRLEGNVVTPYLQVTYDHEFKKQQNQANAWLQTMPEAGIYSVPGLTFNRNYASIVLGARTKIGHLQSNVGLTTSTEKNARDVTLFVNGNF

SEQ ID NO: 22251 - protein, 1084 aa, Xylella fastidiosa
MCCFNYSNKNPRMVMKTNRSTLSPCFRKTMIASLLVPLCSPLYSWAVQTASITDGSTMVISGGYDTEANNHSAVFVQGSGSTINGGSDVVIETTGVGAIGAYASEGGSLGLTGSTINTENGVAFGVLNDKGTVNLQGGTITTKGQTAYGVYSSGLGSNTDIHSSAITTSYSLTHAIYGAGGTGLTLNNTTLNTSGSGSYGIYLDGSGGSLTGANNTINSTHATKGAGIYISAGGSNATLDNTTLNITKGAVGVNVGEGSSITMDGLIATGNITNLFKVNGNASVSNANIELAAGGVLMAQGSSASNQAVIILNNVNVISNSGSTTLVDVNKDADVTINGGAYHSKGNNAKGIWVRDNNSSLNVDNAVIITEGVNATAIENRGTAIVKNTTVITKGNNSHGLYSEQSLDATNMAISTAGIGSIGVAAAKGGNLNLNDAFIETTGNSGMVLGTFADSSISAKNITGISTGAGAYALWVDDGSSILLEESQITTQGQGAGGIYASNTGTGSHTAYTQVTLNNSQIHSEQGPGIWANGADINVDVKNGSQLTGGNGLLVYASSNAGAASNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYKIDDYRWNLQSNLINPGPGPEPEIEPEEIAYRPEVPGYIAAPWLNAFYGFTTLGSLHERRGSAEGAAEGFNQDSWGRIRGQHNNFDAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDSISEIGGTDYSVGQVRGGLRLFSDASEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 22252 - protein, 1041 aa, Xylella fastidiosa
MKTFSRYTPALNHLALALASTLLLIATYTANATAAESEHSTNEDSKAAPHESKTTELDRVVITGSRIPRAGFDTLEPATVVNRQYIDSFGFTNVADALFSQPGFDSSASVRGNQASFGAGVSFLGRFGLGSNRQLTLVNGRRLVTSNPPTVFGPGDGGTQVDLNVIPTSLIERTETIGVGGAPTYGSDAISGVTNIILKKNYEGAEVNIGYGLTERGDNARYSYSALLGSNFANSRGNVTIALDADDSAGVLGEARRYYRNGYSMQTNPNAAAIAQFQPGRQYATDGRVNPTIPFNTSNTDGIPGRVLIRNRRINNMTWGGLLYPSTGRYIRDASQQPRGFGPNQDQFLQFDKHGNLVSYNPGVNFGNSSSSGGDGLDFNQTTQVTSQLDRKSVFMLGNYDVTDNISSFFEGSYYTSKALELTDQSIYNAAGFGTGNVNGSGDQSGALNFNIDNPFLSEQNRQALRNLGITDFRLSRASRDLVIGNSSTDTRLWRAVAGLNGHFDAGGHPFTWETSLNHGEGNFDYYRTGLIQQHFINAINVTRNSAGEIVCDSSAAGTTVDPNCVPLNLFGEGVASAAARNYVTTPTHAKAQMKQTVFNANLSGSFIDLPGGKLGFNVGYERRREEGRFTPDEYQRLGLGRTVPTTGSHGTFTTNEYFGEILAPLVNPDAHLPGLHRLDLTAKLRRVNNTVNGWFTAYTYGLQYEPFQGLQLRGNKTRSFRAPAIVELYTSQQPSYYSIPEPCTPANITAGNRPELRQRNCEAFFAYYNGVNPGTFQEAPTTQLGSVSGNPTLENELAKSWTAGIVFQPEWAHGLRVAADWYDIKISNVITQLDSGDITSGCFDNETFNRNDVPNANRFCSMITRDPSTGVASSVRGEYTNGPYINFRGWTAEINYRLDLKELRWGGSGILDLGFYGYFPKNLKYTAAQDIPAEESVGTIDNSKRQFQWNARYLTGPWNFGVSANYKSAALYSLTNTVETRDYLGIPSYTSYDANIGYTFDKHSSLNLAILNATDKMVAFPYVYDGLGRRYMLTFNYKFH

SEQ ID NO: 22253 - protein, 681 aa, Xylella fastidiosa
MLVTHISILPRTVLFLAVSNLLLTPALAMADVGPPPTDSRHFKTTEVTRHLKDLDAVVVTAIPLRDSYSDLSRPVALLAGERLDEVRASSLGETVAVLPGVQSSNFGPGVGRPIIRGLDGPRIAVLNNGLSSQDVSTVSQDHSPAVEPFLANQIEVLKGPSTLLYGSGAIGGVVNIVDGRIAEAPVGGFNGRAEMRLDGGDKHGNTNMFRIDAGNGSALSVHADGVYRNEKDYDTPKGRQVNSFIDTKSGSMGASFSGDFGFFGLSVARFHDSYGNPGEPGDPVAGDRGSWLRLHQDRYDLKAGLTDPWGEASALRFSLGHTQYDHIEFEGNEVGTTFGKRASEGRVEASFAFGGGWRTAFGVQGGDSTFQALGEESFVPKTNNKSIGVFGLAHNTFGLFQAEFGARGDQVKYDTDNGVTRNYHPGSFSFSGDLALSKQWRLTLNVDHAERAPVEEELFAKGSHIATLAYEVGRADLKKEKANQAELGLVFRNDWSDAKVSTYYSRYGNFIYLVDTGSTWFWDDGQRDLPVRQWSQANAIFHGIEGEATFHLAKNTSGSWDLRVFGDGVRGRLKDGGNLPRIVPARYGAELRWEDVGWRISLGAKRYEKQNRVAVNETPTAGYTMVDAHLAYHIDVDNIAWEVFFDGNNLTNRDARVHTSFLKDDVMLAGRNYTVGLRMFF

SEQ ID NO: 22254 - protein, 899 aa, Xylella fastidiosa
MTPTALSPVTRSATSTREPQDFCCRFLFEPTSALPAIYGRDGAVVQRDLGEARGARPERRVGTFCLSVPPRLSMVSGAPMEEPEHSDLRRRRTRGSAAVAVAAATGALVAFTDGEATAAPAQEPALAEATQGARVTMPSPLGPTEAPYPPGGVGDATVVARITVYADGTVGAVEVEGEEPFASAAARAAPSWRFEPARRDGRPIGARILFPVRFRDPRAAAPAAPPAAPAGPAPPRGSIATAPPSPPAAAQAIDVVVVGERGAPMTTSMTREEVRQVPGAFGDPFRAIEAMPGVTPIASGVPYFFVRGAPPGNVGYFIDGVRVPLLYHVALGPSVIHPALVERVDLYPGGFPARFGRYTGGVIAGETREPARLLHGEANLRLFDAGALVEAPWADGRGTALVGGRYAYPGALLALFSPGVELGYWDYQARVTYDASPYDRVGLFAFGSHDYLAQIEDDGDTDVVLAGDFHRLDLRYDRFFARGGRLRHAITLGHEESENQDGERAGRARLLGARVELSAPVSERLTARAGVDAQLERFDIDIRENDGDFPTRNDRALARLFTSREDLAAGLWADVVVRAAPGFEVVPGLRGDLFASGGATRATVDPRLATRLQATPRVALLSAFGVTHQPPSFLGAVPGMQVGGLRGGVQTGLLASAGVELRLPGEIKATITGFRSGFFDLSDALGNRPPGTDAGLAQRAELRGAGSAHGLEIHAHRSLSKRIGGFVSYTLSRSIRHVGRESFDSAFDRRHVLNMAAAVDVGRGWKLGGRAVFYSGIPMTVDYNLWDNDGVDGQRPDGNDDRPDTEQDIRRRERLRERIAQVVRRLSLPERLPAFFRLDLRLEKRWILRKGRTVSLTVEVLNATAGKETLQYECSLLRGCEPETLGPITLPSIGAEATF

SEQ ID NO: 22255 - protein, 784 aa, Xylella fastidiosa
MAIRLKAFCLAGAALVAVAPAAAQRSGAADATAPGADDRIDEIVVTAQKREERLLDVPQSISVVSSATLERQQIRSIADYASLVPGLTIQQQTPGQARVVLRGINTGGASPTVAIYVDDTPFGSSTGQSNAAYLAGDIDTFDVERIEVLRGPQGTLYGANSLGGVVKYVTAGPKLDRLEGKAQAGLETVKGGNLGWSANAAVNVPLSGKIAVRASGFYRRTGGFIDTLGLARRDANDVDSYGGRGSILLQPTETLTVRLSALAQNLRSDSRAMYDADPVTLAPQATDPSTGAPVSGLTRTEFYAEKTGVDYRLYNGTLDWDAGFATLTSVTSYGRLFSNDVGDVSYQLPGIGDAVFGTGPNTRGLFFPTQITQKKFTQELRLASPDNDRLEWLVGGYYTHEKGRIFQRYLPFDLATGKAVDQTLVLPVGPGGADVTFPDFLVANLASVYKEYAGFGSATWHVGPRLDLTGGVRYSHNRQSTVQSLDGSFLPLSGAPIGPDTSRGRSSENVFTWSVSPRFELGDHASIYARAAKGYRPGGPNVVPPGAGPDFPRRFEADTLISYELGLRAETPGHGFSVDASVYYLDWRNIQTTVTYQTSLGPVTGDGNGDKARSKGAEITVTARPARGFDLTASIAYSDAKLKDDLPGIDIGAPALISPGLKGDRLPYAPEWTVDLSGDYRWSIGGDAEAFVGGNIRLISDQATDFDLAYRLTYGRRLTIDGYATADLRAGIETGRFNLQFQVRNLTNSRGLINAGRFQTRPGTLVNASPIRPRSFGVTLGASF

SEQ ID NO: 22256 - protein, 413 aa, Xylella fastidiosa
MPALAGGFYLQEQSPIEIGRALSGGAAAGDDPSTIYFNPAAMTELQGVQLSAGASALMASAHQTNRGSYRSVPGSTVRVPVTGGDGGNPFESVIPVPSFYASAQVTDKLWLGLGVNAPFGLKLEYDDDFFGRYDSLYTNLKTYNIQPSAAYKLTDNLSIGGGVDVQYVKATLTNALPQVSPLVPTDGFTSLKGDDWTVGWNAGLFYTTGDTNFGVHYRSGISHKLQGTQIISGVAAPLTAANGEFAATAPLDLPDIVTVSMMHRLTPQLRAMITGKWYNWSKFKGIAVTSAAGTTNKELDYRDSYSVSVGGEYDVSPALTLRAGTMFDRTPTNPQYLTTRVPDGDRVWLTGGATWNVSQMMALNLSYAHTFVEKANIIRPDSYFPAPATVTATTLAQTSGNADQVAASLTVRF

SEQ ID NO: 22257 - protein, 385 aa, Neisseria meningitidis
MRKKLTALVLSALPLAAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQPPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22258 - protein, 201 aa, Wolbachia sp. group A
GPISDEETSYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGYTVLYSTVGAEAGVAFNF

SEQ ID NO: 22259 - protein, 174 aa, Neisseria meningitidis
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSTGLGVLAGVSYAVTPNVDLDAGYRYNYIGKVNTVKNVRSGELSAGVRVKF

SEQ ID NO: 22260 - protein, 311 aa, Neisseria gonorrhoeae
DVTLYGTIKAGVETSRSVAHNGAQAATVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFYKNGGFFVQYGGAYKRHHQVQENVNIEKYQIHRLVSGYDNDALYASVAVQQQDAKLTEENYSHNSQTEVAATLAYRFGNVTPRVSYAHGFKGSFDATNYNNDYDQVVVGAEYDFSKRTSALVSAGWLQEGKGESKFVSTAGGVGLRHKF

SEQ ID NO: 22261 - protein, 351 aa, Neisseria meningitidis
GVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQQPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFHLIERGKKGENTSYDQIIAGVDYDFSKRTSAIVSGAWLKRNTGIGNYTQINAA

SEQ ID NO: 22262 - protein, 379 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22263 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 22264 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSIPTFIEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22265 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRVGSLNSPLKNTGANVNAWESGKFTGNVLEISKMAQREHRYLSVRYDSPEFAGFSGSVQYAPKDNSGSNGESYHVGLNYQNSGFFAQYAGLFQRYGEGTKKIEYDGQAYSIPSFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22266 - protein, 349 aa, Neisseria meningitidis
GVEGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPQSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAA

SEQ ID NO: 22267 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSIPTFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22268 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYGDQAYSMPSFVEKLQVHRLVGGYDNNALYVSVAAQQQDAKLYNSHNSQTEVAATVAYRFGNVTPRVSYAHGFKGTVDSADHDNTYDQVVVGAEYDFSKRTSALVSAGWLQEGKGADKIVSTASAVVL

SEQ ID NO: 22269 - protein, 319 aa, Neisseria gonorrhoeae
DVTLYGAIKAGVQTYRSVEHTDGKVSKVETGSEIADFGSKIGFKGQEDLGNGLKAVWQLEQGASVAGANTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSIPTFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 22270 - protein, 293 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSFDDADLSNDYDQVVVGAEYDFSKRTSALVSAGWLQEGKGENKFVSTAGG

SEQ ID NO: 22271 - protein, 295 aa, Neisseria meningitidis
MRKKLTALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDK

SEQ ID NO: 22272 - protein, 319 aa, Neisseria gonorrhoeae
DVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISEMAQREHRYLSVRYDSPEFAGFSGSVQYAPKDNSGSNGESYHVGLNYQNSGFFAQYAGLFQRYGEGTKKIEYDDQAYSMPSFVEKLQVHRLVGGYDNNALYVSVAAQQQDAKLYNSHNSQTEVAATAAYRFGNVTPRVSYAHGFKGTVDSADHDHTYDQVVVGAEYDFSKRTSALVSAGWLQEGKGADKIVSTASAVVL

SEQ ID NO: 22273 - protein, 386 aa, Neisseria meningitidis
MRKKLTALVLSALPLAAVADVSLYGEIKAGVEGRNIQLQLTEPLQNIQQPQVTKRKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPEFSGFSGSVQFVPAQNSKSAYTPAHFVQQTPESQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22274 - protein, 354 aa, Neisseria meningitidis
GVEGRNYQLQLTEAQAANGGASGQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 22275 - protein, 329 aa, Neisseria gonorrhoeae
DVTLYGAIKAGVQTYRSVKHREGKVVGVGTGSEISDFGSKIGFKGQEDLGNGLKAVWQLEQGASVAGANSGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEYDFSKRTSALVSAGWLQEGKGADKIVSTASAVVLRLKF

SEQ ID NO: 22276 - protein, 295 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSE

SEQ ID NO: 22277 - protein, 300 aa, Neisseria meningitidis
GVETSRSVKHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLALPNDNSHNSQTEVAATLAYRFGNVTPRVSYAHGFKGSFDDADLSNDYDQVVVGAEYDFSKRTSALVSAGWLQEGKGESKFVSTAGGVGLRH

SEQ ID NO: 22278 - protein, 386 aa, Neisseria meningitidis
MRKKLTALVLSALPLAAVADVSLYGEIKAGVEGNNIQLQLTEQPSKGQVGNKVTKGKSRIRTKINDFGSFIGFKGSEDLGDGLKAVWQLEQDVSVAGGGATRWGNRESFIGLAGEFGTLRAGRVANQFDDASQAIDPWDSNNDVRSQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAASVGLRHKF

SEQ ID NO: 22279 - protein, 318 aa, Neisseria gonorrhoeae
DVTLYGAIKAGVQTYRSVEHTGGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKNEYDGHAYSMPSFVEKLQVHRLVGGYDNNALYVSVAAQQQDAKLYNSHNSQTEVAATEAYRFGNVTPRVSYAHGFKGTVDSADHDNTYDQVVVGAEYDFSKRTSALVSAGWLQEGKGADKIVSTASAVVL

SEQ ID NO: 22280 - protein, 348 aa, Neisseria meningitidis
GVEGNNIQLQLTEQPSKGQVGNKVTKGQSRIRTKINDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22281 - protein, 214 aa, Neisseria meningitidis
ASEDGSRSPYYVQADLAYAAERITHDYPQATGANNTSTVSDYLRNIRTHSIHPRVSVGYDFGDWRIAADYASYRKWNDNKYSVNTKNVQVNKSNGNRQDLKTENQENGTFHAVSSLGLSAVYDFNTGSRFKPYVGVRVAYGHVRHSIDSTKKTTNVLTVPTNIPGGTPTIYNQGSTQDAYHESHSIRRLGLGVVAGVGFDITPKLTLDTGYRYH

SEQ ID NO: 22282 - protein, 327 aa, Neisseria gonorrhoeae
DVTLYGAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEGHQYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 22283 - protein, 380 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQI

SEQ ID NO: 22284 - protein, 329 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGFFQRYGEGTKKIEYDSQPYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 22285 - protein, 296 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVG

SEQ ID NO: 22286 - protein, 295 aa, Neisseria meningitidis
GVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGG

SEQ ID NO: 22287 - protein, 351 aa, Neisseria meningitidis
GVEGNNIQLQLTEPPSKGQTGNKVIKGKSRIRTKINDFGSFIGFKGSEDLGEGLKAVWQLEQDVSVAGGGATQWGNRESFIGLAGEFGTLRAGRVANQFDDASKAIDPWDSNNVVASQLGIFKRHDDMPVSVRYDSPDFSGFSGSVQFVPAQNSKSAYTPAYYTKGKNNALTLVPAVVGKPGSDVYYAGLNYKNGGFAGSYAFKYAKHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 22288 - protein, 319 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQYYSIPSFVEKLQVHRLVGGYDNNALYASVAAQQQDAKLYNSHNSQTEVAATAAYRFGNLTPRVSYAHGFKGSVHSADYDNTYDQVVVGAEYDFSKRTSALVSAGWLQEGKGAEKIVSTASAVVL

SEQ ID NO: 22289 - protein, 319 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSFVEKLQVHRLVGGYDNNALYASVAAQQQDAKLYNSHNSQTEVAATAAYRFGNLTPRVSYAHGFKGSVHSADYDNTYDQVVVGAEYDFSKRTSALVSAGWLQEGKGAEKIVSTASAVVL

SEQ ID NO: 22290 - protein, 382 aa, Neisseria meningitidis
MRKKLTALVLSALPLAAVADVSLYGEIKAGVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQLPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22291 - protein, 282 aa, Ehrlichia ruminantium
MNYKKILVRSALISLMSFLPYQSFAEPVSSNNIGNENAKEGFYISAKYNPSIPHFRKFSAEETPVYGKDSPTKKVFGLKKEGSITKYSDFTRTDISFEGQNNFISGFSGSIGYIMDGPRVEIEAAYQKFNPKNPANETDTSDYYKHYGLSRAEAMADKKYVVLTNNGVTFSSLMFNACYDITAEGVPFIPYACAGIGADLISIFDDINLKFAYQGKIGISYPITPEISAFIGGYYHGVIGNKYNKVPVKLPVTLIDAPQSTSASVTLDAGYFGGELGVRFTF

SEQ ID NO: 22292 - protein, 388 aa, Neisseria meningitidis
MRKKLTALVLSALPLAAVADVSLYGEIKAGVEGRNYQLQLTEQPSRTQGQTSNQVKVTKAKSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPDFSGFSGSVQFVPAQNSKSAYKPAYVDEKKMVHAAVVGKPGSDVYYAGLNYKNGGFAGNYAFKYAKHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22293 - protein, 298 aa, Neisseria meningitidis
GVETSRSVAHNGAQEASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGGVGLRH

SEQ ID NO: 22294 - protein, 164 aa, Proteus mirabilis
APLGCGPNSKCAYAPAHFVQNKQNQQNQPPTLVPAVVGKPGSDVYYAGLNYKNGGFGGNYAFKYAKHANVGRDAFELFLLGSGSDGAKGTDPLKNHQVHRLTGGYEEGGLNLALAAQLDLSENADKTKNSTTEIAATASYRFGNAVPRISYAHGFDFIERGKKG

SEQ ID NO: 22295 - protein, 93 aa, Neisseria meningitidis
AGVEGNNIQLQLTEPPSKGQTAIKVTKAKSRIRTKINDFGSFIGFKGQFVPAQNSKSAYTPAYVAVENGVAKKVAAVVGKPGSDVYYAGLNYK

SEQ ID NO: 22296 - protein, 97 aa, Neisseria meningitidis
AGVEGRNFQLQLTEPPSKSQLQVKVTKAKSRIRTKISDFGSFIGFKGQFVPAQNSKSAYKPAYWTTVNTGSATTTTFVPAVVGKPGSDVYYAGLNYK

SEQ ID NO: 22297 - protein, 93 aa, Neisseria meningitidis
AGVEGRNFQLQLTEPPSKSQPQVKVTKAKSRIRTKISDFGSFIGFKGQFVPIQNSKSAYTPAHYTRQNNTDVFVPAVVGKPGSDVYYAGLNYK

SEQ ID NO: 22298 - protein, 96 aa, Neisseria meningitidis
AGVEGRNYQLQLTEAQAANGGASGQVKVTKVTKAKSRIRTKISDFGSFIGFKGQFVPAQNSKSAYTPAYVDEQSKYHAAVVGKPGSDVYYAGLNYK

SEQ ID NO: 22299 - protein, 96 aa, Neisseria meningitidis
AGVEGRNYQLQLTEAQAANGGASGQVKVTKAKSRIRTKISDFGSFIGFKGQFVPIQNSKSAYTPAHVVVNNKVATHVPAVVGKPGSDVYYAGLNYK

SEQ ID NO: 22300 - protein, 93 aa, Neisseria meningitidis
AGVEGRNFQLQLTEPPSKSQSQVKVTKAKSRIRTKISDFGSFIGFKGQFVPIQNSKSAYTPAHYTRQNNIDVFVPAVVGKPGSDVYYAGLNYK

SEQ ID NO: 22301 - protein, 146 aa, Neisseria meningitidis
AGSYDSVDSVGVQWLLPVWYRAEWKNWRIASHPELQLNLLRSHSDKAAQAGAFATFRISPIRSGAYPYLEAGLGLHLFSEKKVGRRNLSTRFQFGELIGAGIAWGGRAGGEGETSVGLRLSHYSNAGLKQPNHGIEVFQLTVSHRF

SEQ ID NO: 22302 - protein, 351 aa, Neisseria meningitidis
GVEGRNIQLQLTEPLPNIQPQVTKRKSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22303 - protein, 389 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22304 - protein, 292 aa, Neisseria meningitidis
MRKKLTALVLSALPLAAVADVSLYGEIKAGVEGRNYQLQLTEAQAANGGASGQVKVTKVTKAKSRIRTKISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPIQNSKSAYTPAYYTKDTNNNLTLVPAVVGKPGSDVYYAGLNYKNGGFAGNYAFKYARHANVGRNAFELFLIGSGSDQAKGTDPLKNHQVHRLTGGYEEGGLNLALAA

SEQ ID NO: 22305 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSKDYDQVVVGAEYDFSKRTSALVSAGWLQEGKGENKFVSTAGG

SEQ ID NO: 22306 - protein, 345 aa, Neisseria meningitidis
GVEGNNIQLQLTEQPSKGQVGNKVTKGKSRIRTKINDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPAQNSKSAYTPAYVDEQSKYHAAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGENTSYDQIIAGVDYDFSKRTSAIVSGAWLKRNTGIGNYTQINAA

SEQ ID NO: 22307 - protein, 350 aa, Neisseria meningitidis
GVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22308 - protein, 357 aa, Neisseria meningitidis
GVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 22309 - protein, 351 aa, Neisseria meningitidis
GVEGNNIQLQLTEPPSKGQTGNKVTKGKSRIRTKINDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATYTVDSSGVVTPVPAVVGKPGSDVYYAGLNYKNGGFAGNYAFKYAKHANVGRDAFNLFLLGRIGEDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAA

SEQ ID NO: 22310 - protein, 356 aa, Neisseria meningitidis
GVEGRNYQLQLTEAQAANGGAGASGQVKVTKVTKAKTRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22311 - protein, 351 aa, Neisseria meningitidis
GVEGRNIQLQLTEPLPNIQPQVTKRQSRIRTKISDFGSFIGFKGSEDLGEGLKAVWQLEQDVSVAGGGASQWGNRESFIGLAGEFGTLRAGRVANQFDDASQAIDPWDSNNDVASQLGIFKRHDDMSVSVRYDSPEFSGFSGSVQFVPAQNSKSAYTPAHFVQNKQNQRPTLVPAVVGKPGSDVYYAGLNYKNGGFAGNYAFKYAKHANVGRDAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAA

SEQ ID NO: 22312 - protein, 355 aa, Neisseria meningitidis
GVEGRNYQLQLTEAQAANGGASGQVKVTKAQSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAA

SEQ ID NO: 22313 - protein, 352 aa, Neisseria meningitidis
GVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22314 - protein, 356 aa, Neisseria meningitidis
GVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22315 - protein, 361 aa, Neisseria meningitidis
AAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVAGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINA

SEQ ID NO: 22316 - protein, 361 aa, Neisseria meningitidis
AAVADVSLYGEIKAGVEGRNIQLQLTEPLQNIQPQVTKRKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPAHFVQQTPKSQPTLVPAVVGKPGSDVYYAGLNYKNGGFAGNYAFKYAKHANVGRDAFELFLLGSGSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINA

SEQ ID NO: 22317 - protein, 364 aa, Neisseria meningitidis
AAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPASDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINA

SEQ ID NO: 22318 - protein, 216 aa, Neisseria meningitidis
AAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAF

SEQ ID NO: 22319 - protein, 363 aa, Neisseria meningitidis
AAVADVSLYGEIKAGVEGRNIQLQLTEPPSKSQPQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINA

SEQ ID NO: 22320 - protein, 298 aa, Neisseria meningitidis
AAVAASASATTVYNQNGTKVEVGGRLDVMLGKFGKDQRADLRNNDSRLEFKVEHEIQNGLKALGFYRLGLGKKDSDRSFDDIETKKLWLGLEQDGVGRVTFGKQDTTADAVQMNDHAYIFGGNNNLVDSGDKVISFRSADWKLAEGQTLGFGLDYGFGSSKKENKDNTYGVSAFYAGQFGDFTAGLNAGYTFEKMVDGKKTKSWRVATQAGFGPASFGVEYGQSKKPDNVKEKSLLVGAKYGVLPDVSNLYAQYQHNKKGNEKAEKVYIVGADYAFNKNVVAYAEFANKRQDDKENKY

SEQ ID NO: 22321 - protein, 388 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22322 - protein, 295 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGKYNSESYHAGFNYKNGGFFVQYGGAYKRHVRVDENVNIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 22323 - protein, 118 aa, Helicobacter pylori
MVTLYGIKNCDTIKKARRWLEANNIDYRFHDYRVDGLDSELLNDFINELGWEALLNTRGTTWRKLDETTRNKITDAASAAALMTEMPAIIKRPLLCVPGKPMLLGFSDSSYQQFFHEV

SEQ ID NO: 22324 - protein, 293 aa, Neisseria meningitidis
GVETSRSVTHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGG

SEQ ID NO: 22325 - protein, 293 aa, Neisseria meningitidis
GVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFMQYGGAYKRHQNVDNVKIEKYQIHRLVSGYDNDALYASVAVQQQDAKLVKDNSHNSQTEVAATLAYRFGNVTPRVSYAHGFKGSFDDADYTNDYDQVVVGAEYDFSKRTSALVSAGWLQEGKGESKFVSTAGG

SEQ ID NO: 22326 - protein, 245 aa, Neisseria meningitidis
AAQAASEDGSRSPYYVQADLAYAAERITHDYPQATGANNTSTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSLGLGVIAGVGFDITPKLTLDTGYRYHNWGRLENTRFKTHEVSLGMRYHF

SEQ ID NO: 22327 - protein, 240 aa, Neisseria meningitidis
AAQAASEDGSRSPYYVQADLAYAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLNDKFKPYIGVRVAYGHVKHQVHSVESKTTIVTSKPTKGATQPGKLVSGPTPKPAYHESNSISSLGLGVIAGVGFDITPKLTLDTGYRYHNWGRLENTRFKTHEVSLGMRYHF

SEQ ID NO: 22328 - protein, 241 aa, Neisseria meningitidis
AAQAASEDGSRSPYYVQADLAYAAERITHDYPQATGANNTSTVSDYFRNIRAHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGVRYRF

SEQ ID NO: 22329 - protein, 272 aa, Neisseria meningitidis
RKFRTSIGRRLRLFGSLSKTYPLPWGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGVHLVWAAQLDVSEHDEKTKNTTTAAAPTASSCCRNGVPPLTDADAFYSSRATRANIPTGLIFSGGG

SEQ ID NO: 22330 - protein, 185 aa, Wolbachia sp. wNub
SYYVRLQYNGEILPFYTKVDGIKNATGKEKDSPLTRSFIAGGGAFGYKMDDIRVDVEGLYSQLAKDTAVVNASETNVADSLTAFSGLVNVYYDITIEDMPITPYVGVGVGAAYVSNPSKADTVKDQKGFGFAYQAKAGVSYDVTPEIKLFAGARYFGSYGASFDKAAKDDTGIKNVVYSTVGAEA

SEQ ID NO: 22331 - protein, 185 aa, Wolbachia sp. wDeiSW
SYYVRLQYNGEILPFYTKVDGIKNATSKDKDSPLKRSFIAGGVAFGYKMDDIRVDVEGLYSRLAKNKAVIDASEANVADSLTAFSGLVNVYYDIVIEDMPITPYVGVGVGAAYISNPSNAADVKDQRRFGFAYQAKAGVSYDVAPEIKLFAGARYFGSYGASFDKAAKGDDGIKNILYNTFGAEA

SEQ ID NO: 22332 - protein, 184 aa, Wolbachia sp. wRos
SYYVRLQYNGEVLPFKTRIDGVKYKSGKDNNSPLKASFLAGGGAFGYKMDDIRVDVEGLYSQLSKDADVVDTSPEVVESLTAFSGLVNVYYDIAIEDMPITPYVGVGVGAAYVSNPLVTEVTGDKKSGFGFAYQAKAGVSYDVTPEIKLYAGARYFGSYGANFGKAAKDDGGIKVLYSTVGAKA

SEQ ID NO: 22333 - protein, 183 aa, Wolbachia sp. wAus
SYYVRLQYNGEVLPFKTKIDGVTYKSGKDNNSPLKASFLAGGGAFGYKMDDIRVDVEGLYSQLSKDADVVSDDKAADSVTAFSGLVNVYYDIAIEDMPITPYVGVGVGAAYISNPSKAVAVKDQKGFGFAYQAKAGVSYDVTPEIKLFAGARYFGSYGASFDKATSDDTGITNVLYSTVGAEA

SEQ ID NO: 22334 - protein, 187 aa, Wolbachia sp. wBou
  misc_feature (34)..(34): Xaa can be any naturally occurring amino acid
SYYIRLQYNGEILPLFTKVDGITYKKDNSDYSPXKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSVGEKDKGGHTVLYSTVGAEA

SEQ ID NO: 22335 - protein, 187 aa, Wolbachia sp. wKayA
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYGVTPEVKLYAGARYFGSYGTNFDKSGGEKDKGGHTVPYSTVGAEA

SEQ ID NO: 22336 - protein, 389 aa, Neisseria meningitidis
MRKKLTALVLSALPLAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAHVVVNNKVATHVPAVVGKPGSDVYYAGLNYKNGGFAGNYAFKYARHANVGRNAFELFLIGSATSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22337 - protein, 351 aa, Neisseria meningitidis
GVEGRNYQLQLTEQPSRTQGQTSNQVKVTKAQSRIRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPDFSGFSGSVQFVPAQNSKSAYKPAYVDEKKMVHAAVVGKPGSDVYYAGLNYKNGGFAGNYAFKYAKHANVGRDAFNLFLLGRIGDDDEAKGTDPLKNHQVHRLTGGYEEGGLNLALAAQLDLSENGDKTKNSTTEIAATASYRFGNAVPRISYAHGFDFIERGKKGEHTSYDQIIAGVDYDFSKRTSAIVSGAWLKRNTGIGNYTQINAA

SEQ ID NO: 22338 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDGADLSNDYDQVVVGAEYDFSKRTSALVSAGWLQEGKGENKFVSTAGG

SEQ ID NO: 22339 - protein, 300 aa, Neisseria meningitidis
GVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRH

SEQ ID NO: 22340 - protein, 299 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVNDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 22341 - protein, 294 aa, Neisseria meningitidis
GVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGKNKFVSTAGG

SEQ ID NO: 22342 - protein, 388 aa, Neisseria meningitidis
MRKKLTALVLSALPLAAVADVSLYGEIKAGVEGNNIQLQLTEPPSQGQTGNKVTKGKSRIRTKISDFGSFIGFRGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRDAFNLFLLGRIGDDDEAKGTDPLKNHQVHRLTGGYEEGGLNLALAAQLDLSENGDKTKNSTAEIAATASYRFGNAVPRISYAHGFDFIERGKKGENTSYDQIIAGVDYDFSKRTSAIVSGAWLKRNTGIGNYTQINAASVGLRHKF

SEQ ID NO: 22343 - protein, 385 aa, Neisseria meningitidis
MRKKLTALVLSALPLAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22344 - protein, 393 aa, Neisseria meningitidis
MRKKLTALVLSALPLAAVADVSLYGEIKAGVEGRNYQLQLTEKPSSTNAKTGNKVEVTKAKSRIRTRISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLRHKF

SEQ ID NO: 22345 - protein, 387 aa, Neisseria meningitidis
MRKKLTALVLSALPLAAVADVSLYGEIKAGVEGRNYQLQLTEAQAANGGAGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGATKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22346 - protein, 380 aa, Neisseria meningitidis
MRKKLTALVLSALPLAAVADVSLYGEIKAGVEGRNYQLQLTEAQAANGGASGQVKVTKAKSRIRTKISDFGSFIGFKGNEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQINAA

SEQ ID NO: 22347 - protein, 295 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGG

SEQ ID NO: 22348 - protein, 297 aa, Neisseria meningitidis
GVETSRSVAHNGAQGASVETATGIVDLGSKIGFKGQEDLGNGLKAIWQVEQKASIAGTDSGWGNRQSFIGLKGGFGKLRVGRLNSVLKDTGDINPWDSKSDYLGVNKIAEPEGRLISVRYDSPEFAGLSGSVQYALNDNAGRHNSESYHAGFNYKNGGFFVQYGGAYKRHHQVQENVNTIEKYQIHRLVSGYDNDAALYASVAVQQQDAKLVEENYSHNSQTEVAATLAYRFGNVTPRVSYAHGFKGSFDATNYNNDYDQVVVGAEYDFSKRTSALVSAGWLQEGKGESKFVSTAGG

SEQ ID NO: 22349 - protein, 294 aa, Neisseria meningitidis
GVETSRSVEHNRGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGG

SEQ ID NO: 22350 - protein, 297 aa, Neisseria meningitidis
GVETSRSVAHNGAQAASVETGTGIVDLGSKIGFKGQEDLGNGLKAIWQVEQKASIVGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVVQEDLNIEKYQIHRLVSGYDNDALYASVAVQQQDAKLALPNDNSHNSQTEVAATLAYRFGNVTPRVSYAHGFKGSFDDADLSNDYDQVVVGAEYDFSKRTSALVSAGWLQEGKGENKFVSTAGG

SEQ ID NO: 22351 - protein, 668 aa, Helicobacter pylori
MESPVSSTIKLSTLCIAIASAFSSPVMAEESTSHFDEVVVWGTKVSSNTESIIADDMSLKQADHMSDLLREIPGVDVGGTHSVNQRITIRGLSETDLDIRLDGASQHANMFHHIGNLTLNPDILKSADIQVGNNSVTQNGLGGSVLFETKDAKDLLRYDESFGARVYGGYATNASQQGSLTVYGLLSDNVDAMLYSHYMSRTDFKDGDGNETFGSEGDVYNILGKIGFEPSDLHRFELSYDLYRDSGDYSPRPDMSGGANEGLSNDILIPTDYDRDTITASYELRGESHKGNVTLYNTETEIQRDESVMAPRWPSNRLSNNTAKNQNFGVNAKFQSDYRLMSFDNIATYGFDYMDKSSSSYYGSSKFMDESAISTALFVEDQFYFTQAFSITAGVRFDDYQRKAETGNDDFDDVTWSLATQWDVTQEWTLFASTRSLFKGPELMETFIAYQDVAYLADDIKAETGQNTQGGVRFDKRIDDHFVGANLTVFQTDIDDYITEEYQAASQSYLIYNLGDVEIKGFEASLSYGYEMFNSKLSYARSDTKNKDTGGAVAGGNGRSIDMGDSITLTLDYQSEALETIFGWNSMFVKDEDNVFDGQPIKEGYDVHNLYAQWVPSNVDGLSVTFGIDNVFDEQYTSHASRSGTARGFTLDDYEPGRNYKLSAAYQF

SEQ ID NO: 22352 - protein, 1291 aa, Helicobacter pylori
MELQQTHRKINRPLVSLALVGLLVSITPQKSHAAFFTTVIIPAIVGGIASGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDGADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVAGEVNFNHLTVGDRNAAQAGIIPSKKTYIGTLDLWQSAGLNIIAPPEGGYKDKPNNTNSQSGAKNDKNESAKNDKQDSNTQVINPPNSGQKTEIQPTQVIDGPFAGAKDTVVNISRINTNADGTIKVGGYTASLTTNAAHLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTSKLMFNNLTLGPNAVMDYSQFSNVTIQGNFINNQGTINYLVRGGNIETLSVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNATNNARFARYALIKNAPFAQTNATPNLVAINKHDFGTIESVFELANRSKDIDTLYAHSGAQGRDLLQTLLIDSHNAGYARTMIDATSANEITKQLNTATDALNNIASLEHKTSGLQTLSLSNAMILNSRLVNLSRRHTNNIDSFAKRLQALKDQRFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGAVGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELKLAKEVFLNLGFVYLHNLISNIGHFASNLGMRYSF

SEQ ID NO: 22353 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNISIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLNVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFASYALIKNAPFAQTSATPNLVAINKHDFGTIESVFELANRSKDIDTLYANSGAQGRDLLQTLLIDSHNAGYARTMIDATSANEITKQLNTATDALNNIASLEHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNGEVEAIVGGFGSYGYSSFSNQANSLNSGANNANFGVYSRIFANKHEFDFEAQGALGSDQSSLNFKSALLRDLNQSYNYLAYGAATRASYGYDFAFFRNALVLKPSVGVSYNHLGSTNFESNSTNKTALKNGASSQHLFNASANVEARYYYGDTSYFYMNAGVLQEFANFGSSNAVSLNTFKVNAARNPLNTHARVMMGGELQLAKEVFLNLGFIYLHNLISNAGHFASNLGMRYSF

SEQ ID NO: 22354 - protein, 1291 aa, Helicobacter pylori
MELQQTHRKINRPLVSLALVGLLVSITPQKSHAAFFTTVIIPAIVGGIATGAAVGTVSGLLGWGLKQAEEANKTPDKPDKVWRIQAGRGFNEFPNKEYDLYKSLLSSKIDGGWDWGNAARHYWVKGGQWNKLEVDMKDAVGTYKLSGLRNYTGGDLDVNMQKATLRLGQFNGNSFTSFKDSADRTTRVDFNAKNILIDNFLEINNRVGSGAGRKASSTVLTLQASEGITSGKNAEISLYDGATLNLASNSVKLMGNVWMGRLQYVGAYLAPSYSTINTSKVTGEVNFNHLTVGDRNAAQAGIIASKKTYIGTLDLWQSAGLNIIAPPEGGYKDKPNNTNSQSGAKNDKNESAKNDKQDSNTQVINPPNSGQKTEIQPTQVIDGPFAGAKDTVVNINRINTNADGTIKVGGYTASLTTNAANLNIGKGGVNLSNQASGRSLLVENLTGNITVDGALMVNNQVGGYALAGSSANFEFKAGVDTKNGTIAFNNNISLGRFVNLKASAHTVNFKDIDTGNGGFNTLDFSGVTNKVNINKLITASTNVAIKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNVTIQGNFINNQGTINYLVRGGNIETLNVGNAAVMSFNNDIDSATGFYKPLIKINSAQDLIKNKEHVLLKAKIIGYENASLGTNSISNANLIEQFNERLALYNNNNRMDTCVVRNTDDIKACGMAIGDQAMVNNPDNYKYLIGKAWKNIGISKTANGSKISVRYLGNATPAENGGNTTNLPTNTTNNARFASYALIKNAPFAQTSATPNLVAINKHDFGTIESVFELANRSKDIDTLYANSGAQGRDLLQTLLIDSHNAGYARTMIDATSANEITKQLNTATDALNNIASLEHKTSGLQTLSLSNAMILNSRLVNLSRRHTNNIDSFAKRLQALKDQKFASLESAAEVLYQFAPKYEKPTNVWANAIGGASLNSGGNTSLYGTSAGVDAYLNEKVEAIVGGFGSYGYSSFNNQANSLNSGANNANFGVYSRIFANRHEFDFEAQGALGSDQSSLNFRSALLRDLNQSYNYLAYSAATRASYGYDFVFLRNALVLKPSVGVSYNHLGSTNFESNSTHKTALKNGASSQHLFNASANVEARYYYGDTSYFYMNAGVLQEFAHVGSNNAASLNTFKVNATRNPLNTHARVMMGGELKLAKEVFLNLGFIYLHNLISNIGHFASNLGMRYSF

SEQ ID NO: 22355 - protein, 1296 aa, Helicobacter pylori
MEIQQTHRKINRPLVSLALVGALVSITPQQSHAAFFTTVIIPAIVGGIATGTAVGTVSGLLSWGLKQAEEANKTPDKPDKVWRIQAGKGFNEFPNKEYDLYRSLLSSKIDGGWDWGNAARHYWVKGGQQNKLEVDMKDAVGTYTLSGLRNFTGGDLDVNMQKATLRLGQFNGNSFTSYKDSADRTTRVDFNAKNISIDNFVEINNRVGSGAGRKASSTVLTLQASEGITSDKNAEISLYDGATLNLASSSVKLMGNVWMGRLQYVGAYLAPSYSTINTSKVTGEVNFNHLTVGDKNAAQAGIIANKKTNIGTLDLWQSAGLNIIAPPEGGYKDKPNNTPSQSGAKNDKNESAKNDKQESSQNNSNTQVINPPNSAQKTEVQPTQVIDGPFAGGKDTVVNINRINTNADGTIRVGGFKASLTTNAAHLHIGKGGVNLSNQASGRSLIVENLTGNITVDGPLRVNNQVGGYALAGSSANFEFKAGTDTKNGTATFNNDISLGRFVNLKVDAHTANFKGIDTGNGGFNTLDFSGVTDKVNINKLITASTNVAVKNFNINELIVKTNGISVGEYTHFSEDIGSQSRINTVRLETGTRSLFSGGVKFKGGEKLVIDEFYYSPWNYFDARNIKNVEITNKLAFGPQGSPWGTSKLMFNNLTLGQNAVMDYSQFSNLTIQGDFINNQGTINYLVRGGKVATLSVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGDQSMVNNPDNYKYLIGKAWKNIGISKTANGSKISVYYLGNSTPTENGGNTTNLPTNTTSNARSANNALAQNAPFAQPSATPNLVAINQHDFGTIESVFELANRSKDIDTLYANSGAQGRDLLQTLLIDSHDAGYARKMIDATSANEITKQLNTATTTLNNIASLEHKTSGLQTLSLSNAMILNSRLVNLSRRHTNHIDSFAKRLQALKDQKFASLESAAEVLYQFAPKYEKPTNVWANAIGGTSLNNGSNASLYGTSAGVDAYLNGQVEAIVGGFGSYGYSSFNNRANSLNSGANNTNFGVYSRIFANQHEFDFEAQGALGSDQSSLNFKSALLQDLNQSYHYLAYSAATRASYGYDFAFFRNALVLKPSVGVSYNHLGSTNFKSNSTNQVALKNGSSSQHLFNASANVEARYYYGDTSYFYMNAGVLQEFAHVGSNNAASLNTFKVNAARNPLNTHARVMMGGELKLAKEVFLNLGVVYLHNLISNIGHFASNLGMRYSF

SEQ ID NO: 22356 - protein, 346 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYTYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 22357 - protein, 348 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDDNVNAWESGKFTGNVLEISGMAKRGHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 22358 - protein, 350 aa, Neisseria gonorrhoeae
MKKSLIALTLAALPVAATADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYQNQLVRDNSHNSQTEVAATVAYRFGNVTPRVSYAHGFKGTVDSADHDNTYDQVVVGAEYDFSKRTSALVSAGWLQEGKGADKIVSTASAVVLRHKF

SEQ ID NO: 22359 - protein, 347 aa, Neisseria gonorrhoeae
MKKSLIALTLAALPVAATADVTLYGAIKAGVQTYRFVEHTNGKVSKVETGSEIADFGSKIGFKGQEDLGNGLKAVWQLEQGASVAGTNTGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYQNSGLFAQYAGLFQRYGEGTKKMEGYYLYNIPSLFVEKLQVHRLVGGYDNNALYASVAAQQQDAKLYGTWSANSHNSQTEVAATVAYRFGNVTPRVSYAHGFKGTVDSADHDNTYDQVVVGAEYDFSKRTSALVSAGWLQEGKGADKIVSTASAVVLRHKF

SEQ ID NO: 22360 - protein, 299 aa, Neisseria meningitidis
GVETSRSVKHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQDVDDVKIEKYQIHRLVSGYDNDALHASVAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGLRH

SEQ ID NO: 22361 - protein, 299 aa, Neisseria meningitidis
GVETSRSVFHQNGQVTEVTTGTGIVDLGSKIGFKGQEDLGNGLKAIWQVEQKASIAGTDSGWGNRQSFIGLKGGFGKLRVGRLNSVLKDTGDINPWEGKSDYLGVNKIAEPEARLISVRYDSPEFAGLSGSVQYALNDNAGKHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLR

SEQ ID NO: 22362 - protein, 298 aa, Neisseria meningitidis
GVETSRSLDYQDGQVYSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHQNVDDVKIEKYQIHRLVSGYDNDALYASVAVQQQDAKLVEDNSHNSQTEVAATLAYRFGNVTPRVSYAHGFKGSFDDADIGNEYDQVVVGAEYDFSKRTSALVSAGWLQEGKGAYKFVSTAGGVGLRH

SEQ ID NO: 22363 - protein, 323 aa, Neisseria meningitidis
EVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENAGFFGQYAGSFAKYADLNKDAERVAVNTPNAHAVKDYQVHRVVAGYDANDLYVSVAGQHEAAKNNMVGSTDIGKKHEQTQVAATAAYRFGNVTPRVSYAHGFKAKVNGKKAARYQYDQVIVGVDYDFSKRTSALVSAGWLQEGKGKNKTEKTASM

SEQ ID NO: 22364 - protein, 396 aa, Neisseria meningitidis
MRKKLTALVLSALPLAAVADVSLYGEIKAGVEGRNYQLQLTEAQAANGGASGANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYKPAYWTTVNTGSATTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAIVSGAWLKRNTGIGNYTQINAASVGLR

SEQ ID NO: 22365 - protein, 384 aa, Neisseria meningitidis
MRKKLTALVLSALPLAAVADVSLYGEIKAGVEGRNFQLQLTEPPLKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRDAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLR

SEQ ID NO: 22366 - protein, 238 aa, Neisseria meningitidis
ASEDGSRSPYYVQADLAYAAERITHDYPQATGANNTSTVSDYFRNIRAHSIHPRVSVGYDFGDWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGMRYRF

SEQ ID NO: 22367 - protein, 241 aa, Neisseria meningitidis
ASEDGSRSPYYVQADLAYAAERITHDYPKPTGANNTSTVSDYFRNIRAHSIHPRVSVGYDFGGWRIAADYASYRKWNDNKYSVNTKELQRNKEHGNWIELKTENQGNGSFHAVSSLGLSAIYDFKLNDKFDKFKPYIGARIAYGHVKHQVHSVETETTIIFTTPTKGAKVGGTITHNSMSKPPYHESNSISSLGLGVIAGVGFDITPKLTLDTGYRYHNWGRLENTRFKTHEVSLGVRYRF

SEQ ID NO: 22368 - protein, 239 aa, Neisseria meningitidis
ASEDGSRSPYYVQADLAYAAERITHNYPEPTGADKDKISTVSDYFRNIRAHSIHPRVSVGYDFGGWRIAADYARYRKWNNNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRLGLGVVAGVGFDITPKLTLDTGYRYHNWGRLENTRFKTHEVSLGMRYHF

SEQ ID NO: 22369 - protein, 381 aa, Neisseria meningitidis
MRKKLTALVLSALPLAAVADVSLYGEIKAGVEGRNYQLQLTEAQAANGGAGASGQVKVTKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFELFLLGSGSDQAKGTDPLKNHQVHRLTGGYEEGGLNLALAAQLDLSENADKTKNSTTEIAATASYRFGNAVPRISYAHGFDLIERGKKGENTSYDQIIAGVDYDFSKRTSAIVSGAWLKRNTGIGNYTQ

SEQ ID NO: 22370 - protein, 403 aa, Neisseria meningitidis
MRKKLTALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGASQWGNRESFIGLAGEFGTLRAGRVANQFDDASQAINPWDSNNDVASQLGIFKRHDDMPVSVRYDSPEFSGFSGSVQFVPAQNSKSAYKPAYYTKDTNNNLTHTKDTNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 22371 - protein, 889 aa, Helicobacter pylori
MYYLLGLCSFTSQATLIPPPGFESLLEGQTEQIEVLLPGHSLGLFPVVVKPDTVQFMSPLMVLESSGLAALPAAERQKALAALSRPLLRNSNLVCGVSEAKDSSECGYVATDKEDVAVIFDENNAQLSLFLNRDWLPDEERRDKRWLTPTPEGVSAFIHRQTLYLSDDLHSRNMTLNGSGALGLGDGRYLGGDWAAIWNQSEHYNNSQAWFDNLFVRQDLGNQYYLQAGRMDQRNLSSATGGDFGFSLLPLSRFDGLRTGTTQAYVNHEVDHNATPVMVQVTRNARIDIYRGSELLGSQFLTPGMHTLDTHSLPPGSYPLALRVYEDGILRRTETQPFSKGGNSFSAQTQWFIQGGLEDTGDKASHYDGETVMAAGFQTGLRKNISLTEGISLAHEAWYSETRLNSQHAVLDGTLDLSAGILHGTDSTSGNTEQVTYNDGFSASLWRNHTESDACSGRHPQSVHASMTCQTSMNASLSVSVGNWYALLGYSTSRTEGRPVYRGYDDNSDKENVFWRQAYIPASHRESAQASATYSLNMAGMNINTHGGVWRTRNDGVNDDGLFMSVSVSYASQPPTMTGSNRYTSAGTDIHSSRNQKTQTSWNVNHVRSWQQDLYRELSVGFSGYNDDSWSGSLGGRMSGRMGELSATISNSHQRNAGSASSLTAGYSSSLALSRNGLFWGGGQDGEPASGMAVNVESEGDEGSSGKVVSVRGSSQPFSLGFGQQSLLLMEGYNATEVTIEDAGVSSQGMAGVKAGGGSRCYFLTPGHLLVHNISASMSRLYVGRVLDKDGRPLLDAQPLNYPFLSLGPSGRFSLQSEHKESSLWLLSKNRILRCPMSVHKRRDVMQVVGDVRCELSDVDALPQALQISPRVIRLLNVAGLLRHSVQEA

SEQ ID NO: 22372 - protein, 228 aa, Pseudomonas putida
MSRLRVFAFAVLGLLGFSSHSYAVEYPPGVEVEEPYEVYEEEVVDGLITPPEYDWDGFYLGVQGGWARLHGTNRFNNSGSQYNGGTVGLYGGYNYTYQNILIGVEGEGAYWAFGERSRGEMSLRSDYFAAAKIRAGLTYDWFMAYVTGGAAVSTFRASNPNFGPGTDSNTMLGWVGGAGLEMFVTERIIVRLDYERIVFPGRSFTVGGTRFKEDIDSDAIRLGVSYKF

SEQ ID NO: 22373 - protein, 333 aa, Klebsiella pneumoniae
LMMMGFVASTATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDLTLQYQGKNEGCEAKKQNGDGVGTSLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDD

SEQ ID NO: 22374 - protein, 445 aa, Chlamydia pneumoniae
MVITNLSINADTIYGKNPINIVASAANKNITLTGTLALVNADGAFYENHTLQDSQDYSFVKLSPGAGGTIITQDASQKPLEVAPSRPHYGYQGHWNVQVIPGTGTQPSQANLEWVRTGYLPNPERQGSLVPNSLWGSFVDQRAIQEIMVNSSQILCQERGVWGAGIANFLHRDKINEHGYRHSGVGYLVGVGTHAFSDATINAAFCQLFSRDKDYVVSKNHGTSYSGVVFLEDTLEFRSPQGFYTDSSSEACCNQVVTIDMQLSYSHRNNDMKTKYTTYPEAQGSWANDVFGLEFGATTYYYPNSTFLFDYYSPFLRLQCIYAHQEDFKETGGEVRHFTSGDLFNLAVPIGVKFERFSDCKRGSYELTFAYVPDVIRKDPKSTATLASGATWSTHGNNLSRQGLQLRLGNHCLINPGIEVFSHGAIELRGSSRNYNINLGGKYRF

SEQ ID NO: 22375 - protein, 847 aa, Chlamydia pneumoniae
MLFSKKRLPLAVAVTAFVAAAPVAAQQLEEVIVTAQKRAENLQDVPISVSTVSGEKIADNTIVNFAALADFVPSLHIADAPVNTNIYMRGIGSGNNRGFEQSVGMYLDGVYLGRGRQYRSALMDVERIEVLRGPQGTLFGKNTVAGAINISSASPVVGDEASGAINASIEENGGQIYDAYIQGGSDTFAARLALRYRETDGYIYNAYLEEDEGALQETGGRLTLVWEPSDTFSANMKYTNMRRDRNGSASATAQFLDPAQRNIDVPGRSAFADIAYTLMDTFFPDFPSVAGQDFTTYKDNNCGLDTSCSEAGIGYKPENSDDDIQNFSLNMNWDVGNGTLTSVTGWAGYEYNDDVDVDWLPLQFIDRSDIHDFHQFSQEFRWASDIGDRFTYTVGAYYDENELDMEGQVGIDTNFDGLFPQFAQAAFGAPFPNLLTLLTGGAYGSNQIARNHNFNQETESFAFFAQGTYELTDSLRLTAGLRYTEEEKDAVSSQRLGDQNCASDPNPTDPKGVGMTGACPEGYSYFLDIIQAQNFNTYNKQWVGSRKTDDLSPSLNLQWDMSDSSMLYASWSQGFKSGGFSAADDGEPGDFGVAQLPPPGGFVSTVPNADFEFDDESVDSIEIGGKHEFLDGAMRLNWAAFYSEYEDLQTTIFKGVGFSVKNAASSEVQGFEVDWLLQVTDALRVGVNAAYLDATYGDFPDGPCNAIQLDENSLCGTPQGIAAGGPSAQNDLTGVNTLYASDWSGNAFADFRMPLGAMELFAGVDVNYRSDFMSAGDNDEKDGIDAYTKVNARIGLGGDRWEIMAYGRNIFDEAALQQSFDTPVLAGSHTQYMDEGAVFGVRGTLRF

SEQ ID NO: 22376 - protein, 704 aa, Acinetobacter sp.
MFPGTPPYPRLLLLTALLGGQAVADDLFIDNTDLPQVLTATRLKQSPAAVPGSMTVLDSELIRASGARDIPELLRLVPGMMIGYGAGNQPTVNYHGSNVNDARRMQVLIDGRSVYRAGLATVDWSDIPLAMEDIERIEVFRGPNTVSYGANALMAVVNILTRKPADSHGTRLKVTRGQDGINDFYASHGLGWDGGDMRLSLSGQQDDGFDENQFGQDYRDSRRLTRFNLSANHNLAVDQTLEWQLAAKEGSNQRPYTYQPVFQQYESGNNADVNAKDYAGSLRWTKDFSAEHSLYIQGSAQHFDRQQVWRACDALQSFSPELTQLWQMNPDFAEKVARGIATGAPLSTDDPAMKGLLQKVQQQWEQGGQEQVCGDVDQSTRETRYDLEIQDTLSLTDSLRLLSGMNYRYDRADSQTYFNGSIDDQTWRLFGQLEWRADEHWILQGGAMFEDSRLSGSSLTPRVAVNYLITPRHGLRAVYSEAVRSPDMFENNVNWSYTVKNLTPNSFGLQNGEYFVKTRGPGDLEQERMRSRELGYNGYFSDLDLSLDVKLFYDEITGMISEPLRNNQYIASNANKARFSGSEAQMDWRPTLRDRLRLTYAYVDAWASNPDDRRLSARNSGSAGWMREWGAGWSSALFYYGDDALNQYRYERLDLRLAKRFRVYGSNLELAALWQQRLDDEPTSALQNRYDSRHRLSVSAELEF

SEQ ID NO: 22377 - protein, 182 aa, Wolbachia sp. wTai
SYYVRLQYNGEILPFYTKIDGITNATGKDKDSPFKASFPTLAGSGAFGYKMDDIRVDVEGLYSQLAKDATAVSDNKAADSVTAFSGLVNVYYDIAIEDMPITPYVGVGVGAAYISNPSKANAVKEQKGLGFAYQAKAGVSYDVTPEIKLFAGARYFGSYGASFNKETVSATKEINVLYSAVG

SEQ ID NO: 22378 - protein, 161 aa, Wolbachia sp. wCep
KTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKEFGFAYQAKAGVSYDVTPEIKLYAGARYFGSYGASFNKEAVSATKEIN

SEQ ID NO: 22379 - protein, 172 aa, Wolbachia sp. wSca
  misc_feature (2)..(4): Xaa can be any naturally occurring amino acid
SXXXCFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGNSYSRRT

SEQ ID NO: 22380 - protein, 182 aa, Wolbachia sp. wVul
  misc_feature (3)..(3): Xaa can be any naturally occurring amino acid
  misc_feature (156)..(156): Xaa can be any naturally occurring amino acid
  misc_feature (159)..(159): Xaa can be any naturally occurring amino acid
  misc_feature (163)..(163): Xaa can be any naturally occurring amino acid
  misc_feature (172)..(172): Xaa can be any naturally occurring amino acid
  misc_feature (176)..(176): Xaa can be any naturally occurring amino acid
  misc_feature (179)..(179): Xaa can be any naturally occurring amino acid
SYXLREQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYXGSXGANXGKTAKDDGXTKVXYTXLGP

SEQ ID NO: 22381 - protein, 199 aa, Wolbachia sp. group A
GPISDEETSYYVRLQYNGEILPLFTKTDGITNATGKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANLGKAGKATKDDAGIKVLYSTVGAEAGVAFNF

SEQ ID NO: 22382 - protein, 181 aa, Wolbachia sp. wCauB
SYYVRLQYNGEVLPFKTKIDGVTYKSGKDNNSPLKPSFLAGGGAFGYKMDDIRVDVEGLYSQLSKDADVVDTSPAVVESLTAFSGLVNVYYDIAIEDMPITPYVGVGVGAAYVSNPLVTEITGDKKSGFGFACQAKAGVSYDVTPEIKLYAGARYFGSYGANFGKTAKDDGGIKVLYSTVG

SEQ ID NO: 22383 - protein, 458 aa, Burkholderia pickettii
MKGNYVRAATAICVAICGTHARATDVFNLEGFGPVSRAMGGTGAAFDIGPAAMMENPATLGLMGEGRHFSLGLDVVSTDIKVTNTATGETASSGNHGNNNGPYFAPQTAFVYRQGRYAFGAGIFAEGGLGTQYGGSSFLSRTSNGVDTGLDQFSRLLVLRVPFSAAYHVTDKLTVGASVDAVWTSLNLGTLLDVSQIGTLAGQGRVSGTLVPTLLGVPGLSGGSIDFSRNAPVGGGAQAWGIGGRLGLTYQVTPDTRIGAAYQAKTHVGDLTGQATLSAVSSVAGNIPLKGDVTVRNFQMPAQLTVGISHQFNDQLSVSADYQRVFWSSVMKDMTVGFVQSGSGANLDLSLPQNYRDISVFGIGAEYRYNAKWTFRGGFHYAQEAIPGNMLLAVVPATPTTSLTGGVSYAIGKNDVIDFALSVALRKTLDNASQPNTAVPISVTHSQVNAVIAYQKRF

SEQ ID NO: 22384 - protein, 122 aa, Pseudomonas sp. BG33R
LKKNTADTTDTTDLYTASFIAGGGAFGYKMDDIRVDVEGIYSQLNQDTTVTGTSVPAGGIAKNLTAISGLVNVYYDIAIEDMPITPYVGVGVGAAYVSNPLAKKADDNKASGFGVAYQAKAG

SEQ ID NO: 22385 - protein, 828 aa, Pseudomonas sp. BG33R
MPTNPVLTHTFIPNDIRPVLQSAHLRHAIRAVLFGTALGLATAPQLSVAADTAEVSHDYAIPAGQLTDVLNKIARQAGITLSSTPQLTDGLHSNGLQGKFTTDQALRQLLNGSGLEAVSQGGRNYVLQAQRQSAALALPDTDIRSFSLGNALGSMEGYNATHSQVATKTSMPLVETSQSVSVVTRQQMDDQGSQTVAQAMRYTPGVLTNPYGATHRYDYVAMRGFNDGSVDNIYVDGLKSMGDNGTYSTMQVDPYFLERIDILKGPSSVLYGRSSPGGLVALTTKKPLFAPYHQVQATVGTQGQRGVGFDFSGPVDDDKRIAYRLTGLADASDTQFDHNKEERYAIAPAISVDFTEDTSLTLQAYLQHDPDGGYHGGNPADGMLHKRNGLRLSDHFFEGEPSIDNYERTQQSFSYQFEHRFNDVFTARQNFRYQDSDVSMDQVYSAGWADVDSNKLNRAYTGGDERLHSYIIDNMLQAEFFTGAAKHTLLLGADYQRRKADVAWRYGTVGPLDAGNPQYGNGNLQVLGENRYQRRLQQTGVYLQDLVELDQWRFSLGLRQDWVKVSEENRDSDSKVSDQRSRFTSRAGVLYLFENGIAPYISYSESFNPNTVSDQQGRPLAPTEGTQWEAGIKYQPPGSDNLFTASVFRIEQENLASKQPDEDFYRPVGEVRSQGLELEAHVQLTDSLKLLSGYTFTDIEYSKSMPSLVSGNLDNKGNSPTQAPKQMLSLWADYNFRQGALDGLRLGGGVRYVGYSWVDAENSMTVPSYTLFDASIGYDLGKVGLAGVDVRLNANNLTNENYITSCASLNYCYMGEERNVSATVSYQF

SEQ ID NO: 22386 - protein, 318 aa, Zymomonas mobilis [sequence omitted]

SEQ ID NO: 22387 - protein, 1135 aa, Zymomonas mobilis
MNFPTITRNNWMCCSIILVFLALGSPEPLQAQENQKERITIQVKNQPIQKVFDDLSKQTGLKFFYGEAIANRNVQVNLKFKNAPVNSVLNEITRQANLYFKRENNTIAVSLGNAGNASVPVTQDRKVTGIITDERGEPIIGANVVVKGTSNGTVTDLNGQYSIEANGKSILLISYIGYLSEEVAVGNNKTLNIQLKEDTQKLDEVVVIGYGTQKRSNLSGAISKISSEVIDSKPVTNVLSALQGEIPGMVVQRTSGQPGNEEFDLNVRGASSTNGGNTPLVLVDGIPGDMNMINPQDIEAISVLKDASASIYGSRAAGGVVLITTKKGKSGAPKLTYNGNLAITKMTGIMKAPTNYEMAIMDNEANIHNGAAPLYTQELLDRILANDPNPIDHPTQPGWKLFFTNTDWMDELLTNGVQHRHNLTISGGGEKSNYYLSAGYSKQFGVVKYADDNNTKYNLRMNYDYRLAKWLKLETKVSLDNQKRTDIGSNGAWVIGEAMFDMPNFPIYNANGEFFTQGGWSNAIALAKESETATFNTREMNGNFRLIADITDGLVFNAQVGLNYKNKNNEDIAKAIPLYTWDGDINYYTGAGSPEQSAVDRTTEETIYQNYTAYLNYNKNFGLDHHLDAMLGMAYEAEEVRMFMARRDNFITDELWELNLGGTGNMKNDAKAEHWATSSAFARIGYSFKNKYILETNFRYDGSSRFAPGNRWRMFPGVSASWRISQEEFLKSSKVFNELKLRASYGQTGNQEGIRLYDYIQLLKFRDDGWGTKLTYPFGSGSQTQAMGLDVLAGVNRTWEILENINAGIDAAFLDSRLGFSFDYFVKMNNNMLIPVTYPSMLGATPPDTNSGKLRTNGFELTLNWTDKIGNVEYSAQFQLSDAKNKLVEYGGSDTYELGLNKTREGYPINSYFAYVYDGVVKDQADLDAYKKLEGVPSNIGIGDAKFKDLNGDGKISTYGDKEGDDGDAKYVGSTTPRYTFGLNLGAKWNNFDISVFFQGVAKRTLFREGEFSMPWSDWWRYPPQFYYGQTWNEDRQDAYYPRLTHGDIRHWNYQASTMQKINAAYVRLKNIQIGYTLPKSLLQKIGIERTRFYVSGQDLFEIHGVKGGWDPESDTGGFNYPFQRYYSFGIDLTF

SEQ ID NO: 22388 - protein, 634 aa, Vibrio cholerae
MRNIRPSQIGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPIYGNYTPIDESSAADRTITKEQASLYAQYQIKLDQQWIGLIGGRMDWVDTENESQKNAQRKSRSDAEFSFNAGLMYLASNGVSPYLSYSQSFDVLSTIDSATGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAQLGLQRLDVWLRRTLCRRVKR

SEQ ID NO: 22389 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSMPSFVEKLQVHRLVGGYDNNALYVSVAAQQQDAKLYNSHNSQTEVAATVAYRFGNVTPRVSYAHGFKGTVDSANHDNTYDQVVVGAEYDFSKRTSALVSAGWLQEGKGADKIVSTASAVVL

SEQ ID NO: 22390 - protein, 319 aa, Neisseria gonorrhoeae
DVTLYGAIKAGVQTYRSVEHTDGKVSKVETGSEIADFGSKIGFKGQEDLGNGLKAVWQLEQGASVAGANTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQAYSIPTFVEKLQVHRLVGGYDNNALYVSVAAQQQDAKLYNSHNSQTEVAATVAYRFGNVTPRVSYAHGFKGTVDSANHDNTYDQVVVGAEYDFSKRTSALVSAGWLQEGKGADKIVSTASAVVL

SEQ ID NO: 22391 - protein, 319 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFIGLKGGFGTIRAGSLNSPLKNTGANVNAWESSKFTGNVLEISGMAQREHRYLSVRYDSPEFAGFSGSVQYAPKDNSGSNGESYHVGLNYRNSGFFAQYAGLFQRYGEGTKKIEYNDQAYSIPSFVEKLQVHRLVGGYDNNALYVSVAAQQQDAKLYNSHNSQTEVAATVAYRFGNVTPRVSYAHGFKGSVHSADYDNTYDQVVVGAEYDFSKRTSALVSAGWLQEGKGAEKIVSTASAVVL

SEQ ID NO: 22392 - protein, 319 aa, Neisseria gonorrhoeae
DVTLYGAIKAGVQTYRSVEHREGKVVGVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDNQSYSMPSFVEKLQVHRLVGGYDNNALYVSVAAQQQDAKLYNSHNSQTEVAATAAYRFGNLTPRFSYAHGFKGSVHSADYDNTYDQVVVGAEYDFSKRTSALVSAGWLQEGKGAEKIVSTASAVVL

SEQ ID NO: 22393 - protein, 319 aa, Neisseria gonorrhoeae
DVTLYGAIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYRNSGFFAQYAGLFQRYGEGTKKIEYEHQVYSIPSFVEKLQVHRLVGGYDNNALYVSVAAQQQDAKLYNSHNSQTEVAATVAYRFGNVTPRVSYAHGFKGTVNSADHDNTYDQVVVGAEYDFSKRTSALVSAGWLQEGKGADKIVSTASAVVL

SEQ ID NO: 22394 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYSDQAYSMPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 22395 - protein, 312 aa, Neisseria gonorrhoeae
DVTLYGTIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHVRVDENVNIEKYQIHRLVSGYDNDALHASDAVQQQDAKLVEDNYSHNSQTEVAATLAYRFGNVTPRVSYAHGFKGSFDDADLSNDYDQVVVGAEYDFSKRTSALVSAGWLQEGKGENKFVSTAGGVGIRHKF

SEQ ID NO: 22396 - protein, 319 aa, Neisseria gonorrhoeae
DVTLYGAIKAGVQTYRSVEHTKGKVSSVETGSEIADFGSKIGFKGQEDLGNGLKAIWQLEQGASVAGTNSGWGNKQSFVGLKGGFGTIRAGSLNSPLKNTGANVNAWESGKYTGEFLEISKMAQREHRYLSVRYDSPEFAGFSGSVQYAPKDNSGSNGESYHVGLNYRNNGFFAQYAGLFQRYGEGTKKIEYEYQVYSIPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSVGWLQGGKGADKIVSTASAVVL

SEQ ID NO: 22397 - protein, 319 aa, Neisseria gonorrhoeae
DVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSVPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 22398 - protein, 317 aa, Neisseria gonorrhoeae
DVTLYGAIKAGVQTYRSVEHRKGKVVGVETGSEISDFGSKIGFKGQEDLGNGLKAVWQLEQGASVAGANSGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKVEGYAYNIPSFVEKLQVHRLVGGYDNNALYASVAAQQQDAKLYNSHNSQTEVAATVAYRFGNVTPRVSYAHGFKGTVDSADYDNTYDQVVVGAEYDFSKRTSALVSAGWLQEGKGADKIVSTASAVVL

SEQ ID NO: 22399 - protein, 319 aa, Neisseria gonorrhoeae
DVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 22400 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQDYSMPSFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22401 - protein, 317 aa, Neisseria gonorrhoeae
DVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKMEGYTYNIPSFVEKLQVHRLVGGYDNNALYASVAAQQQDAKLYNSHNSQTEVAATAAYRFGNLTPRVSYAHGFKGSVHSADYDNTYDQVVVGAEYDFSKRTSALVSAGWLQEGKGAEKIVSTASAVVL

SEQ ID NO: 22402 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDDNVNAWESGKFTGNVLEISGMAQREHRYLSVRYDSPEFAGFSGSVQYAPKDNSGSNGESYHVGLNYQNSGFFAQYAGLFQRYREGTKKIEYEHQVYSIPSFVEKLQVHRLVGGYDNNALYVSVAAQQQDAKLYNSHNSQTEVAATAVYRFGNVTPRVSYAHGFKGTVDSADHDNTYDQVVVGAEYDFSKRTSALVSAGWLQEGKGADKIVSTASAVVL

SEQ ID NO: 22403 - protein, 331 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSPSLFVEKLQVHRLVGGYDNNALYVSVAAQQQDAKLYGARRANSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 22404 - protein, 317 aa, Neisseria gonorrhoeae
DVTLYGAIKAGVQTYRSVEHTKGKVSSVETGSEIADFGSKIGFKGQEDLGNGLKAIWQLEQGASVAGTNSGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKIEGYQYNIPSFVEKLQVHRLVGGYDNNALYVSVAAQQQDAKLYNSHNSQTEVAATGIYRFGNVTPRVSYAHGFKGTVDSADHDNTYDQVVVGAEYDFSKRTSALVSAGWLQEGKGADKIVSTASAVVL

SEQ ID NO: 22405 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYGDQAYSMPSFVEKLQVHRLVGGYDNNALYVSVAAQQQDAKLYNSHNSQTEVAATAAYRFGNVTPRVSYAHGFKGTVDSADHDNTYDQVVVGAEYDFSKRTSALVSAGWLQEGKGADKIVSTASAVVL

SEQ ID NO: 22406 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGGRTKKIEYDGQAYSIPSFVEKLQVHRLVGGYDNNALYVSVAAQQQDAKLYNSHNSQTEVAATVAYRFGNVTPRVSYAHGFKGTVDSADYDHTYDQVVVGAEYDFSKRTSALVSAGWLQEGKGADKIVSTASAVVL

SEQ ID NO: 22407 - protein, 319 aa, Neisseria gonorrhoeae
DVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSFVEKLQVHRLVGGYDNNALYVSVAAQQQDAKLYNSHNSQTEVAATAAYRFGNVTPRVSYAHGFKGTVDSADHDHTYDQVVVGAEYDFSKRTSALVSAGWLQEGKGADKIVSTASAVVL

SEQ ID NO: 22408 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSFVEKLQVHRLVGGYDNNALYVSVAAQQQDAKLYNSHNSQTEVAATVAYRFGNVTPRVSYAHGFKGTVDSANHDNTYDQVVVGAEYDFSKRTSALVSAGWLQEGKGADKIVSTASAVVL

SEQ ID NO: 22409 - protein, 313 aa, Neisseria gonorrhoeae
DVSLYGTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGSVGLRHKF

SEQ ID NO: 22410 - protein, 319 aa, Neisseria gonorrhoeae
DVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQNYSMPSFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22411 - protein, 303 aa, Neisseria gonorrhoeae
DVTLYGTIKVGVETSRSVAYHGAQADRVKTATEIADLGSKIGFKGQEDLGNGLKAIWQLEQKAYVSGTLEGWGNRQSFIGLKGGFGKVRVGRLNSVLKDTGGFNPWEGKSYYLGLSNIVQPEERHVSVRYDSPEFAGFSGSVQYVPNDNSGKNRSESYHAGFNYKNSGFFVQYAGSYKRHNFTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVATVGGVG

SEQ ID NO: 22412 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSIPTFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22413 - protein, 328 aa, Neisseria gonorrhoeae
DVTLYGAIKAGVQTYRSVGHREGKVVGVETGSEISDFGSKIGFKGQEDLGNGLKAVWQLEQGASVAGTNTGWGNKQSFIGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKMEGYYLYNIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGAEKIVSTASAVVLRHKF

SEQ ID NO: 22414 - protein, 319 aa, Neisseria gonorrhoeae
DVTLYGAIKAGVQTYRSVEHTDGKVSKVETGSEIADFGSKIGFKGQEDLGNGLKAVWQLEQGASVAGTNTGWGNKQSFVGLKGGFGTIRVGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDSQAYSMPSFVEKLQVHRLVGGYDNNALYVSVAAQQQDAKLYNSHNSQTEVAATAAYRFGNVTPRVSYAHGFKGTVDSANHDNTYDQVVVGAEYDFSKRTSALVSAGWLQEGKGADKIVSTASAVVL

SEQ ID NO: 22415 - protein, 319 aa, Neisseria gonorrhoeae
DVTLYGAIKAGVQTYRSVGHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSFVEKLQVHRLVGGYDNNALYASVAAQQQDAKLYNSHNSQTEVAATAAYRFGNLTPRVSYAHGFKGSVHSADYDNTYDQVVVGAEYDFSKRTSALVSAGWLQEGKGAEKIVSTASAVVL

SEQ ID NO: 22416 - protein, 317 aa, Neisseria gonorrhoeae
DVTLYGVIKAGVQTYRSVEHREGKVVGVETGSEISDFGSKIGFKGQEDLGNGLKAVWQLEQGASVAGANSGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKMEGYTYNIPSLVEKLQVHRLVGGYDNNALYASVAAQQQDAKLYNSHNSQTEVAATVAYRFGNVTPRVSYAHGFKGTVDSADHDNTYDQVVVGAEYDFSKRTSALVSAGWLQEGKGADKIVSTASAVVL

SEQ ID NO: 22417 - protein, 303 aa, Neisseria gonorrhoeae
DVTLYGTIKAGVETSRSVAHHGAQADRVKTATEIADLGSKIGFKGQEDLGNGLKAIWQLEQKAYVSGTDTGWGNRQSFIGLKGGFGKVRVGRLNNILKDTGGFNPWEGKSYYSGLSNIAQPEERHVSVRYDSPEFAGFSGSVQYVPNDNSGKNHSESYHAGFNYKNSGFFVQYAGSYKRHNYTTEKHQVHRLVGGYDHDALYASVAVQQQDAKLTWRDDNSHNSQTEVAATVAYRFGNVTPRVSYAHGFKGSVYDADHDNTYDQVVVGAEYDFSKRTSALVSAGWLQKGKGAEKFVATVGGVG

SEQ ID NO: 22418 - protein, 308 aa, Neisseria gonorrhoeae
DVTLYGTIKVGVETSRSVAYHGAQADRVKTATEIADLGSKIGFKGQEDLGNGLKAIWQLEQKAYVSGTLEGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGSYKRHNFTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVVTVGGVGLRHKF

SEQ ID NO: 22419 - protein, 303 aa, Neisseria gonorrhoeae
DVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVG

SEQ ID NO: 22420 - protein, 319 aa, Neisseria gonorrhoeae
DVTLYGAIKAGVQTYRSVTHREGKVVGVKTGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQYYSIPSFVEKLQVHRLVGGYDNNALYASVAAQQQDAKLYNSHNSQTEVAATAAYRFGNLTPRVSYAHGFKGSVHSADYDNTYDQVVVGAEYDFSKRTSALVSAGWLQEGKGAEKIVSTASAVVL

SEQ ID NO: 22421 - protein, 303 aa, Neisseria gonorrhoeae
DVTLYGTIKAGVETSRSVAHHGAQADRVKTATEIADLGSKIGFKGQEDLGNGLKAIWQLEQKAYVSGTLEGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHSYTTEKHQVHRLVGGYDHDALYASVAVQQQDAKLTWSNDNSHNSQTEVAATVAYRFGNVTPRVSYAHGFKGSVYDADNDNTYDQVVVGAEYDFSKRTSALVSAGWLQRGKGTEKFVATVGGVG

SEQ ID NO: 22422 - protein, 303 aa, Neisseria gonorrhoeae
DVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATEAYRFGNVTPRVSYAHGFKGSVYDADNDNTYDQVVVGAEYDFSKRTSALVSAGWLQRGKGTEKFVATVGGVG

SEQ ID NO: 22423 - protein, 303 aa, Neisseria gonorrhoeae
DVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATMAYRFGNVTPRVSYAHGFKGSVYDADNDNTYDQVVVGAEYDFSKRTSALVSAGWLQRGKGTEKFVATVGGVG

SEQ ID NO: 22424 - protein, 303 aa, Neisseria gonorrhoeae
DVTLYGTIKAGVETSRSVAHHGAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHSYTTEKHQVHRLVGGYDHDALYVSVAVQQQDAKLTWSNDNSHNSQTEVAATWAYRFGNVTPRVSYAHGFKGSVYDADNDNTYDQVVVGAEYDFSKRTSALVSAGWLQRGKGTEKFVATVGGVG

SEQ ID NO: 22425 - protein, 303 aa, Neisseria gonorrhoeae
DVTLYGTIKAGVETSRSVAHHGAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHNYTTEKHQVHRLVGGYDHDALYASVAVQQQDAKLTWRNDNSHNSQTEVATTVAYRFGNVTPRVSYAHGFKGSVYDADNDNTYDQVVVGAEYDFSKRTSALVSAGWLQRGKGTEKFVATVGGVG

SEQ ID NO: 22426 - protein, 184 aa, Wolbachia sp.
SYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVG

SEQ ID NO: 22427 - protein, 193 aa, Wolbachia sp.
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTKQVTDAGAYKVLYSTVG

SEQ ID NO: 22428 - protein, 184 aa, Wolbachia sp.
SYYVRLQYNGEFLPLFTKVDGITNATGKEKDSPLKASFIAGGGAFGYKMDDIRVDVEGLYSWLNKDADVVGDTVADNLTAISGLVNVYYDVAIEDMPITPYIGVGVGAAYISTPLKTPINDQKSKFGFAGQVKAGVSYDVTPEIKLYAGARYFGSYGANFDGKKTDPKDSTKQVTDAGAYKVLY

SEQ ID NO: 22429 - protein, 176 aa, Wolbachia sp.
ILPFYTKIEGITNKTGKEKGSPLTRSFIAGGGAFGYKMDDIRVDVEGLYSQLAKDTAVVSTSETKVADSLTAFSGLVNVYYDIAIEDMPITPYVGVGVGAAYISNPSEANDVKDQKGFGFAYQAKAGVSYDVTPEIKLYAGARYFGSYGASFNKETVSANKEINVLYSAVGAEAGV

SEQ ID NO: 22430 - protein, 238 aa, Wolbachia sp.
AGEGNGRGPYVQADLAYAYEHITHDYPKPTDPSKGKLSTVSDYFRNIRTHSIHPRVSVGYDFGGWRIAADYARYRKWNDSKYSVSIKNLQRRTSNGNRRDRKTENQENGSFHAVSSLGLSAVYDFKLNDKFKPYIGARVAYGHVRHSIDSTKKTTEFLTTAGARGTDPTVSSPYKNTQDAHQESNSIRRVGLGVIAGVGFDITPNLTLDAGYRYHNWGRLENTRFKTHEASLGVRYRF

SEQ ID NO: 22431 - protein, 218 aa, Wolbachia sp.
ISGFSGSVQFVPAQNSKSAYKPAYYTKDTNNNNNLTLVPAVVGKPGSDVYYAGLNYKNGGFAGNYAFKYARHANVGRNAFELFLIGSATSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAALD

SEQ ID NO: 22432 - protein, 183 aa, Wolbachia sp.
  misc_feature (176)..(176): Xaa can be any naturally occurring amino acid
YVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDATTGKDKGELXVLYSTST

SEQ ID NO: 22433 - protein, 1241 aa, Vibrio halioticoli
MIKKFKKFIPLFLASSLLAEDNGWYMSVGYQIGGTQQFVNNKQLLENQNIVNSVTQSAISIAGPTNGLITLSSQTVADALGYGVSNTVGNQLEGISNILNQIGKNRKDFFSSRQISSISQQLVGLKGSSNPLKAHSSQITAKLLSTTQSAFNQGVTLNSNIISSINSLNPSDNTQEVKAQLQNTAQSMAALLTQIENNITKTTTTTYAFSLLTNLTQAVNASTNNASYVSALKQALSTLGVGYFPSTTANRVVLNPLGQTAYYAPNTILGSTSANINNQAQYNDTLLMNTINGNLTDSNDSVGCTSQVSCLQQFIQNLSPIATAPSSANPANEQAKTLAQSLQGLAMDILDNNAINNTTYNLNNLHNALTFQAYQSSINQYNIVLKQISWNQFTDPKDLLKNTSNNYQIGTVTNAQGQNISAYDCASATSSGISCSAASSTSNSDNAASNFNHSLVATSQVQTINGKEQIGVNSFNLVSQVWSVYNSLQNSEAQLRKNAEILCKTNGSQSGTQPCNTNNNSSGGLNLIGNSQLQNILSPNGTTMNTPKTTQAAVSVNNEAAKTTATNNNNSTTPSNTAISALNTVLQNVNSFQQNIQQTFQNQQSNIQTWANALYPINGTQGGQSSSQSSSNCSNGSNNDLCIQLRANFYQLINTINQQVPTSMDALIAQSQQQSQQQNGSANTSNNACGNGSGATNWCLQQWSDPKAYYSGLQSALGYTTSATTQNGSGSGSGNTITYNVQQITLTSDGLLSTIIQNLKSVNGNGGNGGSNGNNGSQINTAYQMLTDASEGKLGTYSNSGGSGGGSGGSGGSNNGYQTCTKGTSGGNGSNCYEPNKQQSTTSATTTAATTSSDNLSKVYDDAKKIANIIASSGNNQGVGNGLKQFFDALKSSNGSLNNLCQSGNQGGTTSNCSGGLINLLGAIPTNGVSDTNNLVNLLTRFIQTAGFIQNNNNSNANNLQAMFQAITSAISQGFQALQNDISPNTILTLLQAITSDTTTIQAFSQTLRQLLGDQRFFTVEQKLITAMINARNTVQNAQNQANNYGSQPILSQYAPAASTQHGMSNGLGVGIGYKYFFGKARKLGFRHYLFFDYGYSQIGVAKESVKTNIFGYGIGTDFLWNLFRRTFNTKALNFGIFTGVQLGGTTWLSSLRQQIIDNWGDAKNIQPSNFQVAFNFGFRTNFAEFKRFVKGFHDRGVLSQKSVEFGVKVPFINQVYLKSAGADVSYRRLYTFYINYIKAF

SEQ ID NO: 22434 - protein, 791 aa, Neisseria meningitidis
MKPLQMLPIAALVGSIFGNPVLAADEAATETTPVKAEIKAVRVKGQRNAPAAVERVNLNRIKQEMIRDNKDLVRYSTDVGLSDSGRHQKGFAVRGVEGNRVGVSIDGVNLPDSEENSLYARYGNFNSSRLSIDPELVRNIEIVKGADSFNTGSGALGGGVNYQTLQGRDLLLDDRQFGVMMKNGYSTRNREWTNTLGFGVSNDRVDAALLYSQRRGHETESAGNRGYPVEGAGKETNIRGSARGIPDPSKHKYHNFLGKIAYQINDNHRIGASLNGQQGHNYTVEESYNLTASSWREADDVNRRRNANLFYEWMPDSNWLSSLKADFDYQKTKVAAINTKGLFPTNYTTWETEYHKKEVGEIYNRSMDTRFKRFTLRLDSHPLQLGGGRHRLSFKTFASRRDFENLNRDDYYFSGRVVRTTSSIQHPVKTTNYGFSLSDQIQWNDVFSSRAGIRYDHTKMTPQELNAECHACDKTPPAANTYKGWSGFVGLAAQLNQAWRVGYDITSGYRVPNASEVYFTYNHGSGNWLPNPNLKAERSTTHTLSLQGRSEKGMLDANLYQSNYRNFLSEEQKLTTSGTPGCTEENAYYSICSDPYKEKLDWQMKNIDKARIRGIELTGRLNVDKVASFVPEGWKLFGSLGYAKSKLSGDNSLLSTQPLKVIAGIDYESPSEKWGVFSRLTYLGAKKVKDAQYTVYENKGWGTPLQKKVKDYPWLNKSAYVFDMYGFYKPVKNLTLRAGVYNLFNRKYTTWDSLRGLYSYSTTNAVDRDGKGLDRYRAPGRNYAVSLEWKF

SEQ ID NO: 22435 - protein, 919 aa, Zymomonas mobilis
MGEFYFDTVLEEEIMINKSIERWIILFLSVCFLVHGNLFAQEQENNPTASTTEGASGEGGQQQGKKKKKQADQAEQGYPPVYNQREAPGGRISMPEVTVQTTTPPSSAETFGAPNAAVLPTEQGPLSSTYGIPMSVMDTPRQVTPVNQTMMKASGVVYQGYLDPLSVSQLLPTAYTELNWGMGNAVTIRGRQALPYFNGIEMTLQNDSMAGVPFSWNMIESMDITEGPANAVFGATQPTPGSVNYITKQPYFDKFRGYVWDTTGMYSQYLWGADVGGPVNDKVAWRFSYMGQEQGSYYNNIYNNQQNFYVAIGAKPYENYTVDFYGDFGTYSFMPQLADQINRPTNALIDNGLYTAGMLPPGALAGTLVSPFFVPVNRRADIVNPEGGGEAMTGMLQLIQHVKVSDNIEVVNNTFFWYTRSAWIEPSLYVAAYLSGDYEVDNRTEIRVNFETPLEQTAPEKGQKEMKEYKETAKSEGDEEVKKSFWEGAIGEMLMRHNIDAGIEWHYQRNLDYFGDAFWNAGNVWSMMTTNPLTWNATMLIPFVKAVNNPKGPAGGEWQIPGAPPGWFYEPLNGASGSTDCNYWTVNPFYQHNIDWTSKFSLLFGARANFYFVDASTPPGPVGAPFAHFSTAAFAPLVNISPVYKPFPWMTAYFDYNWLQTTNAAVIGGYAPTFQPNSFSEVNQLIEGGVKFNILKDKMYITTAAFTQNQILNNLGFLPNGAPLPATPTTVEGFEINASYQPDRHFWARLGYIYMRAVEEWSSFPPGLHGPSMRQLTPILPYYTGVPIAGGPFINLPFPISGTMPSSNYAFIGFPDQYFSGTVTYTSDVGLGVTLGAIVMSDQYLNYWYNTKIPTQFILNAQIFYSQPKWEARLYLYNFTDEKYWLPFGLGSAGSRAFNMSSIIAGWPFWIEGTVAWKF

SEQ ID NO: 22436 - protein, 322 aa, Neisseria meningitidis
EVSRVKNQGVKTKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDKDKYEHHKSSRESYHAGLKYENAGFFGQYAGSFAKYADLNTDAERVAVNTANAHPVKDYQVHRVVAGYDANDLYVSVAGQYEAAKNNDVGSTKVGNTKVGKKHEQTQVAATAAYRFGNVTPRVSYAHGFKAKVNGVKDARYQYDQVIVGADYDFSKRTSALVSAGWLKEGKGVNKTEKTASM

SEQ ID NO: 22437 - protein, 316 aa, Neisseria meningitidis
EVSRVKNQGVKTKTATQIADFGSKIGFKGQEDLGNGMKAIWQLEQKASIAGTNSGWGNRQSFIGLKGGFGTVRAGNLNTVLKDSGDNVNAWESGSNTGDVLGLGTIGRVESREISVRYDSPVFAGFSGSVQYVPRDNANDKDKYTHKQSSRESYHAGLKYENADFFGQYAGSFAKYADLKDNAERVAVGTTGAHPVKDYQVHRVVAGYDANDLYVSVAGQYEAAKNNDGTANQGKKHEQTQVAATAAYRFGNVTPRVSYAHGFKAKVNGVKNASYQYDQVIVGADYDFSKRTSALVSAGWLQEGKGINKTEKTASM

SEQ ID NO: 22438 - protein, 375 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSIDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGIGGAISSSKRTWDQNNTGLIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 22439 - protein, 926 aa, Pseudomonas fluorescens
MSAIRTSARCGLLLALMGPLLDTAAVAADNLVTQSPGASATQFQFSIASGSLAQALVVFSRVTGIDVIVDGSLDSQLTSAGLSGTMSADAALDHLLANSGMQWYFSSSNTVQLVRSSAARTRSDAIQLGPVRVQATTISDEVYQTAGSMSVLKRDEIERFRGTSVGDIFKGTTGVLVGENRNSGGLDVNIRGMQGQSRVPVLIDGARQETTVWRGYAGVASRTYVDPDLIGAIEISKGPVMSAEGTGATGGVVSMRTIEANDVIKPGQDWGMRARGSLMGNSSSAPEVGTVSGMNGTNKTYRINCAVASLCAGQYAMPASFGLDEGLNRPDWFDLRSWAGSLALARRFDNVDVLVAYAERNQGNYYSGSDGPVPELEMVYRVLPFYTEVTALREGVSRFRAEERIANSNMDSNTLLLKSNIYLADDKIWELSYQRYDSTYGELMPSQLIWLSEVKQTRGSEVTAQTFSSRYHWEPADNDWINVSFNQWYTRTDSINRNYSEDLLFAEPEPEQYDRIGVELSNKMTVEYWGLHNLNYGVSAQREDMDTDIGEGDSITAISNTSYGRIGDRSEFSVFFDWQWKPLATLTWQAGLRYSRAKTDDHKQVVPTGRNENLYDDEGNIIDTLWVESVFCVDNDGDGECDPIRYRTNNSGTAPVVSVIYEPWLNGLQFYARHAQAYRMPSLFETTQGWSVQPSLDYPLRPEHASNNEIGINYLANSALFEDDRLALKLAYFNNITEDYLTRTSPNLWEESGQFFVMRNIESVSLDGTELSLEYDTGIAYTKLGGTYYDFIEVCHYGSYRRERCNNYGVANSYFNNMIPPRWHANATLGARLFNQRLDIGVRGTFMGQRTPTPDFNDDTARGFNSPVPWHEYTIWDAYVSWKHNDILSIDFNVDNLTDQYYLDALSLGMVPAPGRTARLSFTVNF

SEQ ID NO: 22440 - protein, 357 aa, Erwinia carotovora
MKKTAIAVAVAVAAFATVAQAAPKDNTWYTGGKLGWSHYEHAKFTFEDAAGDETSVGTGKKTRDQLGAGLYAGYQYNQYMGFEMGYDWFGKMKYKGDNAGSVSSMGVSLTTKLSYPVMEDLDVYTRLGGMVYRTEAKVNGVGKETDTGVSPVYALGLEYAITPELATRLDYQWVSRMGDKDNIGVSPDNGMLSVGLAYRFGQEAAPVVAPAVVAEPAAPVVENKRFTLRSDVLFNFNKATLKPEGQQALNELYNELSNIDPTQGRVLVVGFTDRIGSQNYNLPLSQKRAQSVVDYLVAKGVPASAIAAEGRGKEDPVTGNKCDAVKGRAALIECLAPDRRVEIEIQGTTEVVTQPGA
